United States Patent 11,098,302 (IDENTIFICATION OF POLYNUCLEOTIDES ASSOCIATED WITH A SAMPLE) - sequence listing, part 47

SEQ ID NO: 159778 - DNA, 500 bp, Homo sapiens
  misc_feature: GYAE6OF01BKL7W.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaatcaacagagtggaggctgaggatgttggggtttattacgtgcatgcaagctctacaaactccctacaacgttcggcggagggaccaagggtgagatacgaaacgactgtggctgcaccatctgtcttctac

SEQ ID NO: 159779 - DNA, 545 bp, Homo sapiens
  misc_feature: GYAE6OF01DNZG7.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaacttatttggattggtacctgcagaagccaggcagtctccacagctcctgatctatttggtctaatcgggcctccgggtcctgacaggttcagtggcagtggatcgagcactagtattttacactagaaatcaacagagtggaggctggaggtagttggtttagggtttattacgtgactagtgacaagtctactaactaacctccctacgtaacgttcggacggacggaccgaagggtcggagaacgtaccgaaacgacgtggtcggacgtcgaccgtacctacttacgttcgttccttcgtaccg

SEQ ID NO: 159780 - DNA, 481 bp, Homo sapiens
  misc_feature: GYAE6OF01A16VS.19.83.H06.1.454.CMB.1.raw
  modified_base (466)..(466): a, c, t, g, unknown or other
  misc_feature (466)..(466): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacactatttggattggtacctgcagaagccagggcagtctccacagctcctgatctatttggtctaatcgggcctccggggtcctgacaggttcagtggcagtgatcaggcacagattttacactgaaatcaacagagtgaggctgaggatgttggggttattacgtgcatgcagctctacaactccctcacgttcgcggaggatcgaaggtggagagtcaagactgtgcngcacatctgtcttac

SEQ ID NO: 159781 - DNA, 508 bp, Homo sapiens
  misc_feature: GYAE6OF01E4K6M.19.83.H06.1.454.CMB.1.raw
  modified_base (334)..(334): a, c, t, g, unknown or other
  misc_feature (334)..(334): n is a, c, g, or t
  modified_base (379)..(379): a, c, t, g, unknown or other
  misc_feature (379)..(379): n is a, c, g, or t
  modified_base (489)..(489): a, c, t, g, unknown or other
  misc_feature (489)..(489): n is a, c, g, or t
tcagtactctcgtgcacgaccggtgctcgatttagatcacgtgcgtcgacggggcgtagactttgtgtttctcgtagtctgctttgctcagcgtcagggtgctgctaatgctctgggtctctggatccaggtggggatattgtggttgactcagtcttccactctccctgcccgtcattcctggagagccggcctccatcgtcctgcaagtctagtcagacgcctcctacatagtaatggacacaactatttggattggtacctgcagaagccagggcagtctccacagctcctgatctatttgggttctaatcgggcctccggggtcctgacnggttcagtgcagtgatcaggcacagtatttacactagaaatcaanagagtggaggctgaggtatggttagggtttattactgcatgacagtctactaacaactccctacaacgttcggacggaggaccaaggtgagatacgaaacgatggtcgcngacacatctgtctctaccg

SEQ ID NO: 159782 - DNA, 505 bp, Homo sapiens
  misc_feature: GYAE6OF01BHSH1.19.83.H06.1.454.CMB.1.raw
  modified_base (481)..(481): a, c, t, g, unknown or other
  misc_feature (481)..(481): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaatcaacagagtggaggctggaggatggttggggtttattactgcatgcaagctactaacaactccctacaacgttcggcggagggaccaaggtggagatacgaaacgaatggnggctgacaccatctgtcttcgtac

SEQ ID NO: 159783 - DNA, 549 bp, Homo sapiens
  misc_feature: GYAE6OF01BUR1V.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctattggtctaatcggacctccgggtccctgactaggttcagtggcagtggatcaggcacagtatttacactagaaatcaacagagtggaggctaggaggtagttggtttaggggtttaattacgtgtctagtgacaagtctactaacaacctcccgtacgtaacggttcggaggacgggaacgtaagggtggaacgaagtacgaaaacgtagtacggtggtacctagacctacctattacgtcgttcttccgtaaccg

SEQ ID NO: 159784 - DNA, 547 bp, Homo sapiens
  misc_feature: GYAE6OF01A1GQE.19.83.H06.1.454.CMB.1.raw
  modified_base (290)..(290): a, c, t, g, unknown or other
  misc_feature (290)..(290): n is a, c, g, or t
tcagtactctcgtgcacgaccggtgctcgatttagatcacgtgcgtcgcgggcgtagtacgtttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagcctccngatctagtttgggttactaacgtccgggccgtccgggtccctgacgtaggttcagtggcagtggatcgagcacagtatttacactagaaatcaacagtagtaggagcgtaggaaggtagttgggtttaggggtttaattacgtgactagtgacaacgtctacctaactaacctcctacgtacgttcgggacggacggacgaaggtgagacgtacgaaacgtactggtcgctgacctactactactgttcctctaccg

SEQ ID NO: 159785 - DNA, 527 bp, Homo sapiens
  misc_feature: GYAE6OF01ARLTO.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaatcaacagagtggaggctgaggatggttggggtttattacgtgacagtgacaagctacgtaacaacttcccctacgaaccggtttcggacggagggacccaaggtggagacgtacgaaacggtaactggtggctgaccacctatcctgttcctcgtacc

SEQ ID NO: 159786 - DNA, 536 bp, Homo sapiens
  misc_feature: GYAE6OF01A6YXY.19.83.H06.1.454.CMB.1.raw
  modified_base (173)..(173): a, c, t, g, unknown or other
  misc_feature (173)..(173): n is a, c, g, or t
  modified_base (531)..(531): a, c, t, g, unknown or other
  misc_feature (531)..(531): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactctagtctccactctccctgcccgtnattcctggagagccggcctcatctcctgcaagtctagtcagacgcctcctacatagtaatggacacaactatttggattggtaccttgcagaagccaggcagtctccacaggctcctgatcgtattgggtctaagtcgggtcctcggggtcctgacaggtacagtggacagtgatctaggcacgagtattttacactagaaactcaacagagtaggagctagagtatcggttaggggtttattacgtgtacagtgacaagtctactaactaaactcccgtacgaaccggttcggacggacgggtaaccaaggtggagtatacgaaacgtagtggtgacgtgacctactatctgtcctntaccg

SEQ ID NO: 159787 - DNA, 501 bp, Homo sapiens
  misc_feature: GYAE6OF01BH11C.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaatcaacagagtggagctgaggatggttgggtttattactgcatgacaagctactaacaaactccctacaactagttcggacggaggaccaaggtggagagtacaaagaactgtggctcgcacatctgtcttac

SEQ ID NO: 159788 - DNA, 521 bp, Homo sapiens
  misc_feature: GYAE6OF01C6QVO.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagcagggcagtctccacagctcctgatctatttgggttctaatcgggcctccgggtcctgacaggttcagtggcagtggatcaggcacagattttacactagaaatcaacagagtgggaggctgaggtatggtttggggtttattacgtgcatgacaagctacctaacaaacctccctacaaccgtttcgggacgggacgggaaccgaagggtggagatacgaaacgtagtgtggcttgctaccatctcgtcttctacc

SEQ ID NO: 159789 - DNA, 545 bp, Homo sapiens
  misc_feature: GYAE6OF01AQ3TG.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggtctaatcgggcctccgggtcctgacaggttcagtggcagtggatcaggcacagtattttacactagaaatcaacagagtggagctaggaggtagtggtttaggggtttattacgtgctagtgacaagtcctactaaccaaacctccctacgtaacggttcgggacgggacgggaccgtaagggtggacgaatacgaaacgtaacgtggtcggacgtcgactaacctacgtcgtcgttcttccgtacg

SEQ ID NO: 159790 - DNA, 521 bp, Homo sapiens
  misc_feature: GYAE6OF01EES4X.19.83.H06.1.454.CMB.1.raw
  modified_base (497)..(497): a, c, t, g, unknown or other
  misc_feature (497)..(497): n is a, c, g, or t
  modified_base (511)..(511): a, c, t, g, unknown or other
  misc_feature (511)..(511): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatcctcctgcaagtctagtcagagcctcctacatagtaatggacacaacttatttggattggtacctgcagaagccgagggcagtctccacagctcctgatctagtttgggttactaagtcgggccgtccgggtcctgacaggtcagtggcagtggatcgaggcacagtatttacactagaaatcaacagagtggagctagaggtagttggtttagggtttattacgtgcagtgacaagtctactaacaacctcctactacggttcggacggacggacgaaggtaggagaatacgaaacgtatgnggctgacctacatntgtctcgtac

SEQ ID NO: 159791 - DNA, 517 bp, Homo sapiens
  misc_feature: GYAE6OF01DJMQG.19.83.H06.1.454.CMB.1.raw
  modified_base (492)..(492): a, c, t, g, unknown or other
  misc_feature (492)..(492): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaagtccgggcctccgggtcctgacaggttcagtgcagtggatcgaggcacagtatttacactagaaatcaacagagtggagcgtgaggattggttgggtttattacgtgcatgacaagtctactaactaacctcccgtactaacggttcggacgggacggacgaagggtggagatacgaaacgagtggnggactgacacattctgtctctaccg

SEQ ID NO: 159792 - DNA, 504 bp, Homo sapiens
  misc_feature: GYAE6OF01A28X4.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatggttggggtttattactgcatgcaagctctaacaaactccctacaacgttcggcggagggaccgaaggtggagatacgaaacgaatggtggctgcaccatctgtcttctac

SEQ ID NO: 159793 - DNA, 556 bp, Homo sapiens
  misc_feature: GYAE6OF01CHOVQ.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctctacatagtaatggacacaactatttggattggtacctgcagaagccagggcagtctccacagctcctgatctagtttggttctaagtcgggcctccggggtccctgacaggttcagtggcagtggatcaggcacagtattttacactagaaatcaacagagtggaggctaggaggtagttggtttggggtttattacgtgctagtgacaagtctactaacctaaaccttccctacgtaaccggttcggacgggacgggaaccgtaagggtaggacgtagtacgaaacggtaacgtggtcggacgtacgacctaccgtactcttcgttcttcgtaccg

SEQ ID NO: 159794 - DNA, 519 bp, Homo sapiens
  misc_feature: GYAE6OF01CRTMH.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactagaaatcaacagagtggaggctgaggagttggttggggtttattacgtgctatgcaagcttcctaacaaaccttccctacaaccggtttcggacggagggaccgaaggtggagatacgaaacgactggtcggctgcacatctcgtcttcgtac

SEQ ID NO: 159795 - DNA, 523 bp, Homo sapiens
  misc_feature: GYAE6OF01DOAVJ.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccgggtcctgacaggttcagtgcagtggatcaggcactagattttacactagaaatcaacagagtggagctggaggtatgttggggttattactgcatgacaagtctactaacaaaccttcccctacgtaaccggttcgggacggagggaaccgaaagggtggacgagtacgaaacgtaactggtgcgtgaccaccatctgtcttcgtac

SEQ ID NO: 159796 - DNA, 540 bp, Homo sapiens
  misc_feature: GYAE6OF01DPQWO.19.83.H06.1.454.CMB.1.raw
tcagtactctcgtgcacgaccggtgctcgatttagatcacgtgcgtcgcgggcggtagactttgtgtttctcgtagtctgctttgctcagcgtcagggtgcctgctaatcgctctgggtctctggatccagtgggatattgtggtgactcagtctccactctccctgccccgtcattcctggagacgcccggcctccatctcctgcaagtctagtcagagcctcctacatagtaatggaacacaactattggattggtacctgcagaagccagggcagtctcacagctcctgatctatttggtctaatcggcctccgggtcctgacagttcagtggcagtggatcgaggcacagtacttttacactagaaatcaacgagagtggagctaggaggatggttgggttattactgctatcgcaagctactaacaactcccgtacaacggttcggacggacgggaaccgtaaggtcggacgaagtacgaaacgtacgtacggtcggctaggaccgtaacctacgtacgtcgttcctccgtaccg

SEQ ID NO: 159797 - DNA, 520 bp, Homo sapiens
  misc_feature: GYAE6OF01DM1GB.19.83.H06.1.454.CMB.1.raw
  modified_base (325)..(325): a, c, t, g, unknown or other
  misc_feature (325)..(325): n is a, c, g, or t
  modified_base (505)..(505): a, c, t, g, unknown or other
  misc_feature (505)..(505): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagagcctctacatagtaatggacacaactatttggattggtacctgcagaagccagggcagtctccacagctcctgatctatttgggtctaatcgggcctccgggtcctgacnggttcagtgcagtggatcaggcacagtattttacactagaaaatcaacagagtggagctagaggatggttaggggtttattacgtgacatgacaagtctactaactaaacctccctacgaacgttcggacggagggaccaaggtggaagatacgaaacgaatggtcggctgacctacatnttacgtcttctaccg

SEQ ID NO: 159798 - DNA, 504 bp, Homo sapiens
  misc_feature: GYAE6OF01C09O5.19.83.H06.1.454.CMB.1.raw
  modified_base (177)..(177): a, c, t, g, unknown or other
  misc_feature (177)..(177): n is a, c, g, or t
  modified_base (293)..(293): a, c, t, g, unknown or other
  misc_feature (293)..(293): n is a, c, g, or t
  modified_base (366)..(366): a, c, t, g, unknown or other
  misc_feature (366)..(366): n is a, c, g, or t
tcagtactctcgtgcacgaccggtgctcgatttagatcacgtgcgtcggacggggcgtagactttgtgtttctcgtagtctgctttgctcagcgtcagggtgctgctaaatgctctgggtctctggatccaggtggggatattgtggttgactcagtctccactctccctgcccgtnattcctggagagccggcctccatcgtcctgcaagtctagtcagagcctctacatagtaatggacacaactatttggattggtacctgcagaagccagggcagtctccacagctccngatctatttggtctaatcgggcctccggggtcctgactaggttcagtgcagtggatcaggcacagtattttanactagaaatcaacagagtgagctgagatgttgggtttatactgctatgcaagctactacaaactcctacaacgttcgacggaggaccaaggtgagatacgaaacgaatggtgacgtgcacctatctgtcgttctaccg

SEQ ID NO: 159799 - DNA, 592 bp, Homo sapiens
  misc_feature: GYAE6OF01BZXGN.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatctcctgcaagtctagtcagagcctcctacatagtaatggacacaacttatttggattggtacctgcagaagccgagggcagtctccacagcctcctgattcttagtttgggtctaagtccgggtccgttccgggtcctgacgtaggttcaggtggcgtaggtggatcgaggcacagtactttacactagaaatcaacgaggagtggaggcgtaggaagggtagttagggtttagggttttattacgtgacgtagtcgtacaacgtctaccttaacctaaacccgttccctaccgtaacggttcgggacgggtacgggaaccgtaagggtaggaacgtaacgtaaccgaaacgtacgtggtcggacgtacgacctacctatcttcgttcctcgtaccg

SEQ ID NO: 159800 - DNA, 502 bp, Homo sapiens
  misc_feature: GYAE6OF01BXIDR.19.83.H06.1.454.CMB.1.raw
  modified_base (495)..(495): a, c, t, g, unknown or other
  misc_feature (495)..(495): n is a, c, g, or t
  modified_base (499)..(499): a, c, t, g, unknown or other
  misc_feature (499)..(499): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccgggtccctgacaggttcagtggcagtggatcaggcacagattttacactagaaaatcaacagagtggaggctagaggatggttggggtttattacgtgcatgcaagctactacaactccctactaacgttcggcggagggaccaaggtggagatacgaaacgatggtggctgcacatctntctntac

SEQ ID NO: 159801 - DNA, 502 bp, Homo sapiens
  misc_feature: GYAE6OF01AMPZL.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggtctaatcgggcctccgggtcctgacaggttcagtggcagtggatcaggcacagtattttacactagaaatcaacagagtggaggctggaggattggttggggtttattacgtgcatgcaagctctaacaacctccctcgaacgttcggacggagggaccaggtggagatacgaaacgatggtggctcgcacatctcgtctctac

SEQ ID NO: 159802 - DNA, 518 bp, Homo sapiens
  misc_feature: GYAE6OF01B6TG8.19.83.H06.1.454.CMB.1.raw
  modified_base (510)..(510): a, c, t, g, unknown or other
  misc_feature (510)..(510): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccgggtccctgacaggttcagtggcagtggatcaggcacagattttacactagaaatcaacagagtggagctgaggatggttaggggtttattacgtgcagtgacaagctactaactaacctccctacaaccgttcggacgggagggaccgaagggtggagatacgaaacgaactggtggctgccaccatctcgttnttctaccg

SEQ ID NO: 159803 - DNA, 519 bp, Homo sapiens
  misc_feature: GYAE6OF01CQ5T3.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggtctaatcgggcctccggggtcctgacaggttcagtggcagtggatcaggcacagattttacactagaaatcaacagagtggaggctggaggtatggttgggtttattactgctatgacaagcttactaacaaacctccctacaacggttcggacgggacggaccgaaggtacggagagtacgaaacggaactggtcggctgacacctatctgtcttctacc

SEQ ID NO: 159804 - DNA, 516 bp, Homo sapiens
  misc_feature: GYAE6OF01CVLM1.19.83.H06.1.454.CMB.1.raw
  modified_base (445)..(445): a, c, t, g, unknown or other
  misc_feature (445)..(445): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctagttttgggttctaagtcgggcctccggggtcctgacaggttcagtggcagtggatcgaggcacagattttacactagaaatcaacagagtggaggcgtgaggtatggtttgggtttattacgtgcatgacaagctactacaacctcccgtanacggttcggacggaggaccaagggtgagatacgaaacgacgtggtgctgacctaccattctcgtcttctac

SEQ ID NO: 159805 - DNA, 534 bp, Homo sapiens
  misc_feature: GYAE6OF01BUQND.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttggtctaagtcgggccgtccgggtccctgacgtaggtcagtggcagtggatcaggcacagtatttacactagaaatcaacagagtggagcgtagaggagttggttagggtttattacgtgacagtgacaagtctactaacctaacctaccctacgtaaccgttcgggacggtaacgggaccgaaggtagaagtagtacgaaacgtacgtagtcggactgacacctatactcgtcttctac

SEQ ID NO: 159806 - DNA, 542 bp, Homo sapiens
  misc_feature: GYAE6OF01DMY7J.19.83.H06.1.454.CMB.1.raw
  modified_base (171)..(171): a, c, t, g, unknown or other
  misc_feature (171)..(171): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagagccggcctccatctcctgcaagtctagtcagagcctctacatagtaatggacacaactattggattggtacctgcagaagccagggcagtcctccacgagctcctgatctagtttgggttctaagtcgggcctccggggtccctgactaggttcagtggcaggtgatcgaggcactagtattttacatagaatcaacagagtggagctgaggtatggttgggtttattacgtgctagtgcaagtctactaacaaaccttccctacgtaacggttcggtacggaggtaccgaaggtggacgtataccgaaacgtacgtggtcgacgtagacctaccgtactccgttcgtcgttcgtaaccg

SEQ ID NO: 159807 - DNA, 521 bp, Homo sapiens
  misc_feature: GYAE6OF01A0OZ3.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctcccctgcccgtcattcctggagagccggcctccatctcctgcaagtctagtcagagcctcctacatagtaatggacacaactattggattggtacctgcagaagccagggcagtctccacagctcctgatctatttgggttctaagtcgggcctccgggtcctgacaggttcagtggcagtggatcaggcacagtattttacactagaaatcaacagagtggagctggaggtatggttaggggtttattactgcatgacaagctactaacaactccctacgaacgttcgggacgggacgggaccaagggtggagtaactacgaaacgagtaggtggctgaccaccatctgttccttctacg

SEQ ID NO: 159808 - DNA, 512 bp, Homo sapiens
  misc_feature: GYAE6OF01C9J7A.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagagcctcctacatagtaatggacacaactatttggattggtacctgcagaagccagggcagtctccacagctcctgatctatttgggtctaatcgggcctccggggtccctgacaggttcagtggcagtggatcgaggcacgagattttacactagaaatcaacagagtggaggctgagagtgttggggtttattacgtgcatgcaagtctactacaacctccctacgacgttcggacggagggaccaagggtggagatacgaaacgagtggtggactgacacatcttcgtctctaccg

SEQ ID NO: 159809 - DNA, 521 bp, Homo sapiens
  misc_feature: GYAE6OF01CYS3I.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcgaggcacagtattttacactagaaatacaacagagtggaggctgaggtagtggttggggtttattacgtgcatgcaagtctactaacaaccttccctcaacgttcggacggacgggaaccgaaggtaggagagtacgaaacgtaactggtgctagctaccatctcgtcttctac

SEQ ID NO: 159810 - DNA, 656 bp, Homo sapiens
  misc_feature: GYAE6OF01AZH5N.19.83.H06.1.454.CMB.1.raw
  modified_base (345)..(345): a, c, t, g, unknown or other
  misc_feature (345)..(345): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtccagacgcctcctacatagtaatggacacaactatttggattggtacctgcagaagccagggcagtctccacagctcctgatctatttgggtctaatcgggcctccgggtcctgactaggtcagtggcagtgatnaggcacagtattttacactagaaatcaacagagtggagctggaggtagtggtttaggggtttactttacgtgtcgtaagtcgtactaaaggtccttaacctaaccctaaaccgttacccccgttaaccgtaaaaccgggttttcccggggaccggggtaaacggggtaaccccggtaaacgggggttacgggaaacggtaaccgttaacccgaaaaaccgggttaaaccgttacgggttacgggtaccgttacggtacccgtaacccggttaacttacccgttacggtttacccgtttccgttaaaccccg

SEQ ID NO: 159811 - DNA, 509 bp, Homo sapiens
  misc_feature: GYAE6OF01BKO60.19.83.H06.1.454.CMB.1.raw
  modified_base (504)..(504): a, c, t, g, unknown or other
  misc_feature (504)..(504): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagtatttacactagaaatcaacagagtggaggctggaggtattggttggggtttattacgtgcatgacaagctctaacaactccctacgaacgttcggcggaggaccaggtgagatacgaaacgtactggtgctggacaccatctgtcttntaccg

SEQ ID NO: 159812 - DNA, 549 bp, Homo sapiens
  misc_feature: GYAE6OF01EZUFH.19.83.H06.1.454.CMB.1.raw
  modified_base (263)..(263): a, c, t, g, unknown or other
  misc_feature (263)..(263): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaanccagggcagtctccacagctcctgatctatttgggttctaagtcgggcctccggggtcctgacgtaggttcagtggctagtggatcgaggcacgagtatttacactagaaatcaacagaggtggaggctagaggtagttggtttgggtttatacgtgctagtgacaagtctactaacaacccttacccgtacgtaaccggttcggacgggtagggtaaccgaagggtaggagactacgaaacgtacgtggtcggactgacctacctataccgtgttactcgtaccg

SEQ ID NO: 159813 - DNA, 501 bp, Homo sapiens
  misc_feature: GYAE6OF01A79A8.19.83.H06.1.454.CMB.1.raw
  modified_base (492)..(492): a, c, t, g, unknown or other
  misc_feature (492)..(492): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttaggggtttattactgcatgcaagctctaacaactccctacaacgttcggcggagggaccaaggtggagatcaaacgaactggtgctgcaccatctntcttctacg

SEQ ID NO: 159814 - DNA, 585 bp, Homo sapiens
  misc_feature: GYAE6OF01BH3PP.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccaggcagtctccacagctcctgatctatttggtctaagtcggcctccgggtcctgacaggtcagtgcagtgatcaggtcacagtatttacactagaaatcaacagagtcggaaggctaggaggtaagtggtttaggggtttacttagtggtcaagtcgactaacgtcgttactaacctaaaccttacccgtacgtaaccggttaccgggacgggaacgggacccgtaaagggtggtaacgtaagtaccgtaaaacggtacgtacggttcggacgttacgacccgtaacctacgttacttacgttccgttccgttaacccg

SEQ ID NO: 159815 - DNA, 541 bp, Homo sapiens
  misc_feature: GYAE6OF01BBJ7A.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggccccccatctcctgcaagtctagtcagagcctcctacatagtaatggacacaactatttggattggtacctgcagaagccagggcagtctccacagctcctgatctatttgggttctaagtcgggcctccggggtccctgacaggttcagtggcagtggatcaggcacagtattttacactagaaatcaacagagtggaggcgtgaggtagtggtttaggggtttattacgtgctatgacaagtctactaacctaaacctccctacgtaacgttcggtaggacgggaccgaagggtggaagtacgtacgaaacgtacgtggtaggctgacacctatcgtagttcttcagttccc

SEQ ID NO: 159816 - DNA, 565 bp, Homo sapiens
  misc_feature: GYAE6OF01C59RW.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctcacagctcctgatctatttgggttctaagtcgggcctccggggtcctgacgtaggttcagtggcagtggatcgaggcacagtactttacactagaaaatcaacgagagtggaggctggaggtagttggtttaggggtttattacgtgactagttagacgtaagtctacttaaccaaaccttcccctacgtaaaccggttcgggaacgggacgggaaccgtaaagggtcgaaggactacgaaaacgaacgttggtacggcctagacctacctatctacgtcttcgtaccg

SEQ ID NO: 159817 - DNA, 554 bp, Homo sapiens
  misc_feature: GYAE6OF01EF97Q.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttggttctaagtccgggcctccggggtcctgacgaggttcagtggcagtggatcgaggcacagtatttacactagaaatcaacagagtggaggtctaggaggtagttggtttaggggttttattacgtgcagtcgacaagtctactaactaaccctccctacgtaacggttcgggacgggacgggaaccgaagggtaggacgaataccgaaacgtaagtggtcggccgtagaccgtaacctatcgttcttccgttctaccg

SEQ ID NO: 159818 - DNA, 947 bp, Homo sapiens
  misc_feature: GYAE6OF01DQ936.19.83.H06.1.454.CMB.1.raw
tcagtactctcgtgcacgaccggtgctcgatttagatcacgtgcgtcggtcggggcgtagacttgtgtttctcgtagtctgctttgctcagcgtcagggtcgctgctaatgcgtctggtctctggatccaggtggggactagttgtcggtagactcagtctccactctccctcgcccgtcacttccctggagtacgcccggcctccatcgtccgtgacgaagtcctacgtcagacgtccctccgtacattacgtaagtaggactaactaacgtttagtttggacgtttcgggtaaccttgacgaagaagaccgacgggacgacggtccccttacccgaacgtacgtaccttcccgttagtacgtttaccgtttacgtttttcggggtttaccttaaacggtttcccgggggtaccccggtttacccccggggggttaccccgttaccgggtaaaccgttaacggggtttaccggtaacgggttacggggacccgtaaggggttacggggtaacgttacccggtaacggggtaccgtaaaccggtaaacgggtttaaacctttttttaaacccgaaaccgtttaaacgggtaaaaaccttaacccgtaaaaccggtaacggggtaaacgggttacggggtaaacggggtcccgttaagggtaacggggttaacggtttaccggggttttttaggggggtttttaaactttaccgggtttacggttaaccgtaacgttacgttaaccggtaaccgttacccgttaaacccggttaaaccctaaaacccgtttacccccgttaaccgggttaaacccgggtttccggggaaccggggtaccgggtaacccggtaaacggggtacggaacggtacgtaacggaaaaccggtacgtacgggttacggaccgttacggacctaccgtacttaccggtcttccttacgtacccg

SEQ ID NO: 159819 - DNA, 655 bp, Homo sapiens
  misc_feature: GYAE6OF01B6R4Z.19.83.H06.1.454.CMB.1.raw
  modified_base (505)..(505): a, c, t, g, unknown or other
  misc_feature (505)..(505): n is a, c, g, or t
tcagtactctcgtgcacgaccggtgctcgatttagatcacgtgcgttcggtcgggggtcgtaggactttcgtgtttcctcgttagtctggctttgcttctagcgtcagggtgctgtctaatgtctcgtggggtctcttaggattcctagggtaggggtagtaacttggtggtagtaccttccaggtcctaccacctacgtcccctaccgcccgttctacttcctggacgtaccgcccggtcccttccacttctccgtgctaaggtcgtacggtcaggacgcctcctacatagtaatggacacaatattggattggactgcagaagccgagggcagtctccacagctcctgatctagtttggtctaagtcgggccgtccgggtcctgacgtaggttcagtggcagtggatcgaggcatagtacttttacacttagaaactcgaacaggtaggtagggaggtgtaggaaggtagttggtttaggggtttattacgtgtctagttganaacgtcttactaacctaacctacccgttacgtaacgggttcgggacgggtacgggaaccggtaagggttaggaacgtaacgtaaccgaaacggtaacgtcgggttacggacgtacggacctactaactcgttacgttccttcgttaaccc

SEQ ID NO: 159820 - DNA, 543 bp, Homo sapiens
  misc_feature: GYAE6OF01ANC2D.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctcccctgcccgtcattcctggagagcccggcctccatctcctgcaagtctagtcagagcctcctacatagtaatggacacaactatttggattggtacctgcagaagccagggcagtctccacagctcctgatctatttggtctaagtcgggcctccgggtcctgactaggttcagtggcagtggatcgaggcacagtatttacactagaaatcaacagagtggagcgtagaggtagttggtttgggtttattacgtgcgtatgacaacgtcctacctaacaaaccgtcccgtacgtaaccggttcggacggagggaccgtaggcgaagactaacgaaacgtacgtggtcgccgtagacctaacactctcgttccttcgtaccg

SEQ ID NO: 159821 - DNA, 629 bp, Homo sapiens
  misc_feature: GYAE6OF01DGBY6.19.83.H06.1.454.CMB.1.raw
  modified_base (171)..(171): a, c, t, g, unknown or other
  misc_feature (171)..(171): n is a, c, g, or t
  modified_base (177)..(177): a, c, t, g, unknown or other
  misc_feature (177)..(177): n is a, c, g, or t
  modified_base (182)..(182): a, c, t, g, unknown or other
  misc_feature (182)..(182): n is a, c, g, or t
  modified_base (225)..(225): a, c, t, g, unknown or other
  misc_feature (225)..(225): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtgggatattgtggtgactcagtctccactctccctgcccgtnattccnggagngcccggcctccatctcctgacaagtctagtcagacgcctccanatagtaatggacacaacttagttggattggtacctgacagaagccgagggcagtctaccacagctcctgattctagtttggtactaagtccgggccgtccgggtcctagacgtaggttcagtggctaggtgaactcgaaggctaacgtagttaactttaccgactaagaaaactcaaacgaggagtaggagtcgtagaggtagttggtttagggtttatacgtgactagtacgacgtaagtcttacctaacctaacccgttccccgtaacgtaaccgggttccgggaacgggtaacgggaaccggtaagggtacggaaacgtacgtaaaccgtaaaccggtaacgttacggtacgggcctagtaacccaaccgtacgttacgtcggttaccttcgttaaccccg

SEQ ID NO: 159822 - DNA, 531 bp, Homo sapiens
  misc_feature: GYAE6OF01AVEHO.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggtctatcgggcctccggggtcctgacaggttcagtggcagtggatcaggcacagtattttacactagaaatcaacagagtggaggctggaggtagttggtttggggtttattacgtgctattgactaagctactaaccaaccttccctacgtaacggttcggacgggaggacccgaagggtgagtatacgaaacgtacgtggtggaccgtgaccgaccatctgtcttcgtacg

SEQ ID NO: 159823 - DNA, 538 bp, Homo sapiens
  misc_feature: GYAE6OF01DP7D7.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcggagcctcctacatagtaatggacacaactatttggattggtacctgcagaagccagggcagtctccacagctcctgatctatttgggttctaagtcgggcctccggggtccctgacaggttcagtggcagtggatcaggcacagtattttacactagaaatcaacagagtggaggctgaggtagttggttaggggtttattactgactagtgactaagctactaacctaaacctccctacgtaacgttcggacggaagggaccaagggtgaagatacaaacggtactgtcggctacgcaaccgtattcgtgttcttctacttcccg

SEQ ID NO: 159824 - DNA, 555 bp, Homo sapiens
  misc_feature: GYAE6OF01BL9MD.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactagaaatcaacagagtggaggctagaggatggttggggtttattacgtgctatgacaagtctactaacaacctccctacgtaacgtttcgggacggtacgggaacccgtaagggtacgggagaacgtacgaaaaccgaacgttggtcgggccgtagacccacctagttacctcgttctttccgtaacccg

SEQ ID NO: 159825 - DNA, 559 bp, Homo sapiens
  misc_feature: GYAE6OF01B0L96.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagcagggcagtctccacagctcctgatctatttggtctaagtcgggccgtccgggtcctgactaggttcagtggcgagtgatcaggcacagtattttacacgtagaaatcaacgagagtagggagcgtaggaggagttgggtttaggggtttaattacgtgcagtgacaagccttactaacctaacctccccgtacgaaccggttcgggaccgggagggaaccgtaagggtaggaagtaataaccgaaacgtaacgtggtacggcgtcgacctacctagtcttcgttcttcgtaccc

SEQ ID NO: 159826 - DNA, 504 bp, Homo sapiens
  misc_feature: GYAE6OF01COEOF.19.83.H06.1.454.CMB.1.raw
  modified_base (414)..(414): a, c, t, g, unknown or other
  misc_feature (414)..(414): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctcggggtccctgacaggttcagtgcagtgatcaggcacagattttacacctgaaaatcaacagagtaggaggctgagagtgttggggtttattactgcatgnaagctctaacaaactaccctcaacgttcggcggagggaccaaggtggagagtcgaaaacgaatacgtggctgcaccatctgtcttctacg

SEQ ID NO: 159827 - DNA, 580 bp, Homo sapiens
  misc_feature: GYAE6OF01AZK96.19.83.H06.1.454.CMB.1.raw
  modified_base (195)..(195): a, c, t, g, unknown or other
  misc_feature (195)..(195): n is a, c, g, or t
tcagtactctcgtgcacgaccggtgctcgatttagatcacgtgcgtcggtcggggacgtaggaactttgtgtttcgtccgtacgtcgtgtctttggctcaggcgtcagggtgcctggctaatcgcgtctagggtctctcggatccagtgggatagttggtggtggactacgacgtctccactctccctgcccgtnattccgtggagcgcccggtcctccatctcctgcaagtctagcaagcgcctctacatagtaatcggacaacaattatttggattggtacctgacagacgccgagggcagtctccacagcctcctgactcttagtttggtactagtccgggcctccgggtcctgactagttcagtgcaggtgatcgaggcacgagtatttacactagaaatcaagagagtgagtctaggagtagttgggttagggtttatacgtgtactatcggactaagtcctacgtaacctaacctcccgtagaaccggttcggacggtaacggaccgaaggtcgagtacgtacgaaacggtagtcggtcgacgtgacctacgtactgttaccgtcttccgtacc

SEQ ID NO: 159828 - DNA, 496 bp, Homo sapiens
  misc_feature: GYAE6OF01CXPUI.19.83.H06.1.454.CMB.1.raw
  modified_base (171)..(171): a, c, t, g, unknown or other
  misc_feature (171)..(171): n is a, c, g, or t
  modified_base (408)..(408): a, c, t, g, unknown or other
  misc_feature (408)..(408): n is a, c, g, or t
  modified_base (493)..(493): a, c, t, g, unknown or other
  misc_feature (493)..(493): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagagccggcctccatctcctgcaagtcagtcagagcctctacatagtaatggacacaactattggatggtacctgacagaagccagggcagtctccacagctctgatctattgggtctaatcgggcctccgggtcctgacagttcagtgcagtgatcagcacagtatttacactagaaaatcaacagagtcggaggctagaggattggttagggttatacgtgcatganaacgctcaactaacctccctacgtaacgttcgggacggacggaccgaggtgagatacgaaacgactgcgctgcacatactgtctnacg

SEQ ID NO: 159829 - DNA, 588 bp, Homo sapiens
  misc_feature: GYAE6OF01C5WN1.19.83.H06.1.454.CMB.1.raw
  modified_base (223)..(223): a, c, t, g, unknown or other
  misc_feature (223)..(223): n is a, c, g, or t
  modified_base (360)..(360): a, c, t, g, unknown or other
  misc_feature (360)..(360): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctanatagtaatggacacaactatttggattggtacctgcagaagccagggcagtctccacagctcctgacttctagtttgggtctaagtccgggcctcccggggtccctgacgtaggttcagtggcaggtgatcgagcanagtattttacactagaaatctaacgagtagtggaaggtctaggaggtagttaggtttggggttttaattaccgtgacgtagttcgacgtaacgtccttacctaacctaaacccttaccccgtacgtaaccggttacgggacgggtacgggaaccgaagggtggaaggtactaacggaaaacgtacgtaggtgaccgttgaccctactacttagttcgtcttcgtaccg

SEQ ID NO: 159830 - DNA, 509 bp, Homo sapiens
  misc_feature: GYAE6OF01BKPMH.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggttctaatcgggcctccgggtcctgacaggttcagtggcagtggatcaggcacagtatttacactagaaactcaacagagtggagctgagtattggttaggggtttattacgtgcatgcaagctactaaccaactccctataacggttcggacggacggaccaagggtgagatacgaaacgtatggtgctgacaccatctgttcttctaccg

SEQ ID NO: 159831 - DNA, 533 bp, Homo sapiens
  misc_feature: GYAE6OF01CJZJY.19.83.H06.1.454.CMB.1.raw
  modified_base (529)..(529): a, c, t, g, unknown or other
  misc_feature (529)..(529): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagagccggcctccatctcctgcaagtctagtcagagcctcctacatagtaatggacacaactatttggattggtacctgcagaagccaggcagtctccacagctcctgatctatttgggttctaagtcgggcctccggggtccctgacgtaggttcaggtggcagtggatcgaggcacagtattttacactagaaatcaacagagtgggaggctaggaggtagttggtttaggggtttaattacgtgctatgacaagtctactaactaactccctacgtaacggttcggacggtaggaaccgaggtggagtacgtacgaaacgtagtgtggctgcacctatctgttctntacc

SEQ ID NO: 159832 - DNA, 536 bp, Homo sapiens
  misc_feature: GYAE6OF01CS2C7.19.83.H06.1.454.CMB.1.raw
  modified_base (431)..(431): a, c, t, g, unknown or other
  misc_feature (431)..(431): n is a, c, g, or t
  modified_base (532)..(532): a, c, t, g, unknown or other
  misc_feature (532)..(532): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgagtctctggatccagtggggatattgtggtgactcagtctccactcctccctgcccgtcattcctggagacgccggcctccatctcctgcaagtctagtcagagcctcctacataagtaatggacaacaactatttggattggtacctgacagaagcagggcagtctccacagctcctgatcttagtttgggttctaacgtccgggccgtccggggtccctgacgtaggttcaaggtggcagtggatcaggcacagtatttaacactagaaaatcaaacagagtggagcgtagaggtatggttgggtttatactgacntgacaagtctactaacaaacctcccacaaccggttcggacggaagggaccaaggtagaagagtacgaaacgtactggacggctacgacacctaatctcgtntacc

SEQ ID NO: 159833 - DNA, 502 bp, Homo sapiens
  misc_feature: GYAE6OF01B0EAU.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtcctgacaggttcagtggcagtggatcaggcacagattttacactagaaatcaacagagtggagctgaggatggttagggtttattactgcatgcaagctactaacaactccctacaacgttcggtaggagggaccaagggtggagatacgaaacgtatggtgactgacacatctgtctctac

SEQ ID NO: 159834 - DNA, 522 bp, Homo sapiens
  misc_feature: GYAE6OF01BQ3JV.19.83.H06.1.454.CMB.1.raw
  modified_base (483)..(483): a, c, t, g, unknown or other
  misc_feature (483)..(483): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagagcctcctacatagtaatggacacaactatttggattggtacctgcagaagcccagggcagtctcccacagctcctgatctatttgggttctaatcgggcctccgggtccctgacaggttcagtgcagtggatcaggcacagtatttacatagaaatcaacaggagtaggaggctaggaggtagttaggtttggggtttaatttacgtgtctatgacaagtctctaacaacctccctacgaacgttcggacggacggacgaaggtgganagtacgaaacgactggtcgctgactacatctgtctctac

SEQ ID NO: 159835 - DNA, 502 bp, Homo sapiens
  misc_feature: GYAE6OF01B07A4.19.83.H06.1.454.CMB.1.raw
  modified_base (322)..(322): a, c, t, g, unknown or other
  misc_feature (322)..(322): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctctgatctatttggtctagtcgggcctcgggtcctgacnggttcagtgcagtgatcaggcacgagtatttacactagaaaatcaacagagtggaggctagaggtattggttaggggtttattacgtgcagtgcagtctctaacaacctccctacgacgttcggacggacggaccgaggtgagtatacgaacgatggtgctgcaccatctcgtctctacg

SEQ ID NO: 159836 - DNA, 584 bp, Homo sapiens
  misc_feature: GYAE6OF01BOLJE.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattccctggagagccggcctccatctcctgcaagtctagtcagagccctcctacatagtaatggacacaatattggattggtacctgcagaagccgagggcagtctccacagcctctgatcttatttgggtctaagtccgggtccgtccgggtccctgactaggttcagtggcagtgatcaggcagtagtatttacactagaaatacaacgagagtggagtcgtaggaggtagttggtttagggtttattacgtagtactagtagacgtaagtctactaaccctaaaccgtcccgtaccgtaacggttcgggacggtacgggaacccgtaagggtacggtacgtaacgtaccgtaaaacgtacgtacggtcggaccgtacgacctaccgacgttactcggttcttcgtacccg

SEQ ID NO: 159837 - DNA, 504 bp, Homo sapiens
  misc_feature: GYAE6OF01BB2ZZ.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtcctgacaggttcagtggcagtggatcgaggcacagattttacactagaaatcaacagagtggaggctgaggagtgttggggttattactgcatgcaagctactaacaactccctactaacgttcggacggacgggacaagggtgagagtacgaaacgactggtggctgacacatctgtctctac

SEQ ID NO: 159838 - DNA, 499 bp, Homo sapiens
  misc_feature: GYAE6OF01BBWUM.19.83.H06.1.454.CMB.1.raw
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccgggtccctgacaggttcagtggcagtggatcaggcacagtatttacactagaaatcaacagagtggagctagaggatggttgggtttattactgcatgcaagctactacaactccctactaacgttcgacgggaggaccaggtgagagtacgaaacgtatggtgctgcaccatctntctntacc

SEQ ID NO: 159839 - DNA, 595 bp, Homo sapiens
  misc_feature: GYAE6OF01CJI8L.19.83.H06.1.454.CMB.1.raw
  modified_base (284)..(284): a, c, t, g, unknown or other
  misc_feature (284)..(284): n is a, c, g, or t
  modified_base (358)..(358): a, c, t, g, unknown or other
  misc_feature (358)..(358): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagacgcccggcctccatctcctgcaagtctagtcagagccctcctacatagtaatggacacaactatttggattggtacctgcagaagccagggcagtctccanagctcctgatctagtttggtctaagtcgggccgtccgggtccctgacaggttcagtggcagtggatcgaggcanagtatttacactagaaatcaacgagagtggagctaggaggtattgggtttaggggtttattaacgtgtacgtagtagaccgaagtctaccgttaaacctaaccgtcccgtacgtaaccggttcggggacgggtaacgggaacccgtaaagggtcggtaaaggtaactaacgtaaaacccggtagttagggtcggcgtacgaccgtaacctacgttacttcgttccgttacgtacccg

SEQ ID NO: 159840 - DNA, 652 bp, Homo sapiens
  misc_feature: GYAE6OF01C8TPA.19.83.H06.1.454.CMB.1.raw
  modified_base (171)..(171): a, c, t, g, unknown or other
  misc_feature (171)..(171): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagagcccggcctccatcctcctgcaagtctagtcagagccctcctacatagtaatggacacaacttatttggattcggtacctgacagaacgccgagggctaggtcctccgaacgacgtccttccgtgtaacttccgttagtttttcggggttacttaaacgtcccggggtccccgttcccgggggtacccctaggaccgtagggtttccaggtcgggactaaggttggaatcgacggtaccacgtaagttaacttttaacaacgtaaggaaactacaaacgaggaggtagggaggcgtaggaaggtattgggtttaggggtttattacgtggactagtgacgtaagtctaactaacctaaacccttcccgtacgtaaccggttccgggaacgggacggaaccgaagggttagagtaactaaccgaaacgtacgtggtgaccgtgacctaaccattacgtcgtcttcgtaccg

SEQ ID NO: 159841 - DNA, 618 bp, Homo sapiens
  misc_feature: GYAE6OF01EBU1G.19.83.H06.1.454.CMB.1.raw
  modified_base (170)..(170): a, c, t, g, unknown or other
  misc_feature (170)..(170): n is a, c, g, or t
  modified_base (223)..(223): a, c, t, g, unknown or other
  misc_feature (223)..(223): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtgggatattgtggtgactcagtctccactctccctgcccgtnattcctggagagccgcctccatctcctgcaagtctagtcagacgcctcctaanatagtaatggacactaacttagtttggattggtacctgcagaagccgagggcagtctccacacgctcctgattcttagtttcgggtctaagtcgggcctccggggtcctgactaggttcagtgcaggtgatcaggcacagttatttacactaagaaactcaacaggagtggaggtcgtaggtaaggtagttgggtttaggggttttacttaacgtggtactagtagtacaacgtcttaacctaactaacccttacccgttaccgtaaccgggttccgggacgggtaacggggtaaccgtaaagggtacggtaaaggaactaaccggaaaacgtaacggtggttacgggacttacgaccgtaaccttacgtacctttacgttaccgttcttacccg

SEQ ID NO: 159842 - DNA, 512 bp, Homo sapiens
  misc_feature: GYAE6OF01D4U66.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagtatttacactagaaatcaacagagtggaggctgaggtatggttggggtttattacgtgcatgacaagctactaacaacctccctacaacgttcggacggacgggaccaagggtgagatacgaaacgtatggtggctgacctacatctgtcttctacc

SEQ ID NO: 159843 - DNA, 656 bp, Homo sapiens
  misc_feature: GYAE6OF01B6SPA.19.83.H06.1.454.CMB.1.raw
tcagtactctcgtgcacgaccggtgctcgatttagatcacgtgcgtcgcgggcgtagactttgtgtttctcgtagtctgctttgctcagcgtcaggttgctgctaatgctctgggtctctggatccaggtggggatattgtggtgactcagtctccactctccctgcccgtcattcctggagacgcccggcctccatcctcctgcaagtctagtcagacgcctcctacatagtaatggacacaacttattggattggtacctgacagaacgccgagggctagtcctccacgagccttcctgtacttcttagttttgggttacctaacgtccgggtcccgttcccggggtccctaggaacgtaggttcgaggtcggacgaggtggactcgaggcaactagtaatttacatagaaatacaacgagtagtaggagcgtaggaggtagttaggttaggggtttaatacgtgacgtagtacgacgtaacgtctaacctaaccgtaaacccttacccgtacgtaaccgggttccggacggggtaacggaaccggtaagggtaggtaacgaacgttaaccggaaaacggtaacgttacgggtacggtaccgtaaggacccgtaaactacgtttaaccgttcgtttcccgttacgttaaccccg

SEQ ID NO: 159844 - DNA, 532 bp, Homo sapiens
  misc_feature: GYAE6OF01BCV15.19.83.H06.1.454.CMB.1.raw
  modified_base (527)..(527): a, c, t, g, unknown or other
  misc_feature (527)..(527): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccaggcagtctccacagctcctgatctatttgggttctaagtcgggcctccggggtccctgacaggttcagtggcagtggatcgaggcacagtattttacactagaaatacaacgagagtggaggtctaggaggtagtggtttaggggtttattacgtgcagtgacaacgtctacgtaacaacctcccgtactacggttcggacggaggaccgtaaggtgagacgtacgaaacgtacgtggtcggctgacacatcgtgtcgttntaccg

SEQ ID NO: 159845 - DNA, 503 bp, Homo sapiens
  misc_feature: GYAE6OF01EY88T.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggttctaatcgggcctccggggtccctgacaggttcagtggcagtggatcaggcacagattttacactgaaatcaacagagtggaggctagaggattggttggggttttattacgtgcagtgcaagctctaacaacctccctactacgtcggcggaggaccgaggtggagatacgaaacgtactgtggctgcacatctgtctctacg

SEQ ID NO: 159846 - DNA, 523 bp, Homo sapiens
  misc_feature: GYAE6OF01A9JT2.19.83.H06.1.454.CMB.1.raw
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (520)..(520): a, c, t, g, unknown or other
  misc_feature (520)..(520): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggttctaagtcgggcctccggggtccctgacgtggttcagtggcagtggatcgagcacagtatttacactagaaactcaacagagtggaggtctggaggtattggtttggggtttattacgtgtacagtgacaagtctactaactaacctccctacgtaacggttcgggacggacggaacgaggtaggagatacgaaacgatggtggctgacacntntntcctntac

SEQ ID NO: 159847 - DNA, 629 bp, Homo sapiens
  misc_feature: GYAE6OF01CYBSA.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagagcctcctacatagtaatggacacaactatttggattggtacctgcagaagccagggcagtctccacagctcctgatctatttgggttctaagtcgggcctccggggtcctgacaggttcagtggcagtggatcaggcacagtattttacactagaaaactcgaaacagagtgggaggcgtaggagggtagtggttttaggggtttatttacgtggactagttggacaacgtcttacctaacctaaacccgttccccttacgtaaacccgggtttccggggaccggggtaacggggtaacccgaaaggggttcgggaaggtaacgttaaccgaaaaccggtaaccggttgggttacgggacccgttggacccgtaacccgtacttaccggttacggttcctttaccgttaacccg

SEQ ID NO: 159848 - DNA, 688 bp, Homo sapiens
  misc_feature: GYAE6OF01EVYUG.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtcctccactctccctgcccgtcattccgtggagacgccggcctccatcctcctgctaagtctagtcagacgccctacctaacatagtaatcggaaccaactaacttagtttggattcggtacctgacaagaacgccgagggccagtcctaccacacgtccttccgtgtacttcgtttaggtttcgggttacctaacggtcccggggtcccgttcccggggtccctaggtacgtacgggttcaggtcggcgtaggtggactcgacggctaacgtagttaactttaacgaacgtaagtaaactacgaaacgaggtaggtagggaggtacgtaggaagggttagtttgggtttagggtttactacggtgtatacgtagtactacgtaccttaacctaaaccgtaacccgttcccgtaacgtacgggttaccgggacgggtaacggtaaccggtaagggtacggtaagtaacctaaccggtaaacgtaggttacggtcgtacacgacctaccgttattacgttacgttccttacgtacccg

SEQ ID NO: 159849 - DNA, 621 bp, Homo sapiens
  misc_feature: GYAE6OF01CO31X.19.83.H06.1.454.CMB.1.raw
  modified_base (139)..(139): a, c, t, g, unknown or other
  misc_feature (139)..(139): n is a, c, g, or t
  modified_base (143)..(143): a, c, t, g, unknown or other
  misc_feature (143)..(143): n is a, c, g, or t
  modified_base (178)..(178): a, c, t, g, unknown or other
  misc_feature (178)..(178): n is a, c, g, or t
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (291)..(291): a, c, t, g, unknown or other
  misc_feature (291)..(291): n is a, c, g, or t
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtgggatattgnggtnactcagtctccactctcccgtgcccgtcacttccnggagacgccggcctccatcctcctgcaagtctagtcagacncctacctanatagtaatggacacaactattggattggacctgcagaacgccagggcagtctccacagctccngatcgtagtttggtactaagtcgggccgtcccgggtcctgacgaggttcgagtgcagtgatcgagacacagtactttacactagaaatcaanagagtggacggtntagtaggtagttgggttaggggtttaattactaggtactaagtcgactaacggtacctacgtaaacctaaaccgtccccgtaacgtaaacgggttaccgggaaccgggaacgggaaacccgaaagggttagggaaacgtaacgttaaaccgaaaaccggtaaacgtgggtcggtaccgtacgacctaaacccgtacttacccgttacttcccgttcttaaccccg

SEQ ID NO: 159850 - DNA, 589 bp, Homo sapiens
  misc_feature: GYAE6OF01CQKEC.19.83.H06.1.454.CMB.1.raw
  modified_base (326)..(326): a, c, t, g, unknown or other
  misc_feature (326)..(326): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtatctggatccagtggggatattgtggtgactcagtctccactctccctgcccgtcattcctggagagccggcctccatctcctgcaagtctagtcagagcctcctacatagtaatggacacaatatttggattggtacctgcagaagccagggcagtctccacagctcctgatctatttgggttctaagtcgggcctccgggtcctgacngttcagtggcagtgatcaggcacagtattttaacactagaaatacaacgagagtggaggctaggaggtagtgggtttagggtttagttacgtgctagtcgtactaaggtcttactaacctaaaccttccccgtacgtaaccggtttacgggaccggggagggaacccgtaagggtacgggaaagtacgtaaccgaaaacggtaacgttaggtcggtacgtacggacctaaccgtacgttccttcggttccttccgttaacccg

SEQ ID NO: 159851 - DNA, 539 bp, Homo sapiens
  misc_feature: GYAE6OF01CJ61Z.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagagcctcctacatagtaatggacacaactatttggattggtacctgcagaagccagggcagtctccacagctcctgatctatttgggttctaagtcgggcctccggggtcctgacaggttcagtggcagtggatcgaggcacagtatttacatagaaatcaacagagtggagctagaggtattggtttaggggtttattactgctatcgacaagtcctactaacaaccctccctacgtaacggttcggacgggacggaaccgaagggtggaagtagtaccgaaacgtacgtggtcggactagccacctatactgttccttctaccg

SEQ ID NO: 159852 - DNA, 536 bp, Homo sapiens
  misc_feature: GYAE6OF01E2GJH.19.83.H06.1.454.CMB.1.raw
  modified_base (352)..(352): a, c, t, g, unknown or other
  misc_feature (352)..(352): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtcctccacagctcctgatctatttggtctaagtcgggtcctccggggtcctgactaggttcagtggcagtgatcgagcanagtatttacactagaaatcaacgagagtggaggctaggaggtagttggtttagggtttaatacgtgacagtgacaagctacctaacaacctccctacgtaacggttcggacggaggaccgaaggtgaagtactacgaaacgtagtggtcggctacggacctacctatcttcgttcctactaccg

SEQ ID NO: 159853 - DNA, 673 bp, Homo sapiens
  misc_feature: GYAE6OF01C1XZ0.19.83.H06.1.454.CMB.1.raw
  modified_base (178)..(178): a, c, t, g, unknown or other
  misc_feature (178)..(178): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattccnggagagcccggcctccatctcctgcaagtctagtcagacgcctcctaacatagtaatcggaacaactaacttagttggattcggtacctgacaagaacgccgagggcagtcctccacacgctcctagattcgttagtttcgggtactaacgtccgggtcccgtccgggtccctggacgtcggttcaggtggctaggtgactcgaggcaacgtagttactttacaactaagaaactcaacgaggtacggtagggacggagtaggaagggttagtttaggggtttacgggtttattacgtagtctaagttacgaacgtaacgtacttaacctaacccgtaaacccgttacccgtaaccggttaaccggttacggggtaacgggaacgggtaaccggaagggtacggaaacgtacgtaaaccgtaaacgggtaacgttacgggtcgtacgtaaccggacctaaccgtacgtttagttcccgttacgttaccgtacccg

SEQ ID NO: 159854 - DNA, 555 bp, Homo sapiens
  misc_feature: GYAE6OF01CAGUY.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggtctaagtcgggcctccgggtcctgactaggttcagtgcagtggatcgaggcactagtattttaacactagaaaactcaacagacggtggaggtcgtaggaggagttggttaggggtttattacgtgcagtgacaatctactaaccgtaacctcccgtacgaacggttcggacgggacggaccgaagggtggaagtactaacgaaacgtaacgtggtcggactagacccgtacctatccgttacgtcgttacctaccg

SEQ ID NO: 159855 - DNA, 604 bp, Homo sapiens
  misc_feature: GYAE6OF01D2HEX.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctagtttgggtctaagtcgggcctccgggtcctgacaggttcagtggcagtgatcgaggcacagtatttacactagaaatcaacgagagtaggaggactaggaggtagttgggtttaggggttttaattacgtgtactaagtcgactaagtctaccgtaaccaaacccgttccccgtacgtaacggtttccggggtagggaacgggaacccgtaaagggtagggaacgtaacgtaaccgaaaaccggtaacgttgggttacgggaccgttacggacctaacccgtacttaccttcggttccttcgttaaccccg

SEQ ID NO: 159856 - DNA, 625 bp, Homo sapiens
  misc_feature: GYAE6OF01DW04E.19.83.H06.1.454.CMB.1.raw
  modified_base (177)..(177): a, c, t, g, unknown or other
  misc_feature (177)..(177): n is a, c, g, or t
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattccnggagagcccggcctccatctcctgcaagtctagtcagacncctctacatagtaangacacaacttattggattggtacctgcagaacgccgagggcagtcctccacagccttcctgattcttagtttggtactaacgtcgggcccgttccgggtcctgacgtaggttcaggtcggctaggtgacgtcgaggacacgtagttaacttttacgaacgttaagaaaactcaaacgagggtaacggtgggaacggtacgtagggtaaggtaggtttagggttttaggggttttaattacgtggactagtacggtactaacgtccgtaactaacctaacccgtcccgttaacgaacgggttccggacgggaacgggtaaccgaagggtacggaacgtagtaaccgaacgtaacgtggtcgacgtcacgtactatccttcgttccttctaaccg

SEQ ID NO: 159857 - DNA, 645 bp, Homo sapiens
  misc_feature: GYAE6OF01AEJEI.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcggagcctcctacatagtaatggacacaacttatttggattggtacctgcagaagccgagggcagtctccacagcctcctgatcttagtttgggttctaacgtccgggcccgtcccggggtccctggacgtaggttcaggtggcgtaggtggactcgaggcaacgtagttaacttttaacgactaaggaaaacttaccgaacgaaggaggtcgggaaggtcgtaggtaggtagtttgggtttagggtttattacgtgactagtcgacaagtccttactaacctaaccgttcccgtaacgtaaccgggttccgggacgggtaacggggaaccgtaagggtacggaagtaacgtaacccgaaacggtaacgtgggtacggtcctacggacctaacccgtactttaccgttacgttcctttcgaaccgtttcccccg

SEQ ID NO: 159858 - DNA, 610 bp, Homo sapiens
  misc_feature: GYAE6OF01EA06Y.19.83.H06.1.454.CMB.1.raw
tcagtactctcgtgcacgaccggtgctcgatttagatcacgtgcgtcgcgggcgttagtacgtttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagagcctcctacatagtaatggacacaacttattggattggtacctgcaagaagccagggcagtcctccacagcctcctgatcttagtttcggtactaaggtcccggtccgttccggggtcctgacgtaggtcaggtgcgagtggatcgagcaacgattaagtttacactaagaaactacaagagaggtacggagcgtaggaaggtagttagggtttacgggtttattacgtgtactagtcgaacaacgtctaacctaacctaacccttcccgtaccgtaacggttcgggaacggtaacgggtaacgaagggtaggaacgtaacgtaaccgaaaacgtagtacggtcggaccgtcgacccgtaacctagttccgtttacttccgttcgttaaccc

SEQ ID NO: 159859 - DNA, 518 bp, Homo sapiens
  misc_feature: GYAE6OF01DRF1H.19.83.H06.1.454.CMB.1.raw
tcagtactctcgtgcacgaccggtgctcgatttagatcacgtgcgtcggcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttggtctaagtcgggcctccgggtccctgacaggttcagtggcagtggatcaggcacagtattttacactagaaatcaacagagtggaggctgaggtatggttgggtttattctgcagtgcagtctactactaacctcccgtacgtacggttcggacggagggaaccgaaggtggacgtatacgaaacgagtggtggctgacctaccattctgtccttgtaccc

SEQ ID NO: 159860 - DNA, 588 bp, Homo sapiens
  misc_feature: GYAE6OF01BSHUC.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaacgccagggcagtctccacagctcctgatctagtttggttactaagtccgggccgttcccggggtccctgacgtaggttcaggtcggcaggtggactcgaggcactagtatttacactagaaactacaacgagagtgggaggctaggaggtagttgggtttagggtttattacgtgtactagtcgactaagtctacctaacctaaccgtcccttacgtaacggttcgggacgggacggtaaccgtaagggtacggaagaacgtacgtaaaacggtacgtagggtcggactggaccctaacgtacttacgttcttcgttcgtaacccg

SEQ ID NO: 159861 - DNA, 599 bp, Homo sapiens
  misc_feature: GYAE6OF01C0IHM.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatctcctgcaagtctagtcagagcctcctacatagtaatggacacaactatttggattggacctgcagaagccagggcagtctccacagctcctgatctatttgggtctaagtcggctccgggtcctgacagttcagtggcagtggactcgagtacacgagtacttttaacactagaaactcaacaggagtaggaggtctaggaaggtagttgggtttaggggtttattacgtgactagtcgacaagtctactaactaaaccttccccgtacgtaacgggttccggacgggtacgggtaacccgaaagggtacggaagtaacgtaaccgaaaaccggtaacgttcggtacgggtccgtacggaccctaacccgtacgttaccgttacgttccttaccgttaacccg

SEQ ID NO: 159862 - DNA, 499 bp, Homo sapiens
  misc_feature: GYAE6OF01E3TOO.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttgggttctaatcgggcctccggggtccctgacaggttcagtggcagtggatcaggcacagattttacactgaaaatcaacagagtggaggctgaggatggttggggtttattactgcatgcaagctctacaactccctacaacgttcggtggagggaccaaggtggagatacgaaacgaatggtggctgcaccatctgtctctac

SEQ ID NO: 159863 - DNA, 663 bp, Homo sapiens
  misc_feature: GYAE6OF01AIXE6.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccgagggcagtctccacagcctcctgatcttagtttgggttctaacgtccgggcccgttccggggtccctgacgtaggttcaggtggcaggtggactcgaggacacagtactttacacgtagtaaactcaacgagtaggtagggacggacgtaggaagggtagtttagggtttaggggttttaattacgtgtacgtagtaggtaccaaacgtcctaaccgttaaaccctaaacccgttccccgttaacggttaaacccgggttccgggaaccgggtaacggggaacccggtaaagggtacgggtaacggtaaacgtaacccgtaaaacgggtacgttacgggtacggaccgttacggaacccgtaccctaacttccgttcgttaccgttccgttaccccg

SEQ ID NO: 159864 - DNA, 541 bp, Homo sapiens
  misc_feature: GYAE6OF01DCQAQ.19.83.H06.1.454.CMB.1.raw
  modified_base (222)..(222): a, c, t, g, unknown or other
  misc_feature (222)..(222): n is a, c, g, or t
  modified_base (391)..(391): a, c, t, g, unknown or other
  misc_feature (391)..(391): n is a, c, g, or t
  modified_base (406)..(406): a, c, t, g, unknown or other
  misc_feature (406)..(406): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtgggatattgtggtgactcagtctccactctccctgcccgtcattcctggagagccggcctccatctcctgcaagtctagtcagagcctcctanatagtaatggacacaactattggatggtactgcagaagccagggcagtctcacagctcctgatcttagtttcggtactaagtcgggccgtccggggtcctgacgtaggttcagtggcagtggatcaggcacagtatttacactagaaatcaacagagtggagctgagtntggttgggttatacngacgagtcgactaagctactaacctaacctcccgttacgtaacggttcggacgggaacggaaccgaagggtcggaacgaactaaccgaaacggtaacttggcggtcgacgactaccactctcgttcttcgtaccg

SEQ ID NO: 159865 - DNA, 664 bp, Homo sapiens
  misc_feature: GYAE6OF01C7HHP.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatctcctgcaagtctagtcagacgcctctacatagtaatggacacaactattggattggtacctgcagagccgaggcagtctccacagcctcctgtactcttagtttcggttacttaacgtccgggtcccgtcccggggtcctaggacgtaggttcgtaggtggcgaggtggatcgaggcacgtagtacttttaacgactagtaaactacaacgagaggtagggaggtacgtaggagggttagttagggtttaggggttttaattacgtgtacgtagtacggactaacgtacttaaccgtaacctaacccgttacccgtacgtaaccgggttcgggaaccgggtaacgggtaacccggtaaggggttacggaaacggtaaccgtaaacggtaaaccggtaagttacgggtcggtaccggtacgtaccgtaaccgttacgttaccgttacggttccgttacccgttaacccg

SEQ ID NO: 159866 - DNA, 721 bp, Homo sapiens
  misc_feature: GYAE6OF01C2NMX.19.83.H06.1.454.CMB.1.raw
  modified_base (178)..(178): a, c, t, g, unknown or other
  misc_feature (178)..(178): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactcctccctgcccgtcattccnggagagccggcctccatctcctgcaagtctagtcagagcctacctacatagtaatggacacaacttagttggattggtacctgcagaagccgagggcagtctccacacgctcctgacttcgtagttttcgggtactaacgttccgggcccgttcccggggtcctacggacgtacgggttcgaaggttcgggacctaggtcggtactcgaggcaacgtaacgtacttttaaccaacgttaagaaaactacgaacgtaggtagggtacggagggtacgttagggaaggtaggtttacgggtttaggggtttttaactttacgtacggtactaagttacgtaacgtaacgtaccttaaccgtaaaccctaaccccgttaccccgttaacggtaaccgggtttacccgggaacgggtaacgggtaaccgtaaggggtacggaaacggtaacgtaaccggtaaaacggtaacggttacgggtacggtaccgttacggtacccgtaacccgttacgttaccgtttaccgttaccttaccgttaaccccg

SEQ ID NO: 159867 - DNA, 692 bp, Homo sapiens
  misc_feature: GYAE6OF01DKKQ6.19.83.H06.1.454.CMB.1.raw
  modified_base (178)..(178): a, c, t, g, unknown or other
  misc_feature (178)..(178): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattccnggagacgcccggcctccatctcctgcaagtctagtcagagtcctacctacatagtaatggacactaacttattggattcggtacctgacaagaacgccgagggcagtctaccacacgctccgtgacttcttagttttcggtacttaagtccgggtccgtcccgggtcctggacgtaggttcaggtcggacgtaggtaggactcgaaggaccacgtaagttaacttttaccgaacgttaacggtaaaactacgtaaaccgaggaacggttagggacggtacgtaggtaagggtagtttagggttttaggggtttatttacgtgtactagtacgacgtaacgtacctaactaaccgtaaacccgttacccgtaaccgtaaccgggttacgggaccgggtacgggtaaccgtaaaggggtacggaaacgtaacgtaaaccggtaaaaccggtaacgtaggtcggtacgtacgacccgtaaccgttaacgtacgtttcgttcccttaccgttaccccg

SEQ ID NO: 159868 - DNA, 598 bp, Homo sapiens
  misc_feature: GYAE6OF01BOWBK.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtatggacacaactattgattgtacctgcagaagccgaggcagtctccacagctcctgacttcttagtttgggttctaagtccgggtccgtccggggtccctgacgtaggttcaggtgcgtaggtggactcgaggactaacgtagttaattttacgaacttaagaaaactacaacgaggtaggtagggaggtcgtaggtaaggttaagttgggtttaggggtttattacgtgactagtgactaagctactaacctaacctcccgtagtaacggttcggacgggacggaaccgaagggtaggaacgtacgtaacgaaacggtaagttggtccgtacgtacgaccgtaacgtattcgtacgttccgttctaccg

SEQ ID NO: 159869 - DNA, 586 bp, Homo sapiens
  misc_feature: GYAE6OF01EUYVH.19.83.H06.1.454.CMB.1.raw
  modified_base (331)..(331): a, c, t, g, unknown or other
  misc_feature (331)..(331): n is a, c, g, or t
tcagtactctcgtgcacgaccggtgctcgatttagatcacgtgcgtcgcgggcgtagactttgtgtttctcgtagtctgctttgctcagcgtcaggtgctgctaatgctctgggtctctggatccagtggggattattgtggtgactcagtctccactctccctgcccgtcattcctggagacgccggcctccatctcctgcaagtctagtcagacgtcctcctacatagtaatggacacaactatttggattggtacctgcagaagccagggcagtctccacagctcctgatctagtttgggttactagtcgggcctccgggtcctgacnggttcagtgcagtgatcaggcacagtatttacactagaaatcaacagaggtggacggtctaggaggtagttaggtttaggggtttaattacgtgctagtggacgtaacgactacctaaccgaaccttcccgtaaccgtaacgggttaccgggacgggaacggggaaccgtaagggtcgggaacgtaacgttaaccgaaacgtaaccgttggtacggctacggacctaacctagttaccttgttccttcgtacccg

SEQ ID NO: 159870 - DNA, 579 bp, Homo sapiens
  misc_feature: GYAE6OF01DEGE7.19.83.H06.1.454.CMB.1.raw
  modified_base (382)..(382): a, c, t, g, unknown or other
  misc_feature (382)..(382): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtcctagtcagagccctcctacataaggtaatggacacaaacttattggattggtacctgcagaagccgagggcagtcctccacagctcctgatcttagtttggttctaagtcgggcccgtccggggtccctgacgtaggttcagtggcaggtggactcgagacacgtagtactttanaactagaaatcaacgagaggtgggagcgtggaaggtacgttggtttagggtttatactgctagtgacacgtctactaacctaaccgtccctacgtaacggttcggacgggtacggacggaagggtggaagtactaacgaaaacgtacgtggtacggtactcggacctaccctagttcctttacggtcttccgtaccg

SEQ ID NO: 159871 - DNA, 564 bp, Homo sapiens
  misc_feature: GYAE6OF01ECFWX.19.83.H06.1.454.CMB.1.raw
  modified_base (278)..(278): a, c, t, g, unknown or other
  misc_feature (278)..(278): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatctcctgcaagtctagtcagacgcctcctacatagtaatggacacaactattggattggtacctgcagagccaggcagtctcanagctctgatctattggtctaagtcgggcctccgggtcctgactaggtcagtggctagtgatcgaggcacgagtacgttttacacgttaagaaaactcaaacgtagaggtggtaaggctaggaggtagttggtttaggggtttattacgtgactagtgacagtctacctaactaaacctcccgtacgtacggttccggacgggtacgggacgtaagggtggaacgaacgtacgtaaacgtagtggtacggactcggactaccgtattcgttacgtcgttacgtaccg

SEQ ID NO: 159872 - DNA, 537 bp, Homo sapiens
  misc_feature: GYAE6OF01CMPGJ.19.83.H06.1.454.CMB.1.raw
  modified_base (377)..(377): a, c, t, g, unknown or other
  misc_feature (377)..(377): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggccctccatctcctgcaagtctagtcagagcctcctacatagtaatggacacaactatttggattggtacctgcagaagccagggcagtctccacagctcctgatctatttgggttctaagtcgggcctccgggtccctgacaggttcagtggcaggtggatcaggcacagtatttacactagaaatcaanagagtgaggctgaggtagtggttaggggtttattacgtgctatgactaagcttactaacctaaacctccctacgtaacgttcgggacgggaggaaccgaagggtgaagataccgaaacgtacgtggtcggactcgaccaccgtatcttgtccttctaccg

SEQ ID NO: 159873 - DNA, 611 bp, Homo sapiens
  misc_feature: GYAE6OF01AEKDC.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatcctcctgcaagtctagtcagagcctcctacatagtaatggacacaactattggattggtacctgcagaagccagggcagtctccacagctcctgatctatttgggttctaagtccgggcctccggggtccctgactaggttcagtggcagtggatcgaggcacgagtattttacactagaaaatcaacagtaggtggaggtctaggaggtagttggtttaggggttttattacgtgctagtcgacaacgtcctaccgttaaccaaacccgttccccgttacgtaaccggtttcgggaccgggtacgggaaccgtaagggtcgggaagtaacgtaaccgtaaaaccggtaacgttacgggtcgggaccgtacggacccgtaacccgtattacccgttcggttccgttccgttaacccg

SEQ ID NO: 159874 - DNA, 594 bp, Homo sapiens
  misc_feature: GYAE6OF01BVD3X.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctagtttggtctaacgtccgggcccgtccggggtccctgacgtaggttcaggtggcaggtggatcgaggcacgagtatttacgactagaaatacaacagagtggagctggaggtattggtttagggtttattacgtgtacagtcgacaagtcctactaacctaaccttccccgtacgtaacgggtttcgggacgggtaacgggaaccgtaagggtaggaacgtaacgtaaccgaaacggtaacgttacgggtcggtacgtacgaccgtaaccctacgttccgttcgttcctttcgttaaccccg

SEQ ID NO: 159875 - DNA, 510 bp, Homo sapiens
  misc_feature: GYAE6OF01EPCEO.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcaggtgagtcaggcacagtatttacactagaaatcaacagagtggagctgaggatggttgggtttattacgtgcagtgacaagctacacaacctcctacgacgttcggacggagggaccaagggtgagatacgaaacgtaatggtcggctgacaccatcgtcgttctcgtac

SEQ ID NO: 159876 - DNA, 574 bp, Homo sapiens
  misc_feature: GYAE6OF01CK1WN.19.83.H06.1.454.CMB.1.raw
  modified_base (275)..(275): a, c, t, g, unknown or other
  misc_feature (275)..(275): n is a, c, g, or t
  modified_base (351)..(351): a, c, t, g, unknown or other
  misc_feature (351)..(351): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccaggcagtcncacagctcctgatctagtttggttctaatcgggcctccggggtccctgacaggttcagtggcagtgatcgaggcanagtattttacactagaaactcaacaggagtaggaggcctaggtaaggtagttggtttaggggtttaattacgtgtacagttagcaacgtctaccgtaacctaaccgtccctacgtaaccggttacgggtaccgggagggtaacccgaagggtcggaagtaactacgaaaacggtactacgggtcgacgtacgacctacctactaccttcgtcttccgtaaccg

SEQ ID NO: 159877 - DNA, 499 bp, Homo sapiens
  misc_feature: GYAE6OF01AL4RI.19.83.H06.1.454.CMB.1.raw
  modified_base (489)..(489): a, c, t, g, unknown or other
  misc_feature (489)..(489): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctcccctgccccgtcattccctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaactccctcaacgttcggcggaggaccaaggtggagatacaaacgaactgtggctgcaccanctgtctctac

SEQ ID NO: 159878 - DNA, 600 bp, Homo sapiens
  misc_feature: GYAE6OF01ADKSH.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtatggacacaactatttggattggtacctgcagagccgagggcagtctccacagcctcctgatcttagtttgggttctaagtccggaccgttcccggggtccctgactaggttcaggtggctaggtggatcaggcacagtaattttacactagaaatcaacaggtagtgggaggcgtaggaggtagtttaggttaggggttttattacgtgtcgtagtcgacgtacgtcttaccgtaactaacccgttcccgtactaacgggtttcgggacgggacgggaaccggaagggtacggaagtaactaccggtaaacgtacgttggtcgggtacctacggaccctaccgtacttacgttcgttcctttcgtaccccg

SEQ ID NO: 159879 - DNA, 568 bp, Homo sapiens
  misc_feature: GYAE6OF01EHLHL.19.83.H06.1.454.CMB.1.raw
  modified_base (346)..(346): a, c, t, g, unknown or other
  misc_feature (346)..(346): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatctcctgcaagtctagtcagacgcctcctacatagtaatggacacaactatttggattggtacctgcagaagccagggcagtctccacagctcctgatctagtttgggttctaagtcgggccgtcccggggtccctgacaggttcgagtggnaggtgatcgaggcacagtatttaacacttagaaaatcaacagagtggagctaggaggtattgggtttagggtttacttacgtgactagtgacaagtctacctaactaaccctcccgtagaaccggttcggacgggaacgggacgtaacgggtggaagacgtaacgaaaaccggtactggtcggcctagaccctacgtacttacctggtttccttcgtacccg

SEQ ID NO: 159880 - DNA, 679 bp, Homo sapiens
  misc_feature: GYAE6OF01BANOJ.19.83.H06.1.454.CMB.1.raw
  modified_base (434)..(434): a, c, t, g, unknown or other
  misc_feature (434)..(434): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattcctggagacgcccggcctccatcctcctgactaagtctagtcagacgccctcctacatagtaatggacaactaacttatttggatttcggtacctgacaagaacgccgagggctagtcctccacacgtcctcctgtacttcgttaagttttcgggtactaacgtccgggtcccgttccgggtcctgacgtaggttcgaggtggctaggtggatcgaggacacgtagttactttaacacgtaagaaactcaacgagtagngggtagtcgaggtaggttagtttgggtttaagggtttattacgtgtacgtagtacggactaacgtaccttacctaaaccgttaaccctacccgttacggtaaccgggttccgggaacgggtaacggaaccggtaaggggtacggtaaaccgtaaacggttaaccgaaaacgggttaccgttagggtccggaccgtaccggtacctaaccgttacgtaccgtttaccgttacgtttccgtaccccg

SEQ ID NO: 159881 - DNA, 732 bp, Homo sapiens
  misc_feature: GYAE6OF01DYCEN.19.83.H06.1.454.CMB.1.raw
  modified_base (173)..(173): a, c, t, g, unknown or other
  misc_feature (173)..(173): n is a, c, g, or t
  modified_base (179)..(179): a, c, t, g, unknown or other
  misc_feature (179)..(179): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtcctccactctccctgcccgtnattccnggagcgccgcctccatcctcctgcaagtctagtcagacgcccttaccaacataagtaatggaacaactaacttatttggattacggtacctgactaaggaaacgccgaagggtccacgtacctccaacgtcgtctcctagacttaccgtttaagttttcggggttacctaacggttccgggtcccgttccccggggtccctaggtaacgtacgggttccaaggttcggacgaggtacggtactacgacggacacgtaagttaacttttacgaaactaagaaaacgtacaaacgaggtacggtaggaaggtacgttaggtaagggttagtttagggtttaaggggttttaacttacgtacgtataacgttacgaacgtaacgtaccttaaccgtaaacccgtaacccgttacccgtaacgtaaccgggttaccgggtaaccgggaacgggtaaccgaaggggtaggtaaacgaaccgttaaaccgaaaacggtaacggttacggtcgtacgtcgaaccgtaccgttacttccgttacgttccttacgtaccccg

SEQ ID NO: 159882 - DNA, 500 bp, Homo sapiens
  misc_feature: GYAE6OF01DIFFM.19.83.H06.1.454.CMB.1.raw
  modified_base (377)..(377): a, c, t, g, unknown or other
  misc_feature (377)..(377): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactagaaaatcaacngagtggagctgaggatgttgggttattactgcatgcaagctactacaaactccctcgaacgttcggacggaggaccaagggtggagatacgaaacgatggtggctgctaccatctgtctctac

SEQ ID NO: 159883 - DNA, 661 bp, Homo sapiens
  misc_feature: GYAE6OF01DGX51.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactcctccctgcccgtcattccgtggagacgcccggcctccatcctcctgacaagtctagtcagacgcctaccacatagtaatcggaacactaacttagtttaggattcgggtacctgacaggaacgccgagggcagtcctaccacagcctccgtgtattcgttagtttggttactaagtccgggccgtcccggggtcctgacgtggttcaggtggcagtcgatcgaggacagacgttactttacactagaaactcaagaggtaggtgggaagtcgtaggacggtagtttgggtttagggtttattacgtgtactagtacgacgaagtcctaactaaccctaaccgttcccgtaacggttaaccgggttacgggaaccggggtaacgggtaacccggtaagggttacgggaaacgtaactaaccggaaaaccggtacgttagggtcgacccgttacgaacccgtaacccgttattaccggtttacgttcccgtttcgtaaccccg

SEQ ID NO: 159884 - DNA, 532 bp, Homo sapiens
  misc_feature: GYAE6OF01C3NMT.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatctcctgcaagtctagtcagagcctcctacatagtaatggacacaactatttggattggtacctgcagaagccagggcagtctcacacgctcctgactctagtttgggttctaagtcgggccctccggggtccctgacaggttcaggtggcagtggatcgaggcacagtactttacactagaaatcaacagagtggaggctgaggtattggttaggggtttattatgactagtgcagtctactaacaaaccttccctacacggttcggacgggagggaacctagggtggagagtacaaacgtatggtcggcgtcactaccctatctcgtcttcgtacg

SEQ ID NO: 159885 - DNA, 565 bp, Homo sapiens
  misc_feature: GYAE6OF01AW5S6.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggtctagtcgggcctccgggtcctgacaggttcagtgcagtgatcgaggcacagtatttacactagaaatcaacgagagtggaggctaggaggtagttggtttaggggtttaattacgtgacgtagtgactaagtctactaactaacctcccgtacgaaccggttacggacgggacgggaaccgaagggtaggaagtacgtaacgtaaaccggagtagggtcggaccgttagaccctacgtacttaccttcgttccgttcgttacccg

SEQ ID NO: 159886 - DNA, 635 bp, Homo sapiens
  misc_feature: GYAE6OF01B83D2.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattcctggagagcccggcctccatcctcctgcaagtctagtcagacgccctcctacatagtaatggacactaacttagttggattcggtacctgacaagaacgccgagggctagtcctaccacgacgtcctccgtgtacttcgttaagttttcgggttaccttaagtcccggggtcccgttcccgggggtccctaggactagggttcaggtggcgtagtggtactcgaggacagagttactttacgactaagtaaactacgaacgaggtaggtagggagtcgtagggtaagttaggttgggtttagggttacttacgtgactagttcacgtaacgtcctactaacctaaccgtcccgtagtacggttcgggacggtacgggaacgagggttagacgtaacgaccgtaaacggtagttgggtcggcgtacgactaaccgtcttaccgtcgttcgttctaacccg

SEQ ID NO: 159887 - DNA, 614 bp, Homo sapiens
  misc_feature: GYAE6OF01C6VFH.19.83.H06.1.454.CMB.1.raw
  modified_base (173)..(173): a, c, t, g, unknown or other
  misc_feature (173)..(173): n is a, c, g, or t
  modified_base (180)..(180): a, c, t, g, unknown or other
  misc_feature (180)..(180): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctcgtgggtctctggatccaggtggggatattgtggtgactcagtctccactctccctgcccgtnattccgnggagcgcccggcctccatctcctgcaagtctagtcagacgcctctacatagtaatcggacacaattattggatggacctgacagagccgaggcagtctccacagtctcctgatcgttagtttgggtactaacgtccgggaccgttccggggtcctacgacgtacggttcaggttcggactaggtcggaactcgaaggcaacgtagtaattttaacaactaagaaaactacgaaacgaggtaaggtagggaagtcgtaggtaagggtaagtttgggtttacggggtttattacgtgtactagtagacaacgtctaactaactaacctcccgtagtaacggttcggacggtaggaacgaggtggaacgtaagaaccgtaaacgaacgtggtacggactacgaacgtaccgtaattccgttacgtccttgtaacccg

SEQ ID NO: 159888 - DNA, 814 bp, Homo sapiens
  misc_feature: GYAE6OF01C8PKT.19.83.H06.1.454.CMB.1.raw
  modified_base (173)..(173): a, c, t, g, unknown or other
  misc_feature (173)..(173): n is a, c, g, or t
  modified_base (179)..(179): a, c, t, g, unknown or other
  misc_feature (179)..(179): n is a, c, g, or t
  modified_base (222)..(222): a, c, t, g, unknown or other
  misc_feature (222)..(222): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtcctccactctccctgcccgtnattccnggagacgccggcctccatcctcctgacaagtctagtcaggacncctacctacaagtagtaatcggaactacgtaacttagttggaatttcgggtaccttggaccgaaggaacgcccgagggacctagtcctaccaactacgtccttcctagtacttactttacgttttcgggtaccttaacggttcccggggcccggttccccgggggtaccttacggaaccggttacgggttaccgtaagggtcgggtacgtagggtggtaactaccggaacggacctaaacgtaaggttaaactttttaaccgaaacgttaaacggtaaaacttaccgaaacggtaacggtaaggggttaggggaacggtacgttagggtaagggttaaggttttacggggtttagggttttaacttaacggtcgtaccgtagttacgaacgtaacgtacctaaccgtaaacctaacccgttacccggtaacgttaaccggggtttacgggaacgggtaaccggggtaaccggtaagggttacgggtaaacgtaaccgtaaaccggtaaaaaccgggtacggttacggtacggtaacccgtacgaacccgtaccttaacgttccctttacggttcccgttaccgttaaccccg

SEQ ID NO: 159889 - DNA, 622 bp, Homo sapiens
  misc_feature: GYAE6OF01CR3L8.19.83.H06.1.454.CMB.1.raw
  modified_base (179)..(179): a, c, t, g, unknown or other
  misc_feature (179)..(179): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactcctccctgcccgtcattccnggagacgccggcctccatctcctgcaagtctagtcagacgcctcctacatagtaatggacaacaacttagtttggattcgggtacctgacgagaacgccgagggcagtcctaccacagctctgactcttagtttggtactaagtccgggccgtccgggtcctgactggttcagtgcgagtcggatcgagcacagttactttacgactagaaactacaacgagacgtaggaggtgaggtaggtagttggtttaggggttttaatacgtagtactagtacgtacaacgtactaaccgtaacctaacccgttccccgttaacgtaaccggttccggggaaccggaacggggtaaaccgaaggggtagaacggtaataaaccggaaacggtaacgtggtacggtccgtacggaccctacgtacttacgttcgttccgttactacccg

SEQ ID NO: 159890 - DNA, 636 bp, Homo sapiens
  misc_feature: GYAE6OF01BLAUX.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattccgtggagacgcccggcctccatcctcctgccaagttctagtcaggacgcctcctacatagtaatggaacaactaattatttggattggtacctgacagaacgccgagggcagtctccacagcctctgacttcttagtttcgggtactaacggtccgggcccgtcccggggtcctagtacgtaggttcgaggtcggcgtagtaggtactcgaaggctaacgtaagttactttaacgaataacgaaactacgaaacgtaggtagggtacggaaggtcgtaggtaaggtagtttgggtttagggtttatacgtagtacagtagactacgtactacctaacctaacccgttcccgtaacgttacggtccgggtacgggaacgggaaccgtaagggtaggacgaacgtaaccgaaacgtagtggcggactaggaccctaacgtacttcctgttcccttacgtaccc

SEQ ID NO: 159891 - DNA, 593 bp, Homo sapiens
  misc_feature: GYAE6OF01DSKGT.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagacgccctcctacatagtaatggacacaactattgattcggtacctgcagaagccagggcagtctccacagctcctgatctagtttggtactagtcggcccgtccggggtccctgactaggtcaggtggcaggtggatcgaggcacgtagtactttacactagaaactacgaacgagtagtggaggctaggaggtagttggtttaggggtttattacgtagtacagttacgacgtaacgtctactaaacctaacccttacccgtaccgttaacggttcgggacgggtacgggtaaccgtaagggtggaacgtacgtaacgaaaacggtacgtggtcggacctacggacctaccgtataccgttcgttcttacccgtaccg

SEQ ID NO: 159892 - DNA, 565 bp, Homo sapiens
  misc_feature: GYAE6OF01EKYI7.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgcccggcctccatctcctgcaagtctagtcagacgcctcctacatagtaatggacacaactatttggattggtacctgcaagaagccgagggcagtctccacacgctcctgattcttagtttgggttctaagtccgggtccgtccgggtcctgactaggttcagtggctagtggatcaggcacgtagtatttacatagaaatcaacagaggtggaggctaggaggtagttggtttagggtttattacgtgtcgagtcgacaagtctaactaacaacccttcctaacgtacggttcgggacgggagggaaccgtaaggaggagaactaacgaaacgtaacgtggtcggactgacctacgtacttacgttcttcgttctacccg

SEQ ID NO: 159893 - DNA, 588 bp, Homo sapiens
  misc_feature: GYAE6OF01D4JAY.19.83.H06.1.454.CMB.1.raw
  modified_base (342)..(342): a, c, t, g, unknown or other
  misc_feature (342)..(342): n is a, c, g, or t
  modified_base (391)..(391): a, c, t, g, unknown or other
  misc_feature (391)..(391): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccaggcagtctccacagctcctgattctattttgggtctaagtccgggcctccggggtccctgactaggttcagtgcngtggatcgaggcacagtatttacactaagaaatcgaacagagtcggagntgaggtatggttgggtttattcgtgactagtgacaacgctactaacctaaaccgtccctacgtaacggttccgggaacggggtacggaaccgtaaagggtacggaacgtaacgtaacgtaaaaaccgtaacgttcggtacgggacccttaggaccctaaccctaacgtttcccgttcggttacctttccgtaacccg

SEQ ID NO: 159894 - DNA, 649 bp, Homo sapiens
  misc_feature: GYAE6OF01BNEGY.19.83.H06.1.454.CMB.1.raw
  modified_base (218)..(218): a, c, t, g, unknown or other
  misc_feature (218)..(218): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagacgcccggcctccatctcctgcaagtctagtcgganccctcctacatagtaatggacacaacttatttggattggtacctgacagaacgccgagggcaggttcctccacacgccttccctggacttcgttagtttgggttacctaagtccgggccccgttccggggtacccctggaccgtaggttcgaggttcggctaggttggactcgacggtcaacgtagtacttttacaacgtagaaacttcgaataggagtggacggactaggtaggtactttgggtttagggtttacttacgtcgtactagtcgactaacgtctaccgtaacgtaaccctcccgtagtaccgttcgggacgggtaacggaccgtaagggtcggaacgtacctaacgaaaccggtaccgtaggtacggtcgtacgtaccgtaaccgtacttaccgtacgtttcctccgttaccgttacccccg

SEQ ID NO: 159895 - DNA, 759 bp, Homo sapiens
  misc_feature: GYAE6OF01DRNUU.19.83.H06.1.454.CMB.1.raw
  modified_base (195)..(195): a, c, t, g, unknown or other
  misc_feature (195)..(195): n is a, c, g, or t
  modified_base (250)..(250): a, c, t, g, unknown or other
  misc_feature (250)..(250): n is a, c, g, or t
tcagtactctcgtgcacgaccggtgctcgatttagatcacgtgcgtcgcgggcgtagactttgtgtttctcgtagtctgctttgctcagcgtcgagggtgctgctaatgctcgtgggtctctggatccgaggtggggattagttggtggtgacttcgagttcctccaccttcctcccgtcgcccgtcacttccgnggagcgcccggcctccagtcctccgtgacaagtctagtcagacgtcctacctaanagttaacgtaagtcggaacctaactaaactttagtttaggtactttcgggtacctggaccaaggaacggcccgaaggggcctaccgtcctacccaacgtagtcccttctaggtacttcgtttaggtttcggttacctacggtccgggtcccgtcccgggtccagtacgtaggttacgagggtcgacgtaggttacggacgtaccgaggtactaacgtacgttaactttaccgaaacgtaagtaaaacctcgaaagtagggtagggtagggacggtagttagggtaaggttaggttttagggtttaacgggtttacttacgtaccgggtatacgggtcaacgtacgtacccttaaccgtaacctacccgttacccgtacggtaacgggttccgggaaagggtaccgggtaacggaagggtaccgtaaacggtaacgaaacccggtaacggtaggtacggtcgtacggtacctaccggtacttcgtaaccgttccgttacctcggtacccc

SEQ ID NO: 159896 - DNA, 556 bp, Homo sapiens
  misc_feature: GYAE6OF01EYZCM.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatcctcctgcaagtctagtcagagcctcctacatagtaatggacacaactattggattggtacctgcagaagccaggcagtctccacagctcctgatctagtttggttctaagtccgggccgtccgggtcctgactaggttcagtggcagtggatcgaggcacgtagtatttacactagaaatcaacgagtagtaggagcgtagaggtagttggtttagggttttacttacgtgtactagtagtacaagtctacctaacaaccctccctacgtaacggttcgggacggtaggaaccgaggtacggacgtataccgaaacgtacgtggtcgacgtacgactaccgtatacgttcgtccttcgtac

SEQ ID NO: 159897 - DNA, 558 bp, Homo sapiens
  misc_feature: GYAE6OF01CZDEV.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagagcctcctacatagtaatggacacaactatttggattggtacctgcagaagccagggcagtctccacacgctcctgatcttagtttgggttctaagtccgggccgtccggggtccctgacgtaggttcaggtggcaggtggatcgaggcacgtagtattttacactagaaatacaacagagtggagcgtggaggtagttggtttagggtttattacgtgactagtcgacaacgtctacctaacctaacctcccgtacgtaaccggttcgggacggacggaaccgtaagggtaggagactaacgaaacgagtggtcgctcgactaccattctcgtcttcgtaccg

SEQ ID NO: 159898 - DNA, 528 bp, Homo sapiens
  misc_feature: GYAE6OF01EY392.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtaccctgcagaagccagggcagtctccacagctcctgatctatttggttctaatcgggcctccgggtccctgacaggttcagtggcagtggatcaggcacagatttacactgaaatcaacagagtggaggctgaggtatggtttaggggtttattacgtgactagtgacaagctctaacaaacctcccgtacaacgttcggaggacgggaccaagggtggaacgagtaccgaaacggtacaggtcggacctgaccgaccattctgttcctgtacccg

SEQ ID NO: 159899 - DNA, 572 bp, Homo sapiens
  misc_feature: GYAE6OF01ES36R.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaacttattggattggtacctgcagaagccagggcagtctccacagctcctgattcttagtttcgggttactaacgtccgggtcctccggggtccctgacgtaggttcaggtggcgtagtggatcgaggctaacgagttaattttacacgtagaaaactcaaacgtaggtagtggaggtctaggaggtagtttgggtttagggttttattacgtgtacagtgacaagctactaacaaccttccgtacgtaacggttcggacggtacggaaccgaagggtaggataacgaacgaaacgtagtggtggactcgacctacagttctcgttcgtctaccg

SEQ ID NO: 159900 - DNA, 513 bp, Homo sapiens
  misc_feature: GYAE6OF01CJI86.19.83.H06.1.454.CMB.1.raw
  modified_base (416)..(416): a, c, t, g, unknown or other
  misc_feature (416)..(416): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggtctaagtcgggcctccgggtcctgactaggttcagtggcagtggatcaggcacagtattttacactagaaatcaacgagagtggagctgaggtatggttgggttattactgcatganaagtctactaacaaacctccctacgaacgttcggacggaggaccgaagggtggacgatacgaaaacgtactggtgctgaccacatctgtctctaccg

SEQ ID NO: 159901 - DNA, 718 bp, Homo sapiens
  misc_feature: GYAE6OF01A8FYZ.19.83.H06.1.454.CMB.1.raw
  modified_base (218)..(218): a, c, t, g, unknown or other
  misc_feature (218)..(218): n is a, c, g, or t
tcagtactctcgtgcacgaccggtgctcgatttagatcacgtgcgtcgcgggcgtagactttgtgtttctcgtagtctgctttgctcagcgtcaggtgctgctaatgctctgggtctctggatccaggtggggatattgtggtgactcagtctccactctccctgcccgtcattcctggagacgcccggcctccatctcctgcaagtctagtcagacncctcctacgatagtaatggacaactaacttagttggattggtacctgcaagaacgccgaagggccagtcctaccacacgtcctcctgacttcctttaaggttttcggttcttaaacgtcccggggtcccggttcccgggggttcccctaggtaccgttagggttaccgtaaggtcgggtacgaaggtcgggtaacttaccgacggtaacctaacgtaggtttaaacttttaacgaacgtaagtaaaactacgaaacgaggtaggtagggaggtacgtaggtaaggtaggtttaggtttaggggtttaccttaagtcgtacgtagtacgtacgtaacggtaccgttaacctaaaccgtaacccttcccggtaaccggttaaccgggttaccgggaacggggttaaccggaaacgtacgggtaggaaccgtaacgtaaccgaaacggtacgtaggtacggcgtaccgacgtaccctattaccgtcgttccgtcgttaacccg

SEQ ID NO: 159902 - DNA, 724 bp, Homo sapiens
  misc_feature: GYAE6OF01ETBKE.19.83.H06.1.454.CMB.1.raw
  modified_base (182)..(182): a, c, t, g, unknown or other
  misc_feature (182)..(182): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggattattgtggtgactcagtcctccactctccctcgcccgtcacttccnggagacgcccggcctccatcctcctgacaagttctaagtcagcgtccctacctaacataagtaactggaaccaactaacttagtttggacttacggtacctgacgaagaacgcgacgggctacgttccaccacgacgtccttacctagtattctttaggtttcggtacgttaacggtccgggtcccgttcccgggtcccgtgaaccgtacggttacaggtcggacgtaggtgactccggagacctaagtagttaacgtttactaagtaaacgtaaacgtaacgtaacgaaggtacggtagggtacggtacggtaggtaaggttaggtttaggtttacgggtttaagtttacgtacgtactacgtacgtaacgtaacgtactaaccgttaacctaacccttacccgtaaccgtaaccggtacgggtaaccgggaacgggtaacggtaacgggtacggtaacgtaaacgtaacggtaaacgtaacgtacggggggtcctacgtaccgaccgtaccgtacgttacgttcgttccgttcgtacccg

SEQ ID NO: 159903 - DNA, 652 bp, Homo sapiens
  misc_feature: GYAE6OF01DUXR6.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattcctggagacgcccggcctccatctcctgcaagtctagtcagacgcctctacatagtaatggacacaacttattggattcggtacctgacagaagacgagggcagtctccacacgctcctgattcgttagttttcgggtactaacgtccgggtcccgttcccggggtccctaggacgtacggttcaaggtcggacaggtggactacgaggcactagtaattttaacacgtaagaaaactacgaaacgtaggaggtagggaggtacgtagggaacgggttagttgggttttaggggttttaacttacgtaggtactagtacgacgtaacgtcctaacctaaccctaacccgttcccgtaacgtaaccggggttacggacggggtaacgggaaccggtagggtaggaacgtaacgtaaccgaaacgtaggttcggtcggactacgacctaacctagttaccgtttcgtcctcgttacccg

SEQ ID NO: 159904 - DNA, 607 bp, Homo sapiens
  misc_feature: GYAE6OF01ELRQE.19.83.H06.1.454.CMB.1.raw
  modified_base (172)..(172): a, c, t, g, unknown or other
  misc_feature (172)..(172): n is a, c, g, or t
  modified_base (179)..(179): a, c, t, g, unknown or other
  misc_feature (179)..(179): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtccctggatccagtggggatattgtggtgactcagtcctccactctccctgcccgtnattccgnggagcgcccggcctccatctcctgacaagtctagtcagacgccctactacatagtaatcggacaactaacttagtttggagttcggtacctgacgaagacgccgagggctacgtcctaccactacgctcctagtactctttaagtttcggtactaacgtccgggcccgttccggggtacctaggacgtaggttcaggtggcaggtcggactcgacggacatagtactttaaccagtaagaaactcaacgagtagaggagcgtaggtaggtagttggtttaggttactacgtgacgtatcgacacgtctaacgtaacctaacctcccgtacgtacggtacggtacggacggacgtaaggtacggagtaaactaacgaaacgtcgtaggtcgcgttacgacctacgtactcgttagtccttgccttcccg

SEQ ID NO: 159905 - DNA, 588 bp, Homo sapiens
  misc_feature: GYAE6OF01CBACG.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagagcctcctacatagtaatggacacaactatttggattggtacctgcagaagccagggcagtctccacagctcctgatctatttgggttctaagtcgggcctcccgggtcctgacaggttcaggtgcgagtgatcaggcacagtatttacactagaaatcaacgagagtaggaggcgtagagggtagttggtttagggtttattacgtggtacagttgacgaacgtcgttacctaacctaaaccttcccgttacgtaacggttcggtacgggacggtaaccgagggtacggaagtaacgtaccgtaaaacggtaacgttggtacggcctacggaccgtaacctacgttaccgttacggttccctttacgtacccg

SEQ ID NO: 159906 - DNA, 542 bp, Homo sapiens
  misc_feature: GYAE6OF01B7YPX.19.83.H06.1.454.CMB.1.raw
  modified_base (171)..(171): a, c, t, g, unknown or other
  misc_feature (171)..(171): n is a, c, g, or t
  modified_base (505)..(505): a, c, t, g, unknown or other
  misc_feature (505)..(505): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagagccggcctccatctcctgcaagtctagtcagacgcctcctacatagtaatggacacaactattggattggtacctgcagaagccgagggcagtcctccacagctcctgatcttagtttgggttactaacgtccgggccgtcccggggtccctgacgaggttcaggtggcaggtggatcgagcactagtatttacactagaaatcaacaggacggtaggaggcgtaggaggtagttgggtttagggtttattacgtgctagtgacaagtctactaactaacctcccgtacgtaacggttcgggacggacggacaggtagacganacgaacgacgtgtcgcgcactacatctctctctaccg

SEQ ID NO: 159907 - DNA, 776 bp, Homo sapiens
  misc_feature: GYAE6OF01BJDJV.19.83.H06.1.454.CMB.1.raw
tcagtactctcgtgcacgaccggtgctcgatttagatcacgtgcgtcggcgggcgtagactttgtgtttcgtcgtagtctcgcgtttgtctcgagtcgtctagggtgctgcgtaaatgactctgggtctactggatccaggtggggtatattgtggtgactcttagtctccacttcttacccgtgcccgtcattccgtggagacgcccggcctccatcctcctgcgaagttctagtcagacgccgtcctacatagtatgacacactattgattggtacctgctagaacgcaggcacgtctcgacagcctcctgactctagtttcgggttactaacgtccggtaccggtcccggggttcctcggtacgtaggtttacgtaaggtcgggacgtaggtaggtactacgtaaggtacgaacgtaacgtttaacgttttaaccgaacgttaacggtaaaacctccgtaaacgtaaggtacgttacgggtaacggtcgtaaagggtaacgggttaacgtttacggggtttttaacggggttttaaactttaccggttacggtaacgttaaggttcgtaaccgtaaagttaccgtttaacccgtaaaacgtaaacccctttccccgttaaacggttaaacggggtttccgggtaacggggaaccggggtaaaccgtacgggttaacggtaacgtacgtttaaaccgtaaacggttaacgtaaacggttggtaccggtacgacggtaaccctacgttaagtccggttagttacccgttacccgg

SEQ ID NO: 159908 - DNA, 568 bp, Homo sapiens
  misc_feature: GYAE6OF01AZJIN.19.83.H06.1.454.CMB.1.raw
  modified_base (177)..(177): a, c, t, g, unknown or other
  misc_feature (177)..(177): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattccnggagagccggcctccatctcctgcaagtctagtcagagcctcctacatagtaatggacacaactatttggattggtacctgcagaagccagggcagtctcacagctcctgatctatttgggtctaagtcgggccgtccgggtcctgactggttcagtcggctagtggatcgaggcacagtacttttacactagaaaatcaacagagtggagcgtagaggtagttggtttaggggtttacttacgtgtacgtatcggacaacgtcttactaactaaacccttcccgtacgtaaccggttcggacgggacgggtaccaagggtgaagtaactaccgaaacgtaacgtcggtcggactacggacctaacctagttacctcgttccttcgtaccg

SEQ ID NO: 159909 - DNA, 685 bp, Homo sapiens
  misc_feature: GYAE6OF01B824P.19.83.H06.1.454.CMB.1.raw
  modified_base (178)..(178): a, c, t, g, unknown or other
  misc_feature (178)..(178): n is a, c, g, or t
  modified_base (292)..(292): a, c, t, g, unknown or other
  misc_feature (292)..(292): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattccnggacgacgcccggcctccatcctcctgcaagtctagtcagacgcctcctacatagtaatggacaactaattagttggattcggtacctgacagaacgccgaggcagtcaccacncgctccgtgacttcgttagtttcgggtactacgtccgggtcccgttccgggtcctgacgtacggttcaggtgacgtaggtcgactcgaggacagtacgttaactttaccaagttaacgaaactacgtaacgtagggtagggtagggaacggtacgtagggtaaggttaggtttgggttttaacggggtttaacttacgtgtacgtagtcggtaacgtaacgtactaaccctaaaccgtaacccgttcccgttacggtaaccgggttaccggggaacgggtaacgggtaaccggtaaggggtaacgtaccgtaaacgtaaccgtaaaccggtacgtacggtacggtaccgtacggaccctacgttactaccgtttcggttccctacgttacccg

SEQ ID NO: 159910 - DNA, 677 bp, Homo sapiens
  misc_feature: GYAE6OF01CKFZS.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagacgcccggccctccatctcctgacaagtctagtcagcgcctcctacatagtatggacacaactatttggattggtactgacagaagccgagggcagtcctaccacagcctcctgacttcgtttaagttttgggttacttaacggtcccggggtcccgttccccggggtccctacgacgtacggtttcgacggtggtcgtaggtggacgtccgaaggtaccacgtaaagttacttttaaccgaacgttaagtaaaacgtaccaaacggtaagggtaagggtagggagggtacgttagggtaagggtaggtttagggttttaggggtttagtttaacgtgtcgtagtacgtacaacgtaccttaaccgtaacctaaccctccccgtacgtaaccggttcgggacgggacggaaccggtagggtacggaagtaacgaacgtaaaccgtaagtcggtcggtccgtacgtacctacctctcgttcttccgttcttacccg

SEQ ID NO: 159911 - DNA, 605 bp, Homo sapiens
  misc_feature: GYAE6OF01AV811.19.83.H06.1.454.CMB.1.raw
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattcctggagacgcccggcctccatcctcctgcaagtctagtcagacgcctcctacatagtaatggacacaactatttggattggtacctgcagaagccgagggcagtctccanagcctccngtatcttagtttgggttactaagtccgggccgtcccggggtcctggactaggttcaggtggcaggtggatcgaggccacgtagttactttaacgataagaaaactacaacgaggaggtagggaggtctaggaggtagttgggtttagggtttaattacgtgactagtcgacgaactcgttacctaaaccgtaaaccctcccgttaaccgtacggttaccgggacgggaacgggtaccgtaagggtacgacgtaacgtaacgaaaccggtactgggtggcctagaccaactactacgttctccgttctaccg

SEQ ID NO: 159912 - DNA, 557 bp, Homo sapiens
  misc_feature: GYAE6OF01ED9A9.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacactaactatttggattggtacctgcagaagccagggcagtctccacagctcctgatctagtttgggttctaagtcgggtccgtccggggtcctgactaggttcagtggcagtgatcaggcacgagtactttacactagaaatcaacagagtggaggctggaggtagttggtttaggggtttattacgtgtactagtcgacacgtctacctaactaaccttccctacgtaacggtcgggacggacgggaacgtagggtaggaagaacgtacgaaacggtagtggtcggacgtcgacctaactagttccttcgttcttctaccg

SEQ ID NO: 159913 - DNA, 635 bp, Homo sapiens
  misc_feature: GYAE6OF01BUFPL.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatcttagtttgggttctaagtccgggcctccggggtccctgactaggttcagtgcagtgatcgaggcacagtactttacactagaaatacaacgagagtggaggtctaggaggtagtttagggtttaggggttttaacttacgtgcggtatggactaaggtccttaccgtaacctaaacccttcccgtaaccggtaaccggtttccgggaccggggtaacgggaacccggtaaaggggtacgggtaacggtaaccgtaaaccgtaaaaccggtaacggttgggtacgggtacgttacggaccgtaacccgtacgttaccgtttacggttccctttaccgttaacccg

SEQ ID NO: 159914 - DNA, 666 bp, Homo sapiens
  misc_feature: GYAE6OF01BU14Q.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatctccctgcaagtctagtcagagcctcctacatagtaatggacacaactatttggattggtacctgcagaagccaggcagtctccacagctcctgatctagtttgggttctaacgtcgggcctccgggtccctgactggtcagtgctagtggatcgaggcacagtattttacacttagaaaactcaacgtaggtagtgggaggcgtaggaggtagtttgggtttaggggttttaagttacgtgctaagtcgactaacggtactaccttaaccgtaaaccccttcccgttaacccggtaaccgggttttaccggggacccggggtaacggggaaaaccccgtaaggggggttacggaaaacggtaacgtaaccggtaaaaacccggtaacgttacggggttaccggaccggttaccgaccgtaaaccccgttacgtttaccctttaccgggtttaccctttccgttaaccccg

SEQ ID NO: 159915 - DNA, 672 bp, Homo sapiens
  misc_feature: GYAE6OF01BJIIY.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactcctccctgcccgtcattcctggagacgcccggcctccatctcctgacaagtctagtcagacgcctacctacatagtaatcggacaactaacttatttggattcggtacctgacaagaacgccgagggctacgtcctccaacgacgtccttaccgtgtacttcgttagttttcgggttactaacggtccgggtcccggtcccggggtccctaggtacgtacggttacgaggtcgacgtaggtgactcgaggacactagttactttacgaactaagaaactacaagaggtaggtacggaagtcgtaaggaggttagtttagggtttagggtttactacgtgtacgtagtacgactaacgtacttaacctaaacctaacccgtacccgttacggtaaccgggttcgggaacggtacgggtaaccgaagggtacgtaacgtaacgtaacggaaaacgtaggttacggtccggtacgtaccgacctaacgttcttaccgttcttccgttccgtacccg

SEQ ID NO: 159916 - DNA, 832 bp, Homo sapiens
  misc_feature: GYAE6OF01C8O54.19.83.H06.1.454.CMB.1.raw
  modified_base (180)..(180): a, c, t, g, unknown or other
  misc_feature (180)..(180): n is a, c, g, or t
  modified_base (244)..(244): a, c, t, g, unknown or other
  misc_feature (244)..(244): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactcctccctgcccgtcattccgnggacgcgcccggcctccatcctcctgctaagtctagtcagacgtccctacctacaattagtaancggaaccaactaacttagttggtattggtacctgcaagacgccgaggcagtcctaccacacgcctccgtgtacttcgttagttttcggttacctaacggtcccgggtcccgttacccggggtccctacggtaacgtaggttccgaagggtcggtacgtaggtacggactacggaacggtacaaaccgtaagtttaacttttaaccgaacgtaaaggtaaaacttaccgaaacgtagggtaacgggtacgggtaacggtacgttagggtaagggttagggttttaggggttttaacggggttttacttaaccggtgtaacgtacgtacggtacgtaaaccgggttaccttaaaccgtaaaccccgttaaaccccgttaccccgttaaccgggtaaacccggggtttccggggaacccgggggtaaccggggtaaacccggtaaggggtacgggtaaaaacggttaaccgttaaaacccgggaaaaaccggttaccggtttaacgggtccggggttaccctaacccggtaacccgaaacccgtttacgttaacccggtttacggttcccttaacccggtttaccccccgg

SEQ ID NO: 159917 - DNA, 784 bp, Homo sapiens
  misc_feature: GYAE6OF01D6TQX.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggattattggtggtgactcagtctccactctccctgcccgtctatcctggagacgcccggtcctccatctcctgacaagtctagtcagacgtcctacctacaataagtaagtacggaaccaactaaactttagtttgggaactttcggtaaccctgacaaggaaacgccgtagggcacgtcctaccagacgtcctacctagtattccttagtttgggttactaacggtcccgggtcccggtcccggggtaccctagtacgtagggtttacaggttcggactaggttcggaactacgaggtcccaaagtacttaagttttaaaccaacgttaaagaaaactaaccgaaacgagggtaaggttacggggaacggtacgttagggaaagggtttaagtttcggggtttttaaggggtttttaaacttaccgtaggtactaacgttacgaaccgaagttaacccttaaacctaaacccgtaaaccccgttaccccgtaacggttaacccgggtttaccggggaacgggggtaccgggaaaccggtaaggggtaacggaaccgtaaagtaaaccgtaaaacggtaaccgttggtaccggtacctaccggtaaccctaccttaaacggttcctttacgttacccgttacgtaaccccg

SEQ ID NO: 159918 - DNA, 679 bp, Homo sapiens
  misc_feature: GYAE6OF01DUCRB.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctcccttcccgtcattcctggagagccggcctccatctcctgcaagtctagtcagacgcctctacatagtaatggacacaacttatttggattggtacctgcagaacgccgagggcagtcctccacacgtcctcctgattcgttagttttcgggttactaacggtccgggtcccggttcccggggttccctaggacgtagggttcgaggttggcgtaggtggatacgaggcacgtacgtaagttttacaacgtaagaaaatcaaacgtagacggtaggacggtcgtaggtaggtaagtttgggtttaggggttttattacgtcgtacgtagtacgaacgtaacgtacttaccgtaaacctaacccgttaccccgtaacggttaaccgggttaccggggacggggtaacgggaaccggtaaacggggtacggaacgtaacgtaaccgtaaaacggtaacgtaggtacggtccgtaccgaccaacccgttagttaccgttacgttccttactccgttaccccg

SEQ ID NO: 159919 - DNA, 574 bp, Homo sapiens
  misc_feature: GYAE6OF01B71CL.19.83.H06.1.454.CMB.1.raw
  modified_base (367)..(367): a, c, t, g, unknown or other
  misc_feature (367)..(367): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagacgcctcctacatagtaatggacacaactatttggattggtacctgcagaagccagggcagtctccacagctcctgtatcttagtttgggttctaagtccgggtccgtccggggtccctgacgtaggttccaggtcggcagtggatcgagcanagtattttacactagaaatacaacagagtggaggctaggacggtagttggtttaggggtttattacgtgacgtatgactaagtctactaacctaacctcccgtaacgtaaccggttcgggacgggacggaaccgtaagggtagacgtacgtaacgaaacgtacgtaggtcggactcgacctacgtacgtacttcgtctcgttacccg

SEQ ID NO: 159920 - DNA, 618 bp, Homo sapiens
  misc_feature: GYAE6OF01CJ6K6.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagacgcctcctacatagtaatggacacaactatttggattggtacctgcagaagccagggcagtctccacagctcctgatctatttgggttctaacgtcgggcctccggggtccctgacgtaggttcagtggcaggtggatcgaggcacacgtatttacatacgaaatccaacgaggaggtgggaggtacgtaggaggtagtttggtttggggttttaatttacgtcgactagtcgacaacggtcttacctaacctaaaccttccccgtacgttaaaccggttccggggaacgggacggggtaaaccgtaaggggtacggaaacgtacgtaaaccgaaaccggtaacgtacgggtcggtaccgtacggacctaaccctacgttaccttacggttccttacgtacccg

SEQ ID NO: 159921 - DNA, 723 bp, Homo sapiens
  misc_feature: GYAE6OF01EVJCT.19.83.H06.1.454.CMB.1.raw
  modified_base (184)..(184): a, c, t, g, unknown or other
  misc_feature (184)..(184): n is a, c, g, or t
  modified_base (305)..(305): a, c, t, g, unknown or other
  misc_feature (305)..(305): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggattattggtggtgactcagtcctccactcctccctcgcccgtcattccgnggagcgccgcctcactctctgacaagtctatcagacgcctacctacgataagtaactggaacacctaattagttaggatttacggtacctagacgaagacgaccgaggctagtccacaacncgtctctgatcgttagtttcggtactacggtccgggtaccgtcccgggtacctagacggtacggttacgtagggtcggcgtaggttcggactacggaacggtactaacgtaaggttttaaccttaacgtaaacgtaaagtaaacgttacgaaacggtagggtacgggtacgggtacggtacgtaagggtaagggtagtttagggtttaacgggttttattacgcgtagtacgtagaacgtaacgtacctaacgttaaacccgtacccttacccgttaacggtaaccgggttaccgggacgggtaaacggaacccggtaagggtacggtaaacgtaacgtaaaccggtaaaaccggtactagggtacgtaccgaaccgtaccgtaacgttcgttacgtcgtttaacctcgttaaccccg

SEQ ID NO: 159922 - DNA, 604 bp, Homo sapiens
  misc_feature: GYAE6OF01AY3M6.19.83.H06.1.454.CMB.1.raw
  modified_base (328)..(328): a, c, t, g, unknown or other
  misc_feature (328)..(328): n is a, c, g, or t
  modified_base (352)..(352): a, c, t, g, unknown or other
  misc_feature (352)..(352): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatctcctgcaagtctagtcagagcctcctacatagtaatggacacaactatttggattggtacctgcagaagccagggcagtctccacagctcctgatctatttgggtctaagtcgggcctccgggtccctgacnggttcagtgcagtgatcgaggcanagtatttacatagaaatcaacagagtggagtctggaaggtagttggtttaggggtttaattacgttgactagtcgactaagtcttacctaacctaaacccttccccgttaacgtaaccgggttccgggaaccgggtaacgggtaaccgaagggttacggaacgtaacgtaccggaaaaccggtaacgttaggtacgggtaccgtacggtacctaaacccgtacttaccgttcggttccctttacgtaacccg

SEQ ID NO: 159923 - DNA, 646 bp, Homo sapiens
  misc_feature: GYAE6OF01D6AK0.19.83.H06.1.454.CMB.1.raw
  modified_base (282)..(282): a, c, t, g, unknown or other
  misc_feature (282)..(282): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgcccggcctcctatttcctgcaagtctagtcacgggcctcctacatagtaatggacacaacttattggattggtacctgacagaagccgagggcagtcnccacagctcctgatcttagtttggttactaagtccgggccgtcccgggtcctgacaggttcaggtggctaggtgatcgaggcactagtatttaacactaagaaaactacaacaggtagtcgggagcgtaggaaggtagtttagggtttaggggtttactaacgtgacgtaactggtaccaagtacctaacctaacctaaacccttcccgttaacgtaaccggggttcgggaacccggggtaagggaaaccgtaacggggttaggaaacgtacgttaaccggaaaaccggttagtacgggttaggaccttacgacccgtaactacggtttctacgttaccttaccttacgttccccttaccccgg

SEQ ID NO: 159924 - DNA, 761 bp, Homo sapiens
  misc_feature: GYAE6OF01BWYXM.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctggtctctggatccagtgggatattgtggtgactcagtctccactctccctgcccgtcattccgtggagacgcccggcctccatcctcctgacaagtctagtcagacgcctcctacaatagtaatggactacaacgttattggattcgtacctgcaaggaacgccgagggctaacgtcctaccactacggccttccgtagtacttacgttagttttcgggttacctaacggttcccggggtaccccgtttaccgggggtcccctaggtaccgtacggggttccgaaggtcggacgtacggtggaactccgaggtacctacgtaagttaactttaaccacgttaacgtaaactacgaacgtaaggtacggtacgggaggttacgtaggtaacggtagttttagggtttaggggttttaaacttacgtacgtactaacggtacgtaacgtaaccgtactttaacccgtaaaccgtaaacccgttcccccgttaaggttaaccgggttccggggaacgggttaaccggggaaccggtaaggttacgggtaaacgtaaccgttaacggtaaaaccgggtagtacgggtacggtaccgttaaccggacctaaccgttaccgttacggttaccgtacgtttaacccgttaccccgg

SEQ ID NO: 159925 - DNA, 624 bp, Homo sapiens
  misc_feature: GYAE6OF01A3A51.19.83.H06.1.454.CMB.1.raw
  modified_base (219)..(219): a, c, t, g, unknown or other
  misc_feature (219)..(219): n is a, c, g, or t
  modified_base (280)..(280): a, c, t, g, unknown or other
  misc_feature (280)..(280): n is a, c, g, or t
  modified_base (570)..(570): a, c, t, g, unknown or other
  misc_feature (570)..(570): n is a, c, g, or t
tcagtactctcgtgcacgaccggtgctcgatttagatcacgtgcgtcgcgggcgtagactttgtgtttctcgtagtctgctttgctcagcgtcaggtgctgctaatgctctgggtctctggatccagtggggatattgtggtgactcagtctccactctccctgcccgtcattcctggagagcccggcctccatcctcctgaccaagtctagtcagacncctcctacatagtaatggacacaactattggattggtaccctgcagaagccagggcagtcnccacagctcctgatctagtttggtctaagtcgggcctccgggtccctgactaggttcagcggcaggtggactcgaggctagagtacttttaacactaagaaactcaaacgtaggaggttagggacggtcgtagggaaggtgtttacgggttttagggggttttaacttacgtgtacgtagttcggacctaaaggtctaccgttaaccaaccttcccgtacgtaaccggtttacgggaccgggtacgggaaccgtagggtacgggtacgaacgttaaccgaaaacggtaancggggtacgtcgacggtaccctactacgttacccgtacgtttctaccgtacccg

SEQ ID NO: 159926 - DNA, 733 bp, Homo sapiens
  misc_feature: GYAE6OF01DG4U9.19.83.H06.1.454.CMB.1.raw
  modified_base (147)..(147): a, c, t, g, unknown or other
  misc_feature (147)..(147): n is a, c, g, or t
  modified_base (169)..(169): a, c, t, g, unknown or other
  misc_feature (169)..(169): n is a, c, g, or t
  modified_base (175)..(175): a, c, t, g, unknown or other
  misc_feature (175)..(175): n is a, c, g, or t
  modified_base (193)..(193): a, c, t, g, unknown or other
  misc_feature (193)..(193): n is a, c, g, or t
  modified_base (214)..(214): a, c, t, g, unknown or other
  misc_feature (214)..(214): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtgggatattgtgtgactnagtctccactctcctgcccgtnattccnggagcgccgcctcgatcnctgacaagtctagtcaggacncctacagtatagtaatcggaactactaacttagttggattcggtaacctgacgtaaggaacgccgtaagggctacgtacctcccaagtacgtcttacccgtagtacgttacttaggtttcggtactaacggtcccgggtacccgtcccgggtactggtaacgtggttacgaggtcgctaaggtgatccggaggtacctacgtagttactttaacgacgtaaagaaacttcgaaacgtaggtacgggtacggacggtacgttacggaagggttacgttttaggggtttaacgggtttactaccggtacggtacttacggttacgtaacgtaaccgttacttaaccggtaaacccttaacccggttcccgttaacgggttaaaccggttcgggaacccgggtaaacggtaaccggtaacgggttacgaaccggtttaaacgtaacccgtaaaacgggtaccgttacggggtccgtaacgtaccgaaccttacgtacttacgtcttacccgttagtaccccg

SEQ ID NO: 159927 - DNA, 549 bp, Homo sapiens
  misc_feature: GYAE6OF01EKBP8.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagacgcctcctacatagtaatggacacaactatttggattggtacctgcagaagccaggcagtctccacagctcctgatctagtttggtctaagtcgggcctccgggtccctgacgtaggttcagttggcgaggtgatcgaggcacagtatttacactagaaatacaacagagtggaggctgaggtagttggtttgggtttattcgtgtacgtatcgacagtctactaacctaactccctacgtacgggttacggaccgggagggaaccgtaggtaggataacgtacgtaaaccgagtaggtcggcgtacgacacctactacgtcgttctcgtacccg

SEQ ID NO: 159928 - DNA, 660 bp, Homo sapiens
  misc_feature: GYAE6OF01B5TAM.19.83.H06.1.454.CMB.1.raw
tcagtactctcgtgcacgaccggtgctcgatttagatcacgtgcgtcgcgggcgtagactttgtgtttctcgtagtctgctttgttcagcgtcagggtgctgctaatgctctgggtctctggatccagtggggatattgtggtgactcagtctccactctccctgcccgtcattcctggagagccggcctccatctcctgcaagtctagtcagacgcctcctacatagtaatggacacaactatttggattggtacctgacaagaacgccgagggcagtcctccacacgctcctgactcttagtttgggttactaacgtccgggtcccgtcccggggtccctaggacgtacgggttcgaggtcggcgtaggtggatcgaggcacgtagtactttacaacgtaagaaactacaaacgaggtaggtgggaggtcgtagggaaggtagtttaggtttaggggttttaacttacgtagtacgtagtacgacgtaacgtccttaacctaacctaaaccttccccgtaaccgtaaccgggttaccggggacgggtaacggggtaacccgtaaagggttcggaaagtacgtaaccgaaaaccggtacgtaggtacggtctacggacctaaccgtacttacgtacggtttaccttcgtcgttcccccg

SEQ ID NO: 159929 - DNA, 726 bp, Homo sapiens
  misc_feature: GYAE6OF01DO3ZL.19.83.H06.1.454.CMB.1.raw
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctcgtgggtctctggatccgaggtggggattagttgtggtgactcagtcctccacttcctcccctgccccgtctattccgnggagacgccggcctccatcctccngacaagtctaggtcaagacgtcccttacctaactataacgtaagcggaactaacaacgtttagtttggattcggtaacctggacgaaggtaacgccggacgggctacgtcctaccacgtacgccctacgttagaactttcgtttacggtttacgggtacctacggtcccggggcccgttccccggggtacctaggaacgttaggggttcagggttcggacgtaggtaggtacctacggacggtaccaaacgttaaggttaactttaaccgaagttaacaaactacgaacgtaggacgtagggacgtagtaggaagggttggttagggtttagggtttacttagtcgtactaaggtcgaacgtaacgtactaaccgttaacctaacccgttccctaggtaaccggtcggggaacgggtaacggaaccggtaagggtaggaaaccgtacgtaaaccgaacgtaggtacggtaggtacctacgacctacccgtattacgtccgttactccgtaccg

SEQ ID NO: 159930 - DNA, 580 bp, Homo sapiens
  misc_feature: GYAE6OF01DRLO6.19.83.H06.1.454.CMB.1.raw
  modified_base (171)..(171): a, c, t, g, unknown or other
  misc_feature (171)..(171): n is a, c, g, or t
  modified_base (177)..(177): a, c, t, g, unknown or other
  misc_feature (177)..(177): n is a, c, g, or t
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
tcagtactctcgtgcacgaccggtgctcgatttagatcacgtgcgtcgcgggcgtagactttgtgtttctcgtagtactgctttgctcagcgtcagggtgctgctaatgctctgggtctctggatccaggtgggatattgtggtgactcagtctccactctccctgccctnattccnggagagccgcctccatctcctgcaagtctagtcagancctcanatagtanggacanatattgattggactgcaganccgaggcagtctcanagctctgatctagtttggtcagtcggcctccggtcctgacaggttcagtggcagtgatcacggacactagtatttacactaagtaaactgaacgagtagtggaacggtctaggacgttagttgggtttagggtttaacttagtgactagttacgacgtaacgtacttactaaaccggtaacctccccgttaacgtaacggtttcgggtagggaacgggtaaccgtaaagggtcggaagtaacgttaaccgaaacgtagttcggtacggaccgttaggacctaacgtacgttaccttgttcctaccgtacccg

SEQ ID NO: 159931 - DNA, 649 bp, Homo sapiens
  misc_feature: GYAE6OF01DRCA2.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagacgcctacctacataagtaatggacacaactattggattggtactgcagaagcagggcagtctccacagcctcctgattcttagttttggttactaagtccgggcccgtcccgggtccctgacgtaggttcagtggctagtggatcgaggcactagtatttaacactaagaaactacgaacagtaggtaggaggcgtaggaggtagttgggtttagggtttaattacgtagtactagtcgaacgtaaccgtaccgttaacctaacctaaacccgttaccccgtaaccgttaaaccgggtttccggggacggggaaccgggtaacccgtaaaggggtacgggaacgtaacgtaaaccgaaaaccggtaacgttacgggtcggtacccgtacgacccgtaaccgtattacccgttacggtttccttacgttaaccccg

SEQ ID NO: 159932 - DNA, 659 bp, Homo sapiens
  misc_feature: GYAE6OF01DK987.19.83.H06.1.454.CMB.1.raw
  modified_base (172)..(172): a, c, t, g, unknown or other
  misc_feature (172)..(172): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtnattcctggagagcccggcctccatcctcctgcaagtctagtcagacgccctcctacatagtaatggacactaatatttggattggtacctgcagaagccagggcagtcctccacacgctcctgattctagtttggtactaacgtccgggtccgtccggggtcctgacgtaggttcaggtggctaggtggactcgacggacacgtagttacttttaacacgtaagtaaaactacgaacgaggtagggtagggagggtacgtagggaaggtagtttgggtttagggtttattacgtggtactagtacggactaacgtaccttaactaacctaaacccgttccccgtacgtaaccgggttacgggaccgggtacggggtaaccgtaagggtacggaaaggtaaccgtaaccggaaaaccggtacgttacgggtcgggtacccgtacgtaacccgtaccgtacttccgttacgttccttaccgttaccccg

SEQ ID NO: 159933 - DNA, 737 bp, Homo sapiens
  misc_feature: GYAE6OF01DS54S.19.83.H06.1.454.CMB.1.raw
  modified_base (171)..(171): a, c, t, g, unknown or other
  misc_feature (171)..(171): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggacgagcccggcctccatcctcctgacaagtctagtcagacgtccctctaacatagtaacgtggaacaacgtaacttagtttggtaattcggtacctgacaagaacgccgagggcagtcctaccagacgccttctgacttcgttagttttgggttacctaacggtccgggtcccgtacccggggtcctggtacgtacgggtttcaggtggctaaggtgactcgacggtcaactacgttaacttttacaactaagtaaaactacgaacgtagggtacgtagggacggtacgtaggtaacggtagtttagggtttacggggtttaactttacgtaggtactagtcggaacgtaacgtaaccgttaacctaaacccgttaaacccgttccccggttaacgtaacccggggtttaccgggaaccggggtaacgggtaaccggtaaagggtacggtaaacggtaaccgttaaacccggtaaaccggtaagggttcggtacggttaccggtacgaacccgtaaccgtacggtttacctttcccgggttaccttcccgttaacccg

SEQ ID NO: 159934 - DNA, 816 bp, Homo sapiens
  misc_feature: GYAE6OF01AEME8.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtcctccactcctccctgcccgtcattcctggagacgcccggccctccatcctcctgcaagtctagtcagacgccctacctacatagtaatggacactaacttagtttaggatttggtacctgacgaagacgccgagggctacgtcctccacgagtcctcgtagtacttcgtttagtttcgggttactacggtccgggtcccggttcccggggtcctaggacgttacggttcgacggtcggacgtaggtcggtacgtacggacggaacctaacgtaacgtttaacttttaaccgaacgttaaacgtaaaacgttaccgaaacggttaacgggtaacgggttacggggaacgggttacggttaaggggttaacgggtttaaggttttacgggggtttttaacgggggttttaacctttacggacggtaacgttacggtaaccggtacgtaaaccgttacccttaaccgttaaaaccccttaacccgttaccccgttaaccgggttaacccggggttaccgggaaccgggggtaaccgggtaaccgggtaaggggtaccgggtaaacgtaaaccgttaacccggtaaaacggttaccggttacgggtacgtacccgttacggacccttaccggttacgttacccgttacgtttccctaccgttaccccg

SEQ ID NO: 159935 - DNA, 630 bp, Homo sapiens
  misc_feature: GYAE6OF01DRFQU.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattcctggagacgcccggccctccatcctcctgcaagtctagtcagacgccctcctacatagtaatggacacaacttatttggattggtacctgacaagaagcccgagggcacgtcctccacacgctcctgacttcgttagtttcgggttactaacgtccgggtcccgttcccggggtacccctgacgtacggttcgaggtcggacgaggttcggatcgaacgcacgtagtacttttaacactagtaaaactcgaaacgaggtaggtagggacgtcgtaggaagggtagtttgggtttagggtttaacttacgtcgactagtacgactacgtcctaactaacctaaccctccgtaaccgtacggttcgggacgggacggaacgtaagggtacgaacgtacgtaacgaaacggtatcggtcggtactcgaactacctattccttgttccgttctacccg

SEQ ID NO: 159936 - DNA, 562 bp, Homo sapiens
  misc_feature: GYAE6OF01BRC6N.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacactaactatttggattggtacctgcagaagccagggcagtcctccacagcctctgatcttagtttgggttctaagtccgggtccgtccggggtcctgacgtaggttcagtggcagtggatcgaggcacgagtactttacactagaaaatcaacgagtagtggaggtctggaggtagtttgggttagggtttattacgtgctagtgacaagtctacctaactaacctcccgtacgtaaccgggttcggacggacgggaccgtaagggtagagtactaacgaaacgtaagtggtcgcgtacgacctactacttactcgttctcgtaccg

SEQ ID NO: 159937 - DNA, 608 bp, Homo sapiens
  misc_feature: GYAE6OF01BB3EM.19.83.H06.1.454.CMB.1.raw
  modified_base (566)..(566): a, c, t, g, unknown or other
  misc_feature (566)..(566): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctctgcaagtctagtcagagcctcctacatagtaatggacacaactattggattggtacctgcagaagccagggcagtctccacacgctcctgtatcttagtttcgggttactaacgtcgggtacccgtcccggggtccctggaccgtaggttcgaggtcggcgaggtcggatcgacggcacgtagtacttttaacgacgtacgaaatcaacgtagaggtaggaacggtctaggtaaggtatttagggtttggggtttaattacgtggactagtacgacaacgtctaaccgtaactaacccgttccccgtacgtaaccggttcgggtagggaacgggaccgtaacgggtaggaacgtaatacgaaacgtagnggtcggactacggacctactattacgtcgttacttcgtaccg

SEQ ID NO: 159938 - DNA, 622 bp, Homo sapiens
  misc_feature: GYAE6OF01BQJ4L.19.83.H06.1.454.CMB.1.raw
  modified_base (171)..(171): a, c, t, g, unknown or other
  misc_feature (171)..(171): n is a, c, g, or t
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagagcccggcctcatctcctgcaagtctagtcagacnccctctaacatagtaatggacanaacttattggattggtacctgacaagaacgccgaggcagtcctccacacgtctcctgactacgttagtttcgggtactaacgtccgggcccgttccggggtccctgactaggttcaggtcggcgtaggtaggactcgaacggcaacgtagttaactttaacaacgttaagaaactacgaaacgaggtaaggtggaaggtcgtaggaggtagttaggtttagggtttattacgtgcgtatcgacgaacgtcttactaacctaacgtacccgtacgtaaccgggttcggacgggtacggtaaccgagggtagaacgtaacgtacgaaaccggtatggtacggcgtacgaccgtaaccgtacgttaccgttcgttccttcctaccg

SEQ ID NO: 159939 - DNA, 610 bp, Homo sapiens
  misc_feature: GYAE6OF01BJKSW.19.83.H06.1.454.CMB.1.raw
  modified_base (177)..(177): a, c, t, g, unknown or other
  misc_feature (177)..(177): n is a, c, g, or t
  modified_base (182)..(182): a, c, t, g, unknown or other
  misc_feature (182)..(182): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattccnggagngccggcctccatctcctgcaagtctagtcagacgcctcctacatagtaatggacacaactattggattggtacctgcagaagccaggcagtcctaccacacgctcctgacttcttagtttgggttactaaggttcgggcccgttcccgggggtccctggacgtacggttcacggtggcaggtggatcgaggcacgtagttatttacactagaaaactcgaacgaggtaggtaggagggtctaggtaggtagttagggtttaggggtttaattacgtgtacgtatcgactaacgtcctaactaacctaacccttcccgtacgtaccgggttcgggaaccgggtacgggaaccgtaaggggtacgtaacgtaccgtaacgaaaccgtagttggtcgacgtcgaccactacgttctcgttccctcgtcccg

SEQ ID NO: 159940 - DNA, 713 bp, Homo sapiens
  misc_feature: GYAE6OF01B7DN4.19.83.H06.1.454.CMB.1.raw
  modified_base (173)..(173): a, c, t, g, unknown or other
  misc_feature (173)..(173): n is a, c, g, or t
  modified_base (180)..(180): a, c, t, g, unknown or other
  misc_feature (180)..(180): n is a, c, g, or t
  modified_base (232)..(232): a, c, t, g, unknown or other
  misc_feature (232)..(232): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtgggatattgtggtgactcagtcctccactcctccctgcccgtnattccgnggagacgccggcctccatctcctgacaagtctagtcagacgtcctaccgtanaatagtaatggaacctaactaacttattggtattcggtacctgacaacggaagccgagggcagtccaccacgacgtctacctgtacttacgttacggttttcgggtaacttaacggttcccgggcccgttcccggggtcccgtagaacgtacggttcgaggtacgggcaggtaggatcgaaggactaacgagttaactttacaactaagaaaactaccgaagtaaggaggtagggacggtataggggtaagtaggtttagggtttaggggtttaacttacgtacgtacgtaagttcggaactaacggtacctaaccgtaaccctaaaccgttccccgtaaaccgttaacccggggttaccggggtaaccgggaacgggtaaacccggtaaaggggtacggtaaacgaacgttaaacggaaacgtaacggtcgtacgggactacggacctaacggacttaccggttcttactacgttacccg

SEQ ID NO: 159941 - DNA, 664 bp, Homo sapiens
  misc_feature: GYAE6OF01DU4JI.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgcccggcctccatctcctgcaagtctagtcagacgcctacctacataagtaatggacactaacttatttggtatttcggtacctgacaagaagccgagggcacgtcctaccacacgtctcctgacttcttagtttggttactaacgtccgggtcccgtccgggtcctgacgtaggttcgaggtggacgtaggtaggactcgaggacatagtactttacacttaagaaatacgaacgagaggtagggacgtcgtagaaggtagttgggtttagggttttacttacgtacgtacgtacgtacgacgtaacgtaccgttaaccttaacctaacccgttacccgttacgtaaccggttaccggaaccggggtacggaaccgggtaagggtacgggacgtaacgtaaacccggtaaaacggtacgttacggtcggtaccgtcgaaccgtaccgttaacgttacgtttcgttccgttaccgtacccg

SEQ ID NO: 159942 - DNA, 663 bp, Homo sapiens
  misc_feature: GYAE6OF01BMWUE.19.83.H06.1.454.CMB.1.raw
  modified_base (466)..(466): a, c, t, g, unknown or other
  misc_feature (466)..(466): n is a, c, g, or t
  modified_base (474)..(474): a, c, t, g, unknown or other
  misc_feature (474)..(474): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattccgtggacgacgcccggtccctccgatccgtccctgcaaagttcctaagtcaagacgtccctacctaacctagttaagttaagtcggaaccaacgtaaaccgtttagttttcgggaattttacgggtaacccttggacctaaggaaacgccgtaggggcctaggttccctccgacaggtccttcctagtattcgttaagttttcgggttactaacgtccgggtcccgtccgggtcccgtgacgtaggttcaggtggacgtagtggactcgaggctacagtatttacacgtanaaatcaangagtaggacgtctaggtaggtacttgggttagggtttacttagtcgtactacgtcgacgaacgtctacctaacaaccgttcctacgtaacggttcggacgggacggtaaccgaagggtcggtacgagtaaccgaacggtaactcggtaggactacggacctacctacgtcgttacgttcgttactaccg

SEQ ID NO: 159943 - DNA, 688 bp, Homo sapiens
  misc_feature: GYAE6OF01AQREN.19.83.H06.1.454.CMB.1.raw
tcagtactctcgtgcacgaccggtgctcgatttagatcacgtgcgtcgcgggccgtagactttgtgtttctcgtagtctgctttgctcagcgtcagggtgctgctaatgctctgggtctctggactccagtgggatattgtggtgactcagtcctccactcctccctgacccgtcattccctgggagacgcccggccctccatcctcctgcaagtcctaggtcagacgccctcctacgatagtaatggacacgtaacttagtttggatttcgggtaccctgccaagaacgcccgagggccagttcctcccacagccttcctgtacttccgttagttttcgggttacctaacggttcccggggccccgttcccgggggtccccttaggacgtcgggtttccagggttcggcctaggtcgggactcgaggcacgtagttactttaccataagtaaactcaacgaggacgtgggacgtcgtaggtaggtagtttgggtttagggtttacttacgtgactgtacgactaacggtccttaacctaacctaacccttcccgtacgtaaccgggttccgggacgggtaacgggaaccgtaagggtacggtaacgtacgtaaccgtaaacgtacgttagggtccggtacgtacgtcccgtaaccgttacttaccgttcgttccgttacgtaccccg

SEQ ID NO: 159944 - DNA, 636 bp, Homo sapiens
  misc_feature: GYAE6OF01EVMJB.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactcctccctgcccgtcattcccggagagccggcctccatctcctgcaagtctagtcagacgcctcctacatagtaatggacacaacttattgattgtacctgacagagcaggcagtctccacacgcctctgacttcgttagtttgggttactaacgtccgggtcccgttccggggtccctaggtacgtacggttcgagtacggcgtaggtacggactacgacggccaacgtagtacttttaacacgttaagaaaactacgaaacgtaaggtacgggtaggacggtacgtaggtaagggtaggtttagggtttaggggtttacttacgtagtactagtacgactaacgtcctactaacctaacctcccgtacgtaccggtacgggacgggaacgggaaccgaaggtaggaacgtacgtaacgtaaacgtacgtaggtcggtactacgacctacgtacttcgtacgtcttcgtacgttcccg

SEQ ID NO: 159945 - DNA, 655 bp, Homo sapiens
  misc_feature: GYAE6OF01EP63I.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagacgcctcctacatagtaatggacactaactattggattggtacctgcagagccagggcagtcctccacagcctcctagattcttatttgggttactaagtccgggtccgtcccggggtcctgaccaggttcgagtggcagtgatcagcactagtatttacatagaaactcaaacaggtacggtaggacggtcgtagggaagggtagttaggggttttacggggttttaacgttacgtacgtactagtcgtaccgtaacgtactaacccttaacctaaaccccgttccccgtaacggtaacccgggttccgggaccgggggtaacgggtaacccggtaaaggggtcggtaaacggtacgtaaaccgtaaaacggtaaccgttagggtcggacccgtacgacccgtaaccgtacgttaccgttcgtttacccgttcgtaacccg

SEQ ID NO: 159946 - DNA, 567 bp, Homo sapiens
  misc_feature: GYAE6OF01ETWWN.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggtctaatcgggcctccgggtcctgacaggttcagtgcagtgatcaggcacagtatttacatagaaactcaaacagagtggaggctaggaggtagttggtttaggggtttaattacgtgactagtgacgaagtcctactaaccaaacctccctaccgtaacggtttcgggacgggaacgggacctaaggggtacggacgtaacgtacgaaaacgacgttggacgggctacggacccaaccgtaacttaccgttcggtccttccgtaaccg

SEQ ID NO: 159947 - DNA, 576 bp, Homo sapiens
  misc_feature: GYAE6OF01BRCP2.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagagcctcctacatagtaatggacactaacttatttggatttgggtacctgcagaagccagggcagtctccacagctcctgatcttagtttggttctaacgtccgggccctccggggtccctgactaggttcagtggcaggtgatcgaggcacgagttactttacactagaaaatcaacaggagtgggagtcgtaggaggtagttgggtttagggtttaacttacgtgactagtgacgtaagtctacctaactaaccctccctacgtacggttcgggacgggacggaccgtaagggtggagtaactaacgaaacggtacgtggtcggacgtcgaccgtacctagttcttcgttcgttcctaccg

SEQ ID NO: 159948 - DNA, 602 bp, Homo sapiens
  misc_feature: GYAE6OF01AUPRL.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatctcctgcaagtctagtcagagcctcctacatagtaatggacacaactatttggattggtacctgcagaagccaggcagtctccacagctcctgatctagtttgggttctaagtcgggccgtcccggggtccctgacaggttcagtggcagtgatcaggcacagtatttacactgaaatcaacagagtggaggtactagaggtagttacggttaggggtttaacttacgtagactagtcgacgaacgcttacgtaacctaaaccttcccgtacgttaaccggtttacgggtacggggaacgggtaacccggtaaagggtacggtaaacgacttaacggaaaaaccgtacgtacggtcggtaccgtagaccgtaaccctagttacccgttcggttcgttaccgtacccg

SEQ ID NO: 159949 - DNA, 1056 bp, Homo sapiens
  misc_feature: GYAE6OF01A5NNN.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctcgtggtctcgtggatccgaggtggggattagttggtggtgactcagtcctccacttcctccctcgtccccgtctacgttcccgtaggacggtaccggccccggtcccttaccctacttcccttcccgtacggtaccgtaaacggtttaccttaacggttaccgaaacggaccgtcccccttacccttaaacgtaacgtttaaaggttaaacgtacgggtaaaccctaaaccgttaaaccgttttaggttttacggtaacggtttttaccgggttaaccccttgggaaccgtaaacgggtaaccgggtaccccgggaaaccggggtccgttaacccggtttaccccctaaccccgaaccgtacccgggttccctttacccggttaggtaaccgttttaaccgttttaacgggttttttacggggttaacccgttaaccggggtttccccgggggttacccccgggtttccccggggtttaccccgtaacggttaaccggtacggggtttaccaggggttcgggtacgtaacggggttacggaaccgttaccggaacggtaaccgttaaacgttaacgttttaaaccgttttaaacgaaaccgtttaaaaggtaaaaacctttaccggaaaaccggttaggtaacgggttacggggaacgttacgtaggggtaacggtttagggttttaggggtttacggtttaacgtttaccgacgttaacgtaggtaccgaccgttaacgtacccgttaaacccttaaccgtaacccccgttacccgggttaccgttaaaccggggtccgggtaacggggtaaaccggaccgggttaaaggggtacgtaaacggaaacccgttaaaccggtaaaccggttaggttaccggtaacggtcccgtacgaacccgttaaaccgttggtttacccttacggtttccctaaacccggttccg

SEQ ID NO: 159950 - DNA, 651 bp, Homo sapiens
  misc_feature: GYAE6OF01B28FS.19.83.H06.1.454.CMB.1.raw
  modified_base (219)..(219): a, c, t, g, unknown or other
  misc_feature (219)..(219): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattcctggagagcccggccctccatctcctgcaagtctagtcagacncctcctacatagtaatggacacaactattggattcggtacctgcaagaacgccagggcagtcctccacacgctcctgtatcttagtttgggttactaacgtccgggtcccgttcccggggtccctggaccgtaggttcgagtggcaggtggatcgaggacacgtagtattttacactagaaacttacgaacgaggagtaggagtcgtaggaggtagttggtttaggggtttaattcgtgtacgtagttcgactaacgtccttaaccttaaaccctaaccgttccccgtaacgtaaccgggtttccggggaacgggtaacgggaaccggtaacgggtacggaacggtaaacgtaacgtaaaaccggtaacggttgggtacggtcccgtacgacccgtaacctacgttagtttaccgttccgtttactaccccg

SEQ ID NO: 159951 - DNA, 616 bp, Homo sapiens
  misc_feature: GYAE6OF01EX985.19.83.H06.1.454.CMB.1.raw
  modified_base (172)..(172): a, c, t, g, unknown or other
  misc_feature (172)..(172): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtnattccgtggagacgccggaccctccatcctcctgactaagtctagtcaagacgtccctacctaacatagtaatcggaacaactaacttagtttggtagttcggtaccctagacgaagaacgccgagggctacgtcctaccacacgcctcctgacttacttagtttcggtactaacgtccgggccgttcccggggtcctgtacgtaggttcaggtgacaggtgatacgagacaacgtagttactttacgaacgtaacgaaaactcgaacgtaggaggtacggaggtacgtaggtaggtagtttgggttagggtttactacgtgactagtgacgacgtactacctaactaacctcctacgtacggtacgggacgtacgggactagggtacgaagtacgaacgtaaacgtagtcggcgtacgagaccactagtactcgtcctgtacc

SEQ ID NO: 159952 - DNA, 753 bp, Homo sapiens
  misc_feature: GYAE6OF01CFTOB.19.83.H06.1.454.CMB.1.raw
  modified_base (246)..(246): a, c, t, g, unknown or other
  misc_feature (246)..(246): n is a, c, g, or t
  modified_base (330)..(330): a, c, t, g, unknown or other
  misc_feature (330)..(330): n is a, c, g, or t
  modified_base (536)..(536): a, c, t, g, unknown or other
  misc_feature (536)..(536): n is a, c, g, or t
tcagtactctcgtgcacgaccggtgctcgatttagatcacgtgcgtcggcgggcgtagactttgtcgtttctcgtagtctgctttgctcgagcgtcgagggtcgctgctaatcgcgtctggtctctggatccgagggtcgggtatagttgtggtgacttcagtcctccacctctcccgtcgcccgtctacttcctcggacgcgcccggtcctacctattcctccgtagacaagtactagtacagcnccttacgtacataagtacgtggactaacaatttagttgtagttcggtacctgacaagaacgacgacgggactcgtacctaccanacgtcctcgtagtacttgttaacgtttcggttactaacggttccgggtccggttcccggtaccgtaggtacgtaccggttcgtagggtcgtacgtgggtagacgttacggagaccgtacgtacgtttaacttaacgtacgtaataactcgaacggtgaagggttcgacgggattacgggtaaggttcgtttgggtttacggttacncgttaggatacgttcaagtaccgtataacccgtacttaaacgtcccgttaaggacggtttacccgggaacgggtacgggtaaccccgggttagggtaaaccgtacgggaaaacctttaacgggaaaccggttggggtttaaaccgcggttaaacccggtaactacccgtaaccggtttggtaacttttccccgggaacctttaaccgttacccccgg

SEQ ID NO: 159953 - DNA, 641 bp, Homo sapiens
  misc_feature: GYAE6OF01DQEA9.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagacgcctcctacatagtaatggacacaacttatttggattggtacctgacagaagcgaggcagtctccacacgctcctgatctagttttgggttctaagtccgggccgtccgggtcctgacgaggttcaggtgcgagtggatcgaggacacgagtactttaacacttaagaaactacaaacacggtaaggtagggaacggcgtaggaagggttagtttgggttttacggggttttaattacgtcgtctaagttgtaaccgtaagtaccttaaccttaaccctaaaccgttaccccgttaccgtaaccgggtttacccgggacggggtacgggaaccgtaagggtaggagtaacgtaaccgtaaaacggtacttacgggtcggacccgtaggacctaacctagttaccttcggttccttcgttaccccg

SEQ ID NO: 159954 - DNA, 612 bp, Homo sapiens
  misc_feature: GYAE6OF01A30T5.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattcctggagacggccggcctccatctcctgcaagtctagtcagagcctcctacatagtaatgacacaactattggattggtacctgacagaagccgagggcagtcctccacagctcctgattcttagttttgggttactaacgtccgggtcccgtcccggggtccctaggaccgtaggttccaggtcggacaggtgatcgaggacacgagtattttaacactaagaaactcgaacgagaggtggagtcgtaggaggtagttgggtttaggggtttattaccgtgctagtcgacgaacgtccttacaacctaaccttaccctacgtaaccggttcgggacggaacggaccgaaagggtcggaacgtaacgtaaaccgtaacggtaacgttggtacggtaccgtacgacctaacgtactaccgttcgttacgttcttaccg

SEQ ID NO: 159955 - DNA, 677 bp, Homo sapiens
  misc_feature: GYAE6OF01C0D4X.19.83.H06.1.454.CMB.1.raw
  modified_base (223)..(223): a, c, t, g, unknown or other
  misc_feature (223)..(223): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtcctccactctccctgcccgtcattcctggagacgcccggccctccactcctcctgcaagtctagtcagacnccctacctacatagtataggacacaacttagttggattcggtacctgcgaagaacgccgagggctagtcctaccacgacgtcctccgtgtacttcgtttagttttgggttacctaacggtcccggggtacccgtcccggggtacccctggtaccgtacggttcgtacggtcggtacgtagggtacgacgtaccggaaggtaccaacgttaaggttaacttttaaccgaacgtaagtaaaactaccgtaaacgaggtaagggtacgggaggtacgtaggtaggttagttgggtttagggtttatacgtgactagtacactaacgtccttaacctaacctaaccctccgtacgtaccggttcgggacggtacggacgtaggtacgacgtagtaccgaaacggtacgtacggtacggcctacgcctaacgtacttcgttactcccgttaccgtcccg

SEQ ID NO: 159956 - DNA, 806 bp, Homo sapiens
  misc_feature: GYAE6OF01D0SG6.19.83.H06.1.454.CMB.1.raw
  modified_base (175)..(175): a, c, t, g, unknown or other
  misc_feature (175)..(175): n is a, c, g, or t
  modified_base (234)..(234): a, c, t, g, unknown or other
  misc_feature (234)..(234): n is a, c, g, or t
  modified_base (301)..(301): a, c, t, g, unknown or other
  misc_feature (301)..(301): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggattagttgtggtgactcagtcctccactctccctgcccgtnattccgtggagacgcccggcctccatctcctgacaagtctagtcagacgtcctactaanataagtaatggaacactaacttagttggattggtacctgacaagaacgccgagggcagtcctaccanacgtcctcctagtacttaccgttagttttcgggttaccttaacggtccggggccccgttcccggggtacctaggaaccgtagggtttcagggttcggacgtaggtacggactaccggaggacctaaacgtaagtttaacttttaaccgaacgttaaaggaaaaacttccgaaaacggtaaggtaggggtacgggtaacggtacggttaagggtaaacgggttaggtttaacggggttttacggggttttaaacttaccggtagtaaccgttaagtacggaacgtaaaccgtccgttaaacctaaacccgtaaaccccgttcccgttaaaccgggtaaaccggggtttacccgggggaacgggggtaaaccgggtaaacccggtaaaggggtaacggtaaacggtaaaccgtaaaccggaaaacggttaaccgttagggtacggtaccgtacgaacccgtaaacgttaacgtttccggttaccgttaccgttaccgttaaccccgg

SEQ ID NO: 159957 - DNA, 619 bp, Homo sapiens
  misc_feature: GYAE6OF01BMMAQ.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctgggagacgcccggcctccatctcctgcaagtctagtcagacgcctcctacatagtaatggacacaactatttggattggtacctgcagaacgccgagggcagtcctccacagcctccgtgtattcttagttttgggttactaacgttccggggtcccgttcccggggtcccctaggacgtaggttcaggtcggctaggtggactcgacggcacgagttactttaacacgtagaaactaccgaacgaggaggtagggacggtcgttaggaagggttagttgggtttaggggtttattacgtgtacgtatgactaagtcctactaacctaaaccgtccctacgtacggttcgggacgggtacgggaacgtagggtaggacgtaacgtacgaaacgtacgtggcgtactcggacctaccgtacttactcgttccttcgtacccg

SEQ ID NO: 159958 - DNA, 791 bp, Homo sapiens
  misc_feature: GYAE6OF01BB499.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctggtctctggatccgaggtggggatagttggtggtcgactcagtcctcccacctcctcccctcgccccgtctacttccgtgggacgacggcccggcccttcccacttcctcccgtagactaagtcttagtccagtacgccccttacctaactaagttaaggttaacgtacggaacctaacctaaacgtttaggtttagggtaagtttcgggttaaccctggaccgaacggaaccggccgaggggacctacgtaccctaccgacgacgtcctccgtagtacttcgttagtttcgggtactacgggtcccgggtcccgttcccgggtacctagtaccgtacggttcgaggtcggacgtaggtagacgtacgacggactaacgtaaggtttaactttaacaacgtaaacgtaaactaccgaaacggtagggtaacggtagggaacggttacgtagggtaagggtttagtttaggggttttacgggttttagtaccgtagaccgttagtacggtaacctaacgtcctaacccttaaacccgtaccctacccggttaacggtaaccgggtacgggaccgggtaaccgggaacggtaaggtacggaaacgtaaccgtaaacggtaaaccggtacgtggttaccggcgtaccgaccgtaacctgttaccgtcgttacctcgtacccg

SEQ ID NO: 159959 - DNA, 606 bp, Homo sapiens
  misc_feature: GYAE6OF01ACVV9.19.83.H06.1.454.CMB.1.raw
  modified_base (273)..(273): a, c, t, g, unknown or other
  misc_feature (273)..(273): n is a, c, g, or t
  modified_base (290)..(290): a, c, t, g, unknown or other
  misc_feature (290)..(290): n is a, c, g, or t
tcagtactctcgtgcacgaccggtgctcgatttagatcacgtgcgtcggtcgggcgtagactttgtgtttctcgtagtctgctttgctcagcgtcaggtgctgctaatgctctggtctctggatccgagtggggatattcgtggttgacgtcagtctccactctccctgccccgtcacttccgtggagagccggcctccatctcctgccaagtctagtcagacgcctcgtacatagtagtcggacacactagttggattggtacctgcagacnccgagggcagtctcacngctcctgatctagtttcgggtctaagtccgggccgtccgggtcctgacgtggttcagtgcagtcgatcgaggcacgtaggtactttacgaacgtagaaaacgtccgaaagtaggtaggtagggacgggtcgtagggtaacggtagtttcgggtttaggggttttaacttacgtgacctagtcgacgaacgtacgtaccttaacctaacccgttcccgtacggtaaccgggttcgggtacgggacgggtaccgaggtgaaacgtagtaaccgaacgtacgtggtcggcgtcgccgtacacgttactcgttctctacg

SEQ ID NO: 159960 - DNA, 849 bp, Homo sapiens
  misc_feature: GYAE6OF01EKYTB.19.83.H06.1.454.CMB.1.raw
  modified_base (263)..(263): a, c, t, g, unknown or other
  misc_feature (263)..(263): n is a, c, g, or t
  modified_base (349)..(349): a, c, t, g, unknown or other
  misc_feature (349)..(349): n is a, c, g, or t
tcagtactctcgtgcacgaccggtgctcgatttagatcacgtgcgtcgcgggcgtagactttgtgtttctcgtagtctgctttgctcagcgtcaggtgctgctaatgctctgggtctctggatccagtgggatattgtggtgactcagtctccactctccctgcccgtcattcctggagacgccggcctccatctcctgcaagtctagtcagacgccttccactatagtaatggacactaactattggtatggtacctgacanaagccagggcacgtctccgacaagccgtctgtacttcgtacgtttacggtttacgtaacgtaccgggttcccggttcccccggggnttacccggtacgtacggtacggttacggtacggtacggtacggtacggtacggtacgtacgtacggtaccgtaacgttaaacgttaacgtttaaaccgttaaacgtaaacgtaaaacgtaaaccgtaaacggtaacgggtaacgggtacggggtacgggtaacggttaacgggtaaacgggtttaaacggggttttaggggttttaacggggttttaacggtttaaccggttaccgtaacggtaacgttaaccggtaaccgtaaccgttaacccgttaaacccgttaaaccccgttaaaccccgttaaccccggttaacccgggttaaacccggggttaacccggggtaacccggggtaaaccgggtaacgggtaaacgggtaaacgggtaaaccggtaaacgtaaccggtaaaacggttaaccggttacgggtaccggtaccggtacccgtacccgtaacccgttacccgtttaccgtttacccgttacccgttacccg

SEQ ID NO: 159961 - DNA, 740 bp, Homo sapiens
  misc_feature: GYAE6OF01DJ7EX.19.83.H06.1.454.CMB.1.raw
  modified_base (179)..(179): a, c, t, g, unknown or other
  misc_feature (179)..(179): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatagttgtggtgactcagtctccactctccctgcccgtcattccnggagagcccggcctccatctcctgacaagtctagtcagacgcctacctacagttaagtaatcggacaactaacttagtttaggattggtacctgacaaggaacgccgagggactacgtcctaccacacgtcctccgtagtacttcgttaagttttcggttactaacggtccgggtcccgttacccggggtcctaggaacgtacggttaccgaagggtcggacgtaggttacggaactcggaacgggcctaaacgtaaggtttaacctttttaaaccgaaccgtaagtaaaaacgtaccgtaaacgtaagggtaagggtacgggaggtaccgttagggaagggttaggtttagggttttaggggtttaacttacgtgtacgtagtacgtacaacgtaccgttaacctaaaccgtaacccttccccgtaacgtaaccgggttcgggaccgggaacggtaaccggtaagggttacgggactaacgtaaccggaaaacgtagttacgggtacggtcgtaccgaacccgtaacctacgttaccttacgttccgtcccgttaacccg

SEQ ID NO: 159962 - DNA, 803 bp, Homo sapiens
  misc_feature: GYAE6OF01A62EX.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccgaggtggggattagttggtggtgactcacgtcctcctactcctccctgccccgtctacttccgtggacgacgcccggtccctcctacttcctccgtgactaacgttctacggtacaaggacctcccttacctaacgtattaagtaagtcggaacctaactaacgttagtttggtacgtttcggtaacctgacaaggaacgtccggaagggcctacgtcctacccgacaccgtcctaccgtagttaacttcgtttaaggttttccgggttactaaccggtcccgggtacccgttcccggggtaccttaggacgttacgggttactaggtcggacgtaggtcggtactcggaacggtctaacgtagtttaaaccgtttacgaacgttaaacggtaaacttaccgaaacggtagggtaacgggttacgggtaacgggttacggttaacggggtaaggtttacgggttttacggggttttaacggggttttaacttaccggttacgtacgtagtaccgtaacgtaaccgtacttaacccgtaacgtacccgtaccgtacggttacggtccgggacgggtacggtaaccgtagggtacgtaagtaaccgtaacggaacggttacgtcggtacgtccggaaccacccgtacgtacttaccggttcgttaccgttccgtacccg

SEQ ID NO: 159963 - DNA, 710 bp, Homo sapiens
  misc_feature: GYAE6OF01D3S74.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactcctccctgcccgtcattcctggagacgcccggcctccatcctcctggcaagtctagtcagacgcctacctaacataagtaatggacaacaacgttattggtagttaggtaccctgaccaggacgccgagggcagtcctaccactacggcctcctagtacttaccttagtttcgggttactaacggtcccgggtacccggttccccggggtccctacggaccgtacgggttacgacggttcgggacgtacggtagacgtaccgaggacctacgtaagttacttttaacgaacgtaaacgaaataccgtaacgaggtaggtagggaacggtcggtaggagggttaggttaggtttagggggtttaacttacgtagtacgtacgtacgacgtaaacgtcttaacccgtaactaaacccgttcccttacggtaaccggtttcggggaacggacgggtaaccggaaggtacggaacggtaacgtaaccgaaacggtaagtcggtcggtacgtccgtaaccgtaccgtacgtcgtttacgtcccgttcgttaaccccg

SEQ ID NO: 159964 - DNA, 676 bp, Homo sapiens
  misc_feature: GYAE6OF01CXUFI.19.83.H06.1.454.CMB.1.raw
  modified_base (224)..(224): a, c, t, g, unknown or other
  misc_feature (224)..(224): n is a, c, g, or t
  modified_base (232)..(232): a, c, t, g, unknown or other
  misc_feature (232)..(232): n is a, c, g, or t
  modified_base (292)..(292): a, c, t, g, unknown or other
  misc_feature (292)..(292): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtcctccactctccctcgcccgtcattccgtggagacgcccggcctccatcctcctgacaagtctagtcagacncctactanatagagtagacacaattagttgattcggtactgacgaagacgccgaggcagtcctccganacgtctctgtattcttaggtttcggtactacggtccgggacccgttcccgggtcctagtacgtacggtcgtaggtggacgtaggtcgacgtacgacggtactaacgtagttaactttacaaacgtaacgtaaactacgaaacgtggtaaggtcggtaggtacgttagggtaacgttaggttttggggttttaacgggtttaacttacgtgtaccgtagtaacgtaccgtaacgttacttaaacccgtaaccctaaccgtttacccggtaccgtaccggggtacgggaacggggtacggaaccggtaagggtacgaacgtacgtaaaccgtaacgtaggtggtaccgacgtcccaacgtccttatcttacgttccgtccgtaccc

SEQ ID NO: 159965 - DNA, 539 bp, Homo sapiens
  misc_feature: GYAE6OF01D3QXN.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatctcctgcaagtctagtcagagcctcctacatagtaatggacacaactatttggattggtacctgcagaagccagggcagtctccacagctcctgatctatttgggttctaagtccgggcctccggggtccctgacaggttcaggtggcagtggatcgaggcacagtattttacactagaaatcaacaggagtggaggctggaaggtagttggtttggggtttattacgtgctagtgacaagctactaactaaacctcccttacgaaccggttcggacgggacgggaccgaagggtggagatacgaaacgtatggtggctcgaccactatactcgttctctaccg

SEQ ID NO: 159966 - DNA, 621 bp, Homo sapiens
  misc_feature: GYAE6OF01D50K6.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttgggttctaagtcggccgtccgggtccctgacaggttcagtggcaggtggatcgaggcacgagtatttaacgactaagaaatcgaacagaggtggaggtcgtaggaggtagttaggtttagggtttattacgtgacagtcgacaagcgtaactaacctaacccgttaccccgtacgtaaccggttcggggaccggggtaacggaacccggtaagggtagggtaacgtacgttaaaccgaaaaccgggttaacgtcgggttacgggaccgtacggaccccgtaacccgtaacgttacccggtttacgttccccgttccgttaaccccg

SEQ ID NO: 159967 - DNA, 714 bp, Homo sapiens
  misc_feature: GYAE6OF01A6IEN.19.83.H06.1.454.CMB.1.raw
  modified_base (180)..(180): a, c, t, g, unknown or other
  misc_feature (180)..(180): n is a, c, g, or t
  modified_base (225)..(225): a, c, t, g, unknown or other
  misc_feature (225)..(225): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtgggattattggtggtgactcagtctcccactcctccctgccctcattccnggagcgcccggcctccatcctcctgacaagttctaggtcagtacnccctacctaacagttagtaagtcggaacaacgtaacttagtttaggtacgttaggtaccctgacgaagaacgccgaagggctacgtcctacccacgtacgtcctccgtagtacgttctttaagtttcggttacttaacggtccgggtcccggttaccccgggtcctagaccgttacggttctagggtgtaccgtaggtacgactacgacggcctaagtacgtttacttaaccaagtaacgtaaataccgaacgaggtaggtacgggaggtcgtaaggtagggtaggttttagggtttagggtttacttagtacgtacgtagtacgtaacgtaccgttacgtaccctaaaccgtacccgttaccgtaaccgttaaccgggtccgggtaacgggaaccggtaaccggtaagggtacgaaacgtaccgtaaaccgtaagtacccggtgtaaccgcttacgaccgtacctagttacctcgtccttgtaccccg

SEQ ID NO: 159968 - DNA, 844 bp, Homo sapiens
  misc_feature: GYAE6OF01CS2HO.19.83.H06.1.454.CMB.1.raw
  modified_base (147)..(147): a, c, t, g, unknown or other
  misc_feature (147)..(147): n is a, c, g, or t
  modified_base (176)..(176): a, c, t, g, unknown or other
  misc_feature (176)..(176): n is a, c, g, or t
  modified_base (184)..(184): a, c, t, g, unknown or other
  misc_feature (184)..(184): n is a, c, g, or t
  modified_base (205)..(205): a, c, t, g, unknown or other
  misc_feature (205)..(205): n is a, c, g, or t
  modified_base (252)..(252): a, c, t, g, unknown or other
  misc_feature (252)..(252): n is a, c, g, or t
tcagtactctcgtgcacgaccggtgctcgatttagatcacgtgcgtcgcgggcgtagactttgtgtttctcgtagtctgctttgctcagcgtcagggtgctgactaatgctcgtgggtctctggatccgaggtgggatattgtggtnactcagtcctccactcctcctcgcccgtntattccgnggagacgcccggccctacctntcctccgtgacctaagtccgttaggtcaggtacctccctaccgtaanaagttaagtaaacgcggaacctaactaaacgtttagtttaggtaatttcggtaacccagacgaaggaaccgccggacgggacacgtcctaacccacgacgtccttacctagtacttacgtttacggtttgggttacctaacggtccccgggtacccgttcccggggtacctacggacgttacgggttacgaggtacggtacgtaggtacggaactaccggacggtaactaaaacgttaacgtttaaacggtttaaaccaaacgtaaaacgttaaaacgtaccgaaacggtaacggtaacggggtagggtaacgggtacgtagggtaacgggtttaagtttaacggggttttaaggtttaaccgtaggtagtaccgtaagtacgtaacgtacgtaacctttaacctaaacccgtaaccccggttaacccgtaaccgggttaaccggggacccggtaacggggaaccgggtaaccggtaaaggttaccgggaaacgtaaaccggtaaacggtaaaaccggtaccgggttagtccggtaccgtaaccgtacccgtacttaccggttaccttaccggtttcttaaccgttaccccg

SEQ ID NO: 159969 - DNA, 723 bp, Homo sapiens
  misc_feature: GYAE6OF01CMLU4.19.83.H06.1.454.CMB.1.raw
  modified_base (311)..(311): a, c, t, g, unknown or other
  misc_feature (311)..(311): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtcctccactctccctgcccgtcattccgtggagacgcccggtccctccatcctcctgctaagtctagtcacgacgtccctacctactaataagtaatggaccaactaacttagtttggaattcggtacctgacaagaacgccgagggcacgtcctccacncgctccgtagtattcgtttagtttcggtactaacggtcccgggtcccgttcccggggtcctagtacgtacggttcgaggtcggtcaggtcgactcgacggtactacgtaagttactttaccgacgttaagaaactacgaaacgtagggtaaggtcgggtaacggtacgttagggtaagggttaggtttagggttttagggtttaacctacgtgaccgtagtcgaacctaacgtaccttaacccgttaaccgtaacccgttacccgtaacgggtaaccgggttaccgggacgggtaacgggaaccgtaaggggtacgggaaaccgtacgtaaaccggtaaaccgtaggttacgggtcgtaacccgtagtaccccgaacttaacgttccgttaccgttcttaccccggttaccc

SEQ ID NO: 159970 - DNA, 637 bp, Homo sapiens
  misc_feature: GYAE6OF01E3E95.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattccgtggagacgccggcctccatcctcctgctaagtctagtcagacgcctcctacatagtaatggaacaactaacttattggattggtacctgacagaacgccgagggcagtcctccacacgctcctagattcgttagtttcgggttactaacgtccgggtcccgtcccggggttcccctaggtaccgtaggttcgaggttcggacgtaggtaggactcggaaggacctaacgtaagttaacttttaacaacgttaagaaaacttacaaacggtaggaagggtagggaggtacgtaggaagggtagtttagggtttaggggtttaatacgtagactagtgactaagtctacctaacaaccttccgtacgaccggttcgggacggtaacggaccgaagggtacgaacgtaataacggaaacgtacgtggtcgactacgacctactacttatcgttctcttacccg

SEQ ID NO: 159971 - DNA, 604 bp, Homo sapiens
  misc_feature: GYAE6OF01EW6N6.19.83.H06.1.454.CMB.1.raw
  modified_base (255)..(255): a, c, t, g, unknown or other
  misc_feature (255)..(255): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccgcctccatctcctgcaagtctagtcagacgcctcctacatagtaatggacacaactattgattggtaccngacagaagaccgagggcagtctccacacgctcctgattctagtttggtctagtccggccgtccgggtccctgactaggttcgaggtggcgaggtggactacgaggacacagtaactttacataagaaactacgaacgaggagtaggagtcgtaggtaacggtattagggtttaggggtttattacgtagactagtcgacgaacgtcctaacctaacaaacccgttccgtacggtaaccggttcgggaaccgggacgggtaaccgtaagggtaggtaacgaaacgtaacgaaacgtacgtggtcggacttagaccctaacctagttaccgttacgttccttacgtacccg

SEQ ID NO: 159972 - DNA, 630 bp, Homo sapiens
  misc_feature: GYAE6OF01BQ3JG.19.83.H06.1.454.CMB.1.raw
  modified_base (172)..(172): a, c, t, g, unknown or other
  misc_feature (172)..(172): n is a, c, g, or t
  modified_base (221)..(221): a, c, t, g, unknown or other
  misc_feature (221)..(221): n is a, c, g, or t
tcagtactctcgtgcacgaccggtgctcgatttagatcacgtgcgtcgcgggcgtacactttgtgtttctcgtagtctgctttgctcagcgtcagggtgctgctaatgctctgggtctctggatccagtggggatattgtggtgactcagtctccactcctccctgcccgtnacttcctggagacgcccggcctccatcctcctgcaagtctagtcagacncctcctacatagtaatggacacaactattggattcggtacctgacagaacgccagggcagtcctccacacgtcttcctagtacttcgttagtttcgggttaccttaagtccgggtcccgtcccggggtccctggacctaggttcagtcggactaggtggactcgaggctaacagttatttaacgacttaagaaactacgaacaggtaaggtaggaggtacgtagggtaggtagtttagggtttagggtttaacttacgtgtacagtcgactaagtccttactaacctaaccgttcccgtacgttaacggtaccgggacgggtaaccggaccgaaggtacggacgtaacgtaccgaaaacggtaccgtaggtacgtccgtacgacctactacttatcgttcttactaccg

SEQ ID NO: 159973 - DNA, 883 bp, Homo sapiens
  misc_feature: GYAE6OF01CJRRC.19.83.H06.1.454.CMB.1.raw
tcagtactctcgtgcacgaccggtgctcgatttagatcacgtgcgtcgcgggcgtagactttgtgtttctcgtagtctgctttgctcagcgtcgagggtgctgctaatgctcgtgggtctctggatccgaggtgggattagttggtggtgactcagtcctccactcctccctcgcccgtctacttccgaggacgaccgcccggcccttaccacttcctccgtaggacctaaacgttctaacggtcaaacgtccgtcccttacccgtaaataagttaaggtaaacgtacggaaacctaaccgtaaacgttttagtttcgggtaacgtttccgggtaacctaggacgaaacggaaaccggtcccggaaggggtacctacggttacccctaacccgaacgttcgtccctttacccgtaggttaactttacgtttacggtttttacgggtaccttaaccgggtcccggggtccccgttcccggggtacctaggtacggttacggtttacgagggtcggtacgtacggttgaaccgttacggaacggaccttaaacgtaacggttttaaacttttaaccggaaacgtttaaacggaaaacctaaccggtaaacggtaagggtaagggtacgggtaaccgggtaggttaggtaacgggttaggtttagggtttacgggtttaacgttacgacgtacgtacgtacgaccgtaacgtacccttaacctaaaccgtacccgtaccggtaacggtaacccggtcggggaaccggtacggaaacggtacgggaggtaaccgtaaacgtaacccggtaaacgtacgtacgggtaccgttacgaccggtaacctaaccggtactttacccgtcgttacccgttacccgttaccccg

SEQ ID NO: 159974 - DNA, 646 bp, Homo sapiens
  misc_feature: GYAE6OF01C1G9Q.19.83.H06.1.454.CMB.1.raw
  modified_base (189)..(189): a, c, t, g, unknown or other
  misc_feature (189)..(189): n is a, c, g, or t
  modified_base (309)..(309): a, c, t, g, unknown or other
  misc_feature (309)..(309): n is a, c, g, or t
  modified_base (417)..(417): a, c, t, g, unknown or other
  misc_feature (417)..(417): n is a, c, g, or t
  modified_base (585)..(585): a, c, t, g, unknown or other
  misc_feature (585)..(585): n is a, c, g, or t
tcagtactctcgtgcacgaccggtgctcgatttagatcacgtgcgtcgtcgggcgtagactttgtgtttctcgtagtctgctttgctcagcgtcagggtgctgctaatgctctgggtctctggatccaggtggggatatttggtggtgacttcagtcctccacttcctccctgccccgtatatttccgnggagacgcccggtcccttccatcctcctggacctaagtcttagtcagacgccctacctacattagtaatggaccagtaacttagttggtagttcggtacctgcaaagacgaccgaggacngtcctacacgtcggcctacctgactacgtttaggttttcggttactaacgtccgggtcccgtcccggggtccctacgacgtaacggttcgaggtcggacgagtggtancgagacactagtactttacactaataatacaacgagaggtaggaggtacgtaggacggttagttacgggtttagggtttaattacgtcgacgtatacgctaagtcctaacctaacctaaccgttcccgtaaggtaccgttcgggaacggtaggaccgtagggtacganaacgtaccgtaaaacgtgtaggtcgacgtacgactaacctattacgtcttcttcgtacccg

SEQ ID NO: 159975 - DNA, 645 bp, Homo sapiens
  misc_feature: GYAE6OF01EIP1T.19.83.H06.1.454.CMB.1.raw
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (639)..(639): a, c, t, g, unknown or other
  misc_feature (639)..(639): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattccgtggagacgcccggccttccatctcctgacaagtctagtcagcnccctctacatagtaangacacacttattggattcggtacctgcaagacgccgagggcacgtctccacacgtcctctagtactttcttagtttcggtacttacggtccgggtcccgtccggggttcctaggtacgtaggttcgaggtcggactaggtgacgtacgacggtacacgtagttaactttaccgacgtaacgaaacttaccaacgtagggtaaggtcgggaagtcgtagggtaacggttggtttagggttttaggggtttacttacgagtactagtcgaacgtaacgtcttaaccaaccttaacctacccgtaacgtaaccgggttcggacgggtaacgggaccgtaaggtaggacgaagtaaccggaaacgtagcgggtaccagtacgaccaattcgtacttcgttaccctntacccg

SEQ ID NO: 159976 - DNA, 764 bp, Homo sapiens
  misc_feature: GYAE6OF01DVUOB.19.83.H06.1.454.CMB.1.raw
  modified_base (171)..(171): a, c, t, g, unknown or other
  misc_feature (171)..(171): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctggtctctgatccaggtgggatagttgtggtgactcagtctccactctccctgccccgtnattcctggagacgcccggtcctccatcctccgtgactaagtctaggtccagtacgcccttacctaacgtataagtaatacggaacctacaaactttgtttaggagtttcggtaacctgaccaaggacgcgagggcacgtcccgtaccactacgccttacgtagtactttacgttaggttttcgggtacttaacggtcccggggtcccgttacccgggtcctaggtaccgtaaggttccaggtcggacgtaggtgatcgacgtactagtacgttaactttaacgaactaagtaaaacctacaaacgtaggtacgggtggtaaacggcgtttagggaacggttagttttcggggttttaaggggttttacttacggtgtaaccgtagtaccggattaacggaccttaacgtaacccgttaaacccttacccggttaacggtaaccgggttacggggaacgggtaccgggtaaaccgttaaaggggtggtaaaaccgtaaccgtaaaccgggtaaacgttacggggtcggttacggacccttacggaaccttaccctaacggttcttacccgggtttacttcccggttaaccccgg

SEQ ID NO: 159977 - DNA, 643 bp, Homo sapiens
  misc_feature: GYAE6OF01EITDG.19.83.H06.1.454.CMB.1.raw
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (377)..(377): a, c, t, g, unknown or other
  misc_feature (377)..(377): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctggtctctggatccgagtggggattattgtggtgactcagtcctccactctccctgcccgtctattccgtggagcgcccggtccctcctattcctcctgctaagtctagtcagcnccctcctanataagtangacactacttagttggattcggtacctgcgaagaacgccgaggacacgtcctaccgacacggtcctacctgtacttcgtttagtttcggtactacggtccgggtcccgttccggggtccctgacgtaggttcgngtcgctaggtagngtacgngacacgtagtttacttaacagtaacaactaacaacgtaggtaggtaggacgtctagggagttagtttgggtttaggtttactagtcgagttagtcgaacgtagtaccctacgtaaccctaaccgtcccgtaacggtccgggttacggaccgggtacggaaccggtaaggaggtaaacgagttaaccgaacgttaggtcggtaccgctaccgaccgtactacgttccgttccttgtcccgttaacccg

SEQ ID NO: 159978 - DNA, 972 bp, Homo sapiens
  misc_feature: GYAE6OF01D7KKG.19.83.H06.1.454.CMB.1.raw
  modified_base (916)..(916): a, c, t, g, unknown or other
  misc_feature (916)..(916): n is a, c, g, or t
tcagtactctcgtgcacgaccggtgctcgatttagatcacgtgcgtcgcgggcgtagactttgtgtttctcgtagtctgctttgctcagagtcagggtgctgctaatgctctgggtctctggatccgagtggggattattggtggtgactcagtcctccactcctccctcgtcccgtctacttcccgtagggacggacggccccggtcccttccctacttcccttcccgtacgtaccgtaacggttccttaacggtccgaacggtaccgtaccccttacccttaacctaagttaaacggttaacgttacgggaaaaccctaaaccgttaaaccgttttaaggttttacgggttaacgttttaccggggttaacccttgggaaccgaaacgggtaaaccggtacccggaacggggtacctaaccggttaccccttacccgaaccgtaccggtcccttaccgttacggttacgtttaccggttttaacggtttttccggggttaacctttaaccggggtccccgggggttcccccgggtttacccccgggggttccccgttaacgggtaaccggttaccggggtttaccgtaacggggttcggggtacgttaacgggtcgggttaacgtaccggaaccgggtacctaaacggttaacgttttaaccttttaaccgaaacggtttaaacgaaaaccttaccggaaacgtaggggtaacgggttacgggacggttacggttagggtaacggtttagggttttaggggtttttaacggggttaacttcgtaggtaaccttaggtacgtaaccgtaacgtacccttaacccgtaaacctaccccgttacccgtacgtaaacccggggttcgggaacggacgggtaaccggaggttacgggactaacgtaaaccgtaaacggnggttaggcgtaccgtacgaccttacggtattccggtacgtttcctaccggttaccc

SEQ ID NO: 159979 - DNA, 679 bp, Homo sapiens
  misc_feature: GYAE6OF01C0EU5.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatcctcctgcaagtctagtcagacgccctcctaacataagtaagtggacaacaacttagtttggattggtacctgacaagaacgccgagggcagtccctaccacacgtcctccgtgtacttccttagttttcgggttactaacggtcccgggtcccgtcccggggtccctgacgtaggttcgaggtgacgtagtggatacgaggtacacgtagttaacttttaacaactaagaaactacgaacgaggaggtgggacggtcgtagggtaaggttagtttagggttttaggggttttaaacttcgtagactaggtacgactaaggtaccttaaccttaaacctaaccccttacccgtaaccgttaccggggttaccgggaacgggaacgggaacccgtaagggtacggaacgtacgtaaaccgaaacggtacgttgggtacgtaccgtacgaccctaccttacttcgtacgttcttcccgttaacccg

SEQ ID NO: 159980 - DNA, 713 bp, Homo sapiens
  misc_feature: GYAE6OF01CU2WF.19.83.H06.1.454.CMB.1.raw
  modified_base (246)..(246): a, c, t, g, unknown or other
  misc_feature (246)..(246): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactcctccctgcccgtctattcctgggacgacgcccggtccctccagttcctcctgactaagttcctagtcaagacgcccttaccgtaanattaagtaagtggaacctacaaatttgtttggattcggtacctgacaaggaacgccgagggcagtcctaccgacacgtccttccaggtacttcgttagttttcgggtactaacggtccgggtcccgtccgggtccctaggaccgtaggttcaggttcggctaggtaggtactacggaggacacgtaagttacgtttaaccagtaagaaactacgtaacgtaggacgtagggacggtacgtagggaacggttaggtttacgggttttaggggtttaactttacggtacgtactaagtacgtaacgtacgtaccgtaacctaacctaaacccgttccgtacccgtaaccggttaccgggacggggtaccggaaccggtaaagggtacggaaactacgtaaaccgtaaacggtaagttagggtccggacgtacgacccgtacttactcccggttattccttacgtacccg

SEQ ID NO: 159981 - DNA, 712 bp, Homo sapiens
  misc_feature: GYAE6OF01CN8JS.19.83.H06.1.454.CMB.1.raw
  modified_base (155)..(155): a, c, t, g, unknown or other
  misc_feature (155)..(155): n is a, c, g, or t
  modified_base (185)..(185): a, c, t, g, unknown or other
  misc_feature (185)..(185): n is a, c, g, or t
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
  modified_base (700)..(700): a, c, t, g, unknown or other
  misc_feature (700)..(700): n is a, c, g, or t
tcagtactctcgtgcacgaccggtgctcgatttagatcacgtgcgtcgcgggcgtagactttgtgtttctcgtagtctgctttgctcagcgtcgagggtgcctgctaatgcttcgtgggtctctggactccgaggtgggtaattgttggtggtanactcgagtcctccactccgtccctgccctntattccgnggacncgccgcctacntcnctgactagtctagcagacncctacganatagtacngacactaattgttagnttggacctgacaggactcgagcacgtcaccagcgtctacctgtacttcgtttaggtttggtaaccttacgggtccccggggtaccgttcccggggtacctaaagggtccgttagggttaacgcggggtacggtacgtaagggtaggacctacgggaggtaaccctaacggttaaaggttttaaactttaaccgaaaggttaaactaaactacgaagttacggacggtaggacgtaggtagggtaaggtttagttagggtttaggtttaccttgagtagtagtcgtaactaacggtaccttaccgtaaaaccgttaccccgtaccgttaacggtaacgggttcggggaacggaacggtaaccgggttaagaggaaaccgtaagtaacccgtaaaggtccgtaggtacggactacgacctaacggttcttagttccgtntaacccggtccc

SEQ ID NO: 159982 - DNA, 697 bp, Homo sapiens
  misc_feature: GYAE6OF01B5U73.19.83.H06.1.454.CMB.1.raw
  modified_base (173)..(173): a, c, t, g, unknown or other
  misc_feature (173)..(173): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactcctccctgcccgtnattcctggagacgcccggcctccatcctcctgcaagtctagtcagacgtccctacctaacattaagtaatcggaaccaacgtaaacttagtttggatttcgggtaccctgacaaggaacgtccgagggctagtcctccaacgacgtccttccgtgtaacttcgttagttttgggttactaagtccgggcccgttccggggtcctgacgtggttacgaggtcgcaggtgactcgaggtcacgtagttaactttacacgttaagaaactcgaacggaggtaggtagggacggtacgtaggaacgggtagtttagggtttagggtttactacgtgtactagtacgacgtaacgtcctaaccgtaacctaaccgttcccgtaacggttaaccgggttcgggaaccgggtacggtaccggtaagggtacggaacgtaacgtaaaccggaaacgttaacggttcgggtaccggtcgtaaccgtcccgtaaccgtacgtttaccgtaccggtttccgttaccgttaccccg

SEQ ID NO: 159983 - DNA, 1010 bp, Homo sapiens
  misc_feature: GYAE6OF01EZH8T.19.83.H06.1.454.CMB.1.raw
tcagtactctcgtgcacgaccggtgctcgatttagatcacgtgcggtcgcgggcgtagactttgtgtttcgtcgtagtctgctttgctcagcgtcagggtgctgctaatgctctgggtctctggatccgaggtggggattagttgtggtgactcacgtcctccactcctccctcgcccgtcagttccgtgggagacggcccggccctccactcctcctagactaagtcctaagtccaagacgtccctaccttaactaagttaagtaaacgtacggaaacctaaacgttaaacgttagtttagggtaacgtttacgggttaccctacggaccgaaacggaaaccgacccggaagggtaccgtaacggtacccctacccgaaccgtaacgtcccgttccgtacgtacgtttaccgttttacggttttacggggtttaccgttaaccggttccccgggggttaccccgggttacccccgggggttaccccgttacgggtaaccggttacggggtttaccgtaaggggttacgggtacggtacgggtacgggtacgtaccgggtaacggtacccgtaaacggtaaacgttttaaaccgttttaaaccgaaccgtttaaacgtaaaaaccgttacctaaaacggtaacgggtaacgggtacggggtaaccgggtacggttaacggggtaagggtttaaggttttacggggggtttttaacgggggtttttaacgtttaaccgggttcgggtaaccgttaaggtttaaccgggttaacccttaacggttaacccgtttaaacccttaaaacccgttaacccgtttaaccccgtttaaacggtttaaaccgggggtttacgggttaaccgggtaaaccggggtaaaccgggtaaggggttaaccgggtaaaaggtaaccgttaaaccgggaaaaccggttaacgggttacgggttaccggacgttaccggtacccgtaacgttaccgtttacgttccgttcccgttccgttaccccg

SEQ ID NO: 159984 - DNA, 688 bp, Homo sapiens
  misc_feature: GYAE6OF01AFYH9.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctggtctctggatccagtggggatattgtggtgactcagtctccactctccctgcccgtcattcctggagagcccggcctccatctcctcgcaagtctagtcagagcctcctacatagtaatggacactaactatttggtattcggtacctgcagaagccgagggctacgtcctacccacgacgtcctcctgtacttctttagtttcgggttactaacgtccgggtcccgttcccggggtcctacgacgtacggttcaggtcggcaggtgactcgagcaactagttactttaacacgttacgaaaactcgaacgtacggtaggtagggtacgggtatagggtaaggtacggttttgggtttaggggtttttaacttacgtacggtataacgtacgtacgaacgtttccctaacctttaaaccctaacccgtaccccgttaacgtaacccggggttccgggacgggtaaccggtaaccggtagggtcgggaaactaccggaaccggtaaaacgtacggtttcggtcggtacccgtacgtacccgtaccctagttaccctcgttccgttacgttaccccg

SEQ ID NO: 159985 - DNA, 1198 bp, Homo sapiens
  misc_feature: GYAE6OF01CR5RL.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattggtggtgactcagtcctccactcctccctcgcccgtctacttccgtgggacgcggtccccggtcccttaccacttccttcctaggacctaaacgttaccgttaaggtcaacggtaccgtacccttacctaacctaagttaaggttaaacgtacggaacctaaccttaaacgtttagtttacgggtaacgtttacgggtacctaggaccgaaggaaacggccgacggggtactacgtccctaccaacgaccgtccttcctagtaacttcgtttaggttttacgggttaccttaacgggtcccgggtaccccggttcccggggtaccctaggtaccgttacggttacggtacgggtcgggtactaagggtacggtacgttaccggacggtaaccgtaacgtttaacggtttaaccttttaaaccgaaaccggttaaaagtaaaaccgtaaccggtaaaacggtaaacgggggttaaacggggttaacggggggtaaacccggggttaacgggttttaaacgggggtaacgggggtttttaaaaggggttttttaaccggggggggtttttttttaaacggggggttttttaaaaaccggtttttaaccccggggttttaaaccccggggtttaacccgggttttaaacccgggtttaaacccgggggttaaaccccggttttaaaaaccccgggttttaacccccggtttttaaaaaccccccgtttaaaaaaccccccggttttaaaacccccccggttttaaacccccccccgggggttttaaacccgggggttttaaaacccccgggggggggttttaacccccgggggggtaaaaccccggggggggggttaaaacccggggggtttaaaaacccggggggttaaaaaccggggggggtttaaacccgggggttaaaaaacccggttaaaaccccggggtttaaaaaaccccggggttaaaaaacccgggggtttaaacccgggggttttaaccccggggggtttaaccggggttaaaccccccgggttaaaacccgggggtttaaaccccccgttt

SEQ ID NO: 159986 - DNA, 774 bp, Homo sapiens
  misc_feature: GYAE6OF01E1174.19.83.H06.1.454.CMB.1.raw
  modified_base (182)..(182): a, c, t, g, unknown or other
  misc_feature (182)..(182): n is a, c, g, or t
  modified_base (223)..(223): a, c, t, g, unknown or other
  misc_feature (223)..(223): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccgaggtggggatattggtggtgactcagtctccactcctccctcgcccgtcattccnggagacgccggcctccatcctcctgcaagtctagtcagacncctcctaacatagtatggacactaacttattagattgtacctgacagaacgccgagggctacgtcctaccacgacgtcctccgtagtacttccgttaagttttcgggttactaacggtccggggtcccggttcccggggtcccctaggtaccgtagggttacgagggtcggacgtaggtacggtacgtcgacgggtaccaacgtaacgttaacgttttaacgaaccgttaaacgaaaacttaccgaaacggtaagggtacgggtagggtaacgggtcgtaaggggtaagggttacgtttaggggttttaaggggttttaacttaccggtagtactaggttacggaccgttaaagttaccccttaactaaaccgaaaccccgtttcccggttaaccgggttaaccgggttaccggggacgggtaaccgggtaaacggtaacggggttaggaaaccgtaacgtaaaccggtaaaacggtacgttgggtacccggtaccgtaccggaactaacccgggttaattacccgttacgttacccgttccgtaccccgg

SEQ ID NO: 159987 - DNA, 552 bp, Homo sapiens
  misc_feature: GYAE6OF01D4ZJ9.19.83.H06.1.454.CMB.1.raw
  modified_base (171)..(171): a, c, t, g, unknown or other
  misc_feature (171)..(171): n is a, c, g, or t
  modified_base (517)..(517): a, c, t, g, unknown or other
  misc_feature (517)..(517): n is a, c, g, or t
  modified_base (547)..(547): a, c, t, g, unknown or other
  misc_feature (547)..(547): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagagccggccctccatctcctgcaagtctagtcagagccctcctacatagtaatggacacaactattggattggtacctgcagaagccagggcagtctccacagctcctgatctatttggttactaagtcgggcctccgggtcctgactaggttcagtcggcagtggatcagcacgtagtattttaacactaagaaactcaaacgagagtgggagtcgtagaggtagttggttggggttttatacgtgactagtcgactagctactaacaaccttccctacgtaacggttcggacgggacggaacctagggtacgagaatacgaaaccgtaagtcggngtacgtcgaccgtacctactacttgtcctntaccg

SEQ ID NO: 159988 - DNA, 709 bp, Homo sapiens
  misc_feature: GYAE6OF01DBGG5.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctcccttcccgtcattcctggagacgcccggcctccatctcctgcaagtctagtcagacgcctcctacatagtaatggacactaactatttggattcggtacctgacagaacgccgtagggcagtctaccgacacgtcctacgtagacttcgttacgtttcgggttactaacgtccgggtcccgtaccggggtccctagacgtaggttcgagtcggactaggtcgatacgacggtcaacgtagttaactttaacaacgttaagaaaacttacgaaacgtaaggtacggttagggaacgtcgggttaggtaagggttactttagggggttttacgggttttaactacggtcggtactaacggttacgaacgtaaccgtctttaaacccgtaaactaaacccgttccccgtaaacgtacggggttaccgggacgggtaaacggggactaaacggggtagaacgtaaaccgtaccggtaaaacggtaccgtggtacggccgttacgaacctaaccgtaccgtttcgtaccgtttacctctccggttacccccg

SEQ ID NO: 159989 - DNA, 680 bp, Homo sapiens
  misc_feature: GYAE6OF01DY2DH.19.83.H06.1.454.CMB.1.raw
  modified_base (171)..(171): a, c, t, g, unknown or other
  misc_feature (171)..(171): n is a, c, g, or t
  modified_base (501)..(501): a, c, t, g, unknown or other
  misc_feature (501)..(501): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagagcccggcctccatctcctgctaagtctagtcagagccctcctacatagtaatggacaacaacttatttggattcggtacctgacaagaacgccgaggcagtcctccacagcctcctgacttcgttagttttcgggttactaacgtccgggtcccgttcccggggtcctagacgtacggttcgaggtcggactaggtaggacgtacgaggaccaactacgttaactttaccgaactaagaaaatccgaaacgtacggaggttagggaagggtcgtaagggtaaggttaggtttagggttttaggggttttaactttacgngtacgtaagtcgaacctaacgtaccttaacctaaacccgttaacctaccccgttaacggtaaccgggttcggaacggggtaacggtaacgtaagggtacgaacgtaaccgtaaacgaaacggttacgtcggtcggccgtacgacctaaccgttcgttcgttacgttcgtaccttaccgg

SEQ ID NO: 159990 - DNA, 699 bp, Homo sapiens
  misc_feature: GYAE6OF01DHUXQ.19.83.H06.1.454.CMB.1.raw
  modified_base (173)..(173): a, c, t, g, unknown or other
  misc_feature (173)..(173): n is a, c, g, or t
  modified_base (179)..(179): a, c, t, g, unknown or other
  misc_feature (179)..(179): n is a, c, g, or t
  modified_base (222)..(222): a, c, t, g, unknown or other
  misc_feature (222)..(222): n is a, c, g, or t
  modified_base (377)..(377): a, c, t, g, unknown or other
  misc_feature (377)..(377): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtcctccactctccctgccccgtnattccnggagacgcccggcctccatcctcctgacaagtctagtcagacncctcctacattaagtaatacggacacaacttagtttggaattcggtacctgacaagaacgccgacgggcacgtcctacccacacgcctccgtagtacttccgtttaggttttcgggttacttaacggtccggggtcccggttacccggggtcccnggtaactagggttcgaagttggcgaggtgaatcgagtacagtaatatttacacgtaagaaactacaacgtagaggtacggtagacgttaggaaggttagttgggtttagggtttaattacgtagtactaacgtggactaacgtcttaacctaaccgtaacccttcccgttaaccggtaaccgggttaccggaccggggtaacgggaccggtaaacggtaggaacggtaaacctaaccggtaaaaggtacccggttagggtaacgttcccggaagtaccccgtaaacttaccgttacgtttcgttacccgttaccgttacccg

SEQ ID NO: 159991 - DNA, 697 bp, Homo sapiens
  misc_feature: GYAE6OF01B5FUI.19.83.H06.1.454.CMB.1.raw
  modified_base (174)..(174): a, c, t, g, unknown or other
  misc_feature (174)..(174): n is a, c, g, or t
  modified_base (180)..(180): a, c, t, g, unknown or other
  misc_feature (180)..(180): n is a, c, g, or t
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctcgtggatccgaggtggggatattgtggtgactcagtctccactctccctgcccgtnattccnggagcgccgcctcatcctcctgacaagtccagtcagcncctactacatagtangacaactacttagttgtattacgtactgcaagacgacgnggcncgtcctccaagcgtctcgtgtacttcgttagtttggttacctacggtcccgggtaccgttcccgggtcctcggacgtcggttacgaggtcggcgtaggtcgatcgaaggctacgtagttactttaaccgacgttaagaaacttaccgaacggtaagggtagggtacggacgggtaccgttaagggtaaggttaggtttacggggttttacgggtttaacgtttacggtacgtacgtactagggtaactaccgttacccttaaaccgtaaccctaacccggttacccggtaacggttaacccgggtttaggggaacccgggtacggtaaccggtaagggtaacggaacgtaacgtaaccggaaacggttagtggtaccggtctaccgcccgtaacgtccgttacgttccttcgtaccttccg

SEQ ID NO: 159992 - DNA, 842 bp, Homo sapiens
  misc_feature: GYAE6OF01A96GU.19.83.H06.1.454.CMB.1.raw
  modified_base (182)..(182): a, c, t, g, unknown or other
  misc_feature (182)..(182): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagngcccggcctccatcctcctgcaagtctagtcagacgcctcctacgataagtaatcggaacacgtaacttatttggatttcggtacctgaccgaagtaacggccgaagggcaggtcctaccacgacgtccgttacccgtagtaactttcgtttaggtttttcggggttacctaaacggtccccggggtccccggttaccccggggggttacccctagggtaaccgtacggggtttaccgaaggggttccgggtaccgtaagggttcggaaccgttaccggtaacgggacctaaccggtaaaggttttaaccttttaaccgaaacgtttaaaggtaaaaccgtacctaaacgggtaacggtaacgggttaggggaacgggttaccgtaagggtaacgggttaagggtttttcgggttttaacgggggtttttaattaaccggttacggtacgttaggtttacgtaccgtaaacgtttacccgttaaccgttaaaacccgttaacccgttacccccgttaacggtacccgggttaacggggaaccgggtaaccggggaacggtaagggttacgggacgtaaaccgtacgaaaaccggtacgttgggtcccggtaccgtacgaccctacgtacttaccggtttcgttccgttacccttaacccg

SEQ ID NO: 159993 - DNA, 786 bp, Homo sapiens
  misc_feature: GYAE6OF01DHXTA.19.83.H06.1.454.CMB.1.raw
  modified_base (182)..(182): a, c, t, g, unknown or other
  misc_feature (182)..(182): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactcctccctgcccgtctacttccgnggagacgcccggcctccatcctccgtagacctaagttcctaagtccaagcgcccttacctacaattaacgtaaagtggaacctaactaaactttagtttacggaatttcgggtaacctgacaaggaacgccgagggccagttcctaccacgacgtcctctagaactttcttaggttttcgggtaccttaacgggtccgggtcccggttcccgggtaccctggtaacgtacgggttcaagggtcggactagggtcggtatcggaagacaagtaggttaactttaacactaaggtaaaactcgaaagaggaggtggaacggtcgtagggtaaggtggtttagggttttaggggttacttacggtcgtaactcgtaacgacttaaccggtaccttaaaccgtaaacccgttaccccgttacccggttaaacggtaaccggggtttacggggtaaacgggtaccgggtaaaccggtaaagggtacggtaaaccggtaaacgtaaacccgggtaaaacccgtaagggtttcgggaccggttaccgtaacccgtaaccgttaccgttaacgtttcccggtttaacttacccgttacccggttaacccccg

SEQ ID NO: 159994 - DNA, 661 bp, Homo sapiens
  misc_feature: GYAE6OF01EY0EB.19.83.H06.1.454.CMB.1.raw
  modified_base (87)..(87): a, c, t, g, unknown or other
  misc_feature (87)..(87): n is a, c, g, or t
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
tcagtactctcgtgcacgaccggtgctcgatttagatcacgtgcgtcgcgggcgtagactttgtgttctcgtagtctgctttgctcngcgtcaggtgctgctaatgctctgggtctctggatccagtgggagtattgtggtgactcagtctccactctccctgcccgtcattcctggagagccggcctccatctcctgcaagtctagtcagagcctcctacatagtaagtagacacactattgtagtgtactcgcacgagaccgaggcgnacgtctaccncacgtctacgtactacttacgttacgtttacgttacgtacgtccggtcccggtccggtccgtaccgtacgtacgtacgtcgtacgtacgtacgtacgtacgtacgtacgacgtacgtacgtaacgtaacgtaacgtaacgtaacgtaacgtaacgtaacggtaacggtaacggtacgtacggncnggttacgtttacgggttttacgggttttaacgtttacggttacggttacttaacgtacggtaacgtaacgtaccgtacctaaccgtaacccgttacccgttaaccgtaaacccggtacccggtaccgggtaaccgggtaccggtaacgggtacggtaacgtaacgtaacgaacgtaacgtacggtcggtacgtacg

SEQ ID NO: 159995 - DNA, 679 bp, Homo sapiens
  misc_feature: GYAE6OF01EMHLC.19.83.H06.1.454.CMB.1.raw
  modified_base (171)..(171): a, c, t, g, unknown or other
  misc_feature (171)..(171): n is a, c, g, or t
  modified_base (177)..(177): a, c, t, g, unknown or other
  misc_feature (177)..(177): n is a, c, g, or t
  modified_base (219)..(219): a, c, t, g, unknown or other
  misc_feature (219)..(219): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctcctgcccgtnattccnggagacgccgcctccatcctacctgacaagtctagtcagacncctctacatagatgacactaacttagttgattcggtacctgacaagaacgccgagggctagtcctaccacagcctacctgtattcttaggtttcggtctaacggtccgggtccgtcccgggtacctagacgtacgtcgaggtcggactaggtcgactacgacggactaacgtaagtttaactttaaccgaacgttaaacgtaaaacttacgaaacgtaggtaaggtcgggaacggtgtagggtaacggttaggtttagggttttagggtttaaactacgtcgaccgttagtacgaacttaacgaccttaaccgtaaaccctaacccgttacccgttacggtaaaccgggtttcgggaacgggaaccggtaaccgtaagggtacgaaagtaacctaacggaaaacgttagtggtccggtactacgaccctacctagttccttcgttacccgtcgttacccg

SEQ ID NO: 159996 - DNA, 899 bp, Homo sapiens
  misc_feature: GYAE6OF01DH1SZ.19.83.H06.1.454.CMB.1.raw
  modified_base (172)..(172): a, c, t, g, unknown or other
  misc_feature (172)..(172): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtntattcctgggagacgcccggcctccatcctcctgacaacgtctagtcaagacgtccctacctacaattaagtaacgtacggaacctaacctaaacgttagttttggtaacgtttcgggtaacccttggaacgtaaacggaaacggaccccggaaggggtccgtaacggtccctaacccaaccgaacggttcccttacccggttggtaacctttaccgtttaggtttttacgggtttaaccgttaaacccggttcccgggggtcccccggtttccccgggggtaccccttacggtaaccggttaacggttcccgtaaggggttcgggacgtaaggggttcgggaacgtaccgtacgggtaacccgtaacgtaacggtttaaacttttaacccgaaacgttaaacgtaaaacgtaaccgaaaacggtaggggtaacgggtagggtaacgggtaccggttaggggtaaagggtttaaggtttaggggttttttaagggtttaacgtttacggtacggactttaacggtaacgtaaccgtaacgttaccccgtaaacgttaaaccctaaccccgttaccgttaaccggtaacccggggttcggggaaccgggtaacgggtaaccggtaaaggggttacggaaaacgtaccggtaaacgtaaaccggtaacgttgggtacgggtactccgacccgtaacgttcgtacctttaacgtcccgtttcgtaccccg

SEQ ID NO: 159997 - DNA, 857 bp, Homo sapiens
  misc_feature: GYAE6OF01DZAPX.19.83.H06.1.454.CMB.1.raw
  modified_base (70)..(70): a, c, t, g, unknown or other
  misc_feature (70)..(70): n is a, c, g, or t
  modified_base (212)..(212): a, c, t, g, unknown or other
  misc_feature (212)..(212): n is a, c, g, or t
  modified_base (511)..(511): a, c, t, g, unknown or other
  misc_feature (511)..(511): n is a, c, g, or t
tcagtactctcgtgcacgaccggtgctcgatttagatcacgtgcgtcgcgggcgtagactttgtgtttcncgtagtctgctttgctcagcgtcgaggtgctgctaatgctcgtggtcctgtggacgtccagggtgggtattagttggtaggtgtacctacgtacgttcctccctacttcccgtcccgtacgtcccgttacacgtttcccggngggaacgccggtccccgtcctaccgtacttccggtccgttaggaactaacggttcgttaacgtaccgacgtaacccgtcccttaactaacgtaagttaagtaacggtaccgaacctaaacgttacggtttagttacggtaacttacggtacctacgaagtaacggaaacgtccggaagggtacctacgtaccccgtacaccggtactccttaccgtagtacgtttaccgtttaggtttaccggtaaccgttaccgtccggggtaaccccgttcccgggactacggtacgtacgtacggnggtacgtagacgtgactcggacgtactaacgtagttaacgttaactaaggtaaacgtaaaccacggtaaggtacgggtaacggtaggggaccgtttaggtaagtacggggtttaacggtaggggttttattaacgcgtacgtaggtaactacccggtataaaccgtcgttaaaccctaaacccgttaaccctacccggtaaggttaaaccgggggttccggtaaacgggtaacggtaaaccgggtaaggttaccgggtaaacaacgggttaaccggtaaacgtaggtcccggtagcctaaccgtacgtaacttccggttacccttaaggttccctaaccggtaccc

SEQ ID NO: 159998 - DNA, 706 bp, Homo sapiens
  misc_feature: GYAE6OF01A5IM0.19.83.H06.1.454.CMB.1.raw
  modified_base (171)..(171): a, c, t, g, unknown or other
  misc_feature (171)..(171): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagacgcccggccctccatcctcctgcaagtctagtcagacgccctcctacatagtaatggacacaactatttggattggtacctgcagaagccgagggcagtcctccacagctcctgatcttagtttgggttctaagtccgggcctccgggtccctgacgtaggtcaggtcgctagtggatcgacggcaacgtagttacttttaaccaacgttaacgtaaaactccgaaacgaggtaaggtagggaacgggtacgtagggtaagggtacgtttagggttttagggggttttaacttaacgtcgtacgtaagtcggaaccgtaacggtccttaaccgttaaacccgtaaacccgttaccccgttaaccggtaaacccgggtttaccggggtaaccggggtaacggggtaacccgtaaaggggtaacggtaaacggtaaacgtaaccgtaaaaccggtacgttacgggtacggtacgtacgtacccgtaaccgttacgttaccggttaccgttccgttaccgttacccg

SEQ ID NO: 159999 - DNA, 818 bp, Homo sapiens
  misc_feature: GYAE6OF01CWAQF.19.83.H06.1.454.CMB.1.raw
  modified_base (173)..(173): a, c, t, g, unknown or other
  misc_feature (173)..(173): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactcctccctgcccgtntattccgtggagacgcccggccctccatcctcctgactaagtctagtcagacgtcctaccactagtagtaatggacctaacaacttagttggattcggacctgactaagaacgcccgagggctacggtcctaccacgacgtcctccgtgtaacttacgtttaggttttcgggttacctaacggtcccggggtacccgttccccgggggtacctaggtaacgtacgggtttcgacggtcggacgtaggtggaacttaccggaggtaccgaaccgttagttaacttttaaccgaaacgttaacgtaaaaccgttaaccgaaacggtacggtaagggtagggacgggtacgttaggggtaagggttaggttttcggggttttaagggtttaccttaacggtcgaacgtagtacggtacctaaggttacccttaaccgtaaacccgttaacccgttaccccgtaccggtttaacggggttcccgggaacggggtaacccgggtaaaccggtagggttaaccgggaaacggtaacgtaaaacccggtaaaccggttaacggttcgggttaccggtcccgttaacccgtaccggttaacccgttacgtttacccgttaccgggtttacccctttacccgttaaacccccgg

SEQ ID NO: 160000 - DNA, 624 bp, Homo sapiens
  misc_feature: GYAE6OF01C6WG4.19.83.H06.1.454.CMB.1.raw
  modified_base (172)..(172): a, c, t, g, unknown or other
  misc_feature (172)..(172): n is a, c, g, or t
  modified_base (179)..(179): a, c, t, g, unknown or other
  misc_feature (179)..(179): n is a, c, g, or t
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (564)..(564): a, c, t, g, unknown or other
  misc_feature (564)..(564): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtgtgactcagtctccactcctccctgcccgtnatttccnggagacgcccggcctccatcctcctgctaagtctacgtcagacnccctcctanatagtaataggacactaacttagtttggattcggtacctagacaaggaacgccgagggcacgtctaccacgacgcctcctagtatcttacggttttgggttacctaacggtccgggtcccgttcccggggtccctacggacgtaacggttcgagggtcggacgtaaggtcggataccgaggtaccacgtaagttactttaacaactaagaaactacgaacgagaggtaggaggtcgtagggagttaggttggtttagggtttattacgtagctatgactagtctaactaaccaactccgtactacgggtcggacggtaggaaccgtaggganacgaataacgaacgtaacgtgtcgacgtacacaaccgtattcgtacgtccttaagttccc

SEQ ID NO: 160001 - DNA, 330 bp, Homo sapiens
  misc_feature: GYAE6OF01D34FV.19.83.H06.1.454.CMB.1.raw
  modified_base (139)..(139): a, c, t, g, unknown or other
  misc_feature (139)..(139): n is a, c, g, or t
  modified_base (173)..(173): a, c, t, g, unknown or other
  misc_feature (173)..(173): n is a, c, g, or t
  modified_base (179)..(179): a, c, t, g, unknown or other
  misc_feature (179)..(179): n is a, c, g, or t
  modified_base (183)..(183): a, c, t, g, unknown or other
  misc_feature (183)..(183): n is a, c, g, or t
  modified_base (198)..(198): a, c, t, g, unknown or other
  misc_feature (198)..(198): n is a, c, g, or t
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
  modified_base (274)..(274): a, c, t, g, unknown or other
  misc_feature (274)..(274): n is a, c, g, or t
  modified_base (282)..(330): a, c, t, g, unknown or other
  misc_feature (282)..(330): n is a, c, g, or t
tcagtactctcgtgcacgaccggtgctcgatttagatcacgtgcgtcgcgggcgtagactttgtgtttctcgtagtctgctttgctcagcgtcaggtgctgctaatgctctgggtctctggatccagtggggatattgnggtgactctacgtctccactctccctgccccgtnattccnggancgccgcctccatccnctgacaagtctatcagacncctctacatagaatggacaanactatgatgactganagaagccgaggcagtctacanagctcctnnnnnnnnnnnnnnnnnnnnnnnnnnnnnnnnnnnnnnnnnnnnnnnnn

SEQ ID NO: 160002 - DNA, 682 bp, Homo sapiens
  misc_feature: GYAE6OF01CNC0S.19.83.H06.1.454.CMB.1.raw
  modified_base (182)..(182): a, c, t, g, unknown or other
  misc_feature (182)..(182): n is a, c, g, or t
  modified_base (203)..(203): a, c, t, g, unknown or other
  misc_feature (203)..(203): n is a, c, g, or t
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (294)..(294): a, c, t, g, unknown or other
  misc_feature (294)..(294): n is a, c, g, or t
  modified_base (309)..(309): a, c, t, g, unknown or other
  misc_feature (309)..(309): n is a, c, g, or t
  modified_base (651)..(651): a, c, t, g, unknown or other
  misc_feature (651)..(651): n is a, c, g, or t
  modified_base (675)..(675): a, c, t, g, unknown or other
  misc_feature (675)..(675): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccgaggtgggatagttgtggtgactcagtctccactcctccctgcccgtctattccgnggacgcgcccggcctccatcncctgcaagtctagtcagacncctacctanaataagaatggaactaactaattagtttgagttcggtactgacaagaacgccgaggcagtcncgactacgctccgtntactcgttagtttcgggtactaacggtccgggtcccgttcccggggtaccctaggaccgttaggttaccgagggttacggaccgtaagggtccggtaagtaccgaacggtaaccaaacgtagtttaaacttttaaccgaacgttaaagtaaaacgtaaccgaaacgtaaggtaggtacgggaaggtccgtaaggaagggtagtttagggttttaaggttaataccgtaggtactaagtacgacaaaccgtactaacctaaacgaaccctacccgtaacggtaaccggttcggggaacgggaacggtaaaccgagggtagaaagtactaacggaaacgtacgngtacgctagactactactatcgtntcgtacc

SEQ ID NO: 160003 - DNA, 697 bp, Homo sapiens
  misc_feature: GYAE6OF01BXAXF.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattcctggagagcccggcctccatctcctgcaagtctagtcagacgcctcctacatagtaatggacacaatattggattcggtacctgacagaagccgagggcagtcctaccacacgcctcctagtacttcgttagttttcgggttactaacgtccgggtcccgttcccggggtccctggtactacggttcgaggtcggcgtaggtcggactacgaggacctacgtaaggttaacttttaaccgaacgtaagtaaaactaccgaaacgtaggtaacggtagggaggtacgtagggaagggtagtttagggtttaggggttttacttacggtacgtacgtagtcgtaacgtaacgtaccgttactaaaccctaaacccgtccccgttaacggaaccggtttcgggaccgggtaacggggtaaccgtaaggggtaggtaacggtaactaaccggtaaaaccgtaacgtcgggtaggtacccgtagaacccgtaacgtacttaccgttacgttccgttccgtaacccg

SEQ ID NO: 160004 - DNA, 724 bp, Homo sapiens
  misc_feature: GYAE6OF01BG4OA.19.83.H06.1.454.CMB.1.raw
  modified_base (139)..(139): a, c, t, g, unknown or other
  misc_feature (139)..(139): n is a, c, g, or t
  modified_base (148)..(148): a, c, t, g, unknown or other
  misc_feature (148)..(148): n is a, c, g, or t
  modified_base (178)..(178): a, c, t, g, unknown or other
  misc_feature (178)..(178): n is a, c, g, or t
  modified_base (234)..(234): a, c, t, g, unknown or other
  misc_feature (234)..(234): n is a, c, g, or t
  modified_base (321)..(321): a, c, t, g, unknown or other
  misc_feature (321)..(321): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctcgtgggtctctggatccgagggtgggatnttggtggtnactcagtcctccactcctcccgtgcccgtnacttccgtggacgacgcccgtcctccattcctcgtgactaagtctaagtcacggcncctaccataatagtagtcggaacaactaacgtttgttaggtcgttacggtacctaggaccaaggaacgtccggaggtccacgtaccnccgaactagtccctactgtactttactttaggttttcggtactaccggtccgggtcccgttccgggtccnggtacgtggtacngggtcgcgtaaggtcgaacgtacgcgggtactaacgtacgtttacttaacaaggttaaacgaactacggaacgaggtagggtacggtacgtacgtaggtacggttacggtttagggtttacggtttattacgagttacaagtcgtaacgtaccgtaccgttaacctaaacccgttacccgtccgtaaccgggttaaccggtacgggtaaccgggaccggtaaggtaacgggtaacggacgtaaaccgtaacggtaacgtaacggttcggaacggtcctacggaaccttcctaacgtcttaccgttccgttacgtaccccg

SEQ ID NO: 160005 - DNA, 730 bp, Homo sapiens
  misc_feature: GYAE6OF01ALW9R.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattggtggtgactcagtcctccactcctccctgcccgtcattcctggagacgcccggtcctccatcctcctgactaagtctagtcagacgcctacctacatacgtaatcggaacactaacttagtttaggattacggtacctgacaaggaacgccgaagggctacggtcctaccgacgtacgtcctacctgtaacttcgttaagttttccgggtactaacgggtcccggggtcccgttcccggggtacctaggacgtacggttcgaggtcggtcgtaggtcggtactcggacggtctaacgtagtaactttacgacgtaagtaaacctcgaaacgtaggtaggtagggacgtcgtacggtaaggtacggtttaggtttacggggtttaattacgtcgtacgtaagtacggtacgtaacgtacctaaccgtaaccgtaacccgttacccgtaaccggttaaccgggtacgggaaccgggaaccggtaggtaacgggtacgaaacgtaacgtaaacgggtaaaccgtaggtacggtcggtaccaccggtacctaaccggtacgtttacccgttacgttacccgttccggttacccg

SEQ ID NO: 160006 - DNA, 719 bp, Homo sapiens
  misc_feature: GYAE6OF01AEWNP.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactcctccctgcccgtcattcctggagcgccggccctccatcctcctgactaagtctagtcagacgccctcctaacatacgtaagtacggaacactaacttatttggattggtaccctgactagaacgccgagggcacgtcctcccacacgcctcctcgtatcgttagttttgggttacttaacgtcggggtccccgtcccgggggttaccctcggtacgtacggttcgacggttcgggtcgtaggttacggaactccggaggtacctaacgtagtaacttttaacaacgtagtaaaactacgaacgaggtaggtgggaggtacgtggaagggttagtttagggtttaggggttttaacttacggtcgtacgtagtacggtacgtaacgtaccttaaccgtaaaccgtaaaccccgttcccgtaacgttaacccgggttacgggtacccggggtaacgggtaaccggtaaggggtacggaaacgtaaccggtaccgtaaaacggtacgttcgggtacggaccgtacgacctaccctacttaccgttcgttacgtcgttacccg

SEQ ID NO: 160007 - DNA, 936 bp, Homo sapiens
  misc_feature: GYAE6OF01BJ93Z.19.83.H06.1.454.CMB.1.raw
tcagtactctcgtgcacgaccggtgctcgatttagatcacgtgcgtcgcgggcgtagactttgtgtttctcgtagtctgctttgctcagcgtcaggtgctgctaatgctcgtgggtctctgggactccgaggtggggtattagttggtggtcgacttctacgttcctccctaccttccttccccgtcgtccccgtctaactttcccgtagggacgacggcccggtaccctccctacttcccttacccgttggacgtaaacgttccttaagtccgtaaggccgtaccccttaccttaaacgtaagttaaggttaaacgtaccggtaacctaaaccgttaagtttaacgttttcgggtaacgttttaccgggttacccgtaggaccgaaaggtaaaccggcccggaacggggtccaacggttcccctacccgaacgtaccggtcccgtttacgacgttacgtttacgtttaacggttttcgggtttaaccgtaacccgggttcccggggtacccggttaccccggggttaccttaggtaccggttacgggtttacggagggttacggaccgtagggttacgacggtccgtaggtacctaacgttaacgtttacctttaaacgaccgtttaaagaaacgtacggaaacgttagggacgggttaggacgggtacgtaaggggtaaggttaacggtttttcggggttttaacgggtttacgttacggtacgtaacgtcggttaacgtaactaacccgttacttaacccggttaaaacctaccccgtttaccgggtaccgggtttaaaccggggtacggggtaacccgggtacgggtaaaccggaggttacccgggaaacttaaacccggtaaacgtaaacggtacgttcggcggtacgtaccgacctaacgtttaccgtccgttacttcgtacccttaccg

SEQ ID NO: 160008 - DNA, 741 bp, Homo sapiens
  misc_feature: GYAE6OF01BGTUK.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattccgtggagagcccggcctccatcctcctgcaagtctagtcagacgcctcctacatagtaatggacactaacttatttggatttggtacctgacaagaacgccgagggcagtcctaccacacgcctcctgacttctagttttgggttactaacgtccgggtccgtcccggggtccctaggacgtacggtttcaggtcgggactaggtaggactacggaggaccgtaaacgaagtttaacttttaaccgaacgttaacggaaaaacttaccgaaacgtaagggtaacggtagggtaacggggtacgttaagggtaacgggttagttttaggggtttttacggggttttaatttacggtaggtaccgtaagttccggaacgtaacgtaccttaaccgttaaaccctaaacccgttccccgttaacggtaacccgggtttaccggggaacggggtaaccgggaaccggtaaaggggtacgggtaaacgtaacggttaaccgtaaaacggtacggttaggtcgggtaccgtacgaaccctaccgtacttacgtacgttccgttactacccg

SEQ ID NO: 160009 - DNA, 768 bp, Homo sapiens
  misc_feature: GYAE6OF01BQ82V.19.83.H06.1.454.CMB.1.raw
  modified_base (537)..(537): a, c, t, g, unknown or other
  misc_feature (537)..(537): n is a, c, g, or t
  modified_base (596)..(596): a, c, t, g, unknown or other
  misc_feature (596)..(596): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctcgtgggtctctggatccgaggtgggtattagttggtggtgactctagtcctccaccttcctcccgtcgccccgttctacgttcccgtggaacgtccggcccggtccctacctatcctccgtcgacgtaagttcctaacgtacgacgaccgtccctacctaacgtaagttaagtaacgtacgggtaacctaacgttaaaccgtttaggttttacggtaacgtttaccgggttaacccgtaggtacaaacggaacggtacccggaacgggtcctacggtaccctacccgaacgtacggtcccttaccgtagtacttacgtttacggtttcggttacgtaaccggtccgggtcccgtcccgggtccgtagtacggtagtacgaggtcgagtaggtgtacgtacgacgactacgtagttattacaagtaanaactagaacgtaggtaggaggacgtgtagggtagttaggttggtttaggttactaggtntacgagtacgaacgtactactaccgtaacgtaacccgttccgaacggtacgggttaccgggaaggtacggaacggtaagggtacgtaaccgtaaccggtaacgtaaccggttagcgggttaaccgccgttaccgaccgtacttcgtaccctttactcccgttacgttacccg

SEQ ID NO: 160010 - DNA, 828 bp, Homo sapiens
  misc_feature: GYAE6OF01AI97J.19.83.H06.1.454.CMB.1.raw
  modified_base (237)..(237): a, c, t, g, unknown or other
  misc_feature (237)..(237): n is a, c, g, or t
  modified_base (815)..(815): a, c, t, g, unknown or other
  misc_feature (815)..(815): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtgggatattgtggtgactcagtctccactcctccctgcccgtctagttccgtgggagacgcccggcctccatctcctgacctaagtcctagtcagacgtcctacctanagtagtaacgtcggaacctaactaactttagtttaggatttacgggtacctggaccaaggaacgaccgagggtacctaacgtccctacccaacgacgtccttccgagtactttccgttagttttcgggttaccgtaaccggtccccggggtcccggttcccggggtccctaggaccggttacgggttacgacggttcgggacgtaggttaggtacgtacggacggtactaaccgtaagtttaactttaaccgaacgttaacgtaaaactcgaaacggtaagggtacgggtaagggtacgggtacgttaggggtacggtttaggttttacggggtttaagggttttacctacggttacgcgttaaaggtccggtaaaccgttacgttaccccgttaaacccttaacccgttaaaccccgttccccgggttaacccggtaaaccgggttcccggggtaaccggggtaaacgggtacccgtaaaggggacgtaaaccgttaacggtaaacccggtaaacggttcccgttaagggcccggtacgtaccgtacccgtaacgttacggtacgtttccgttaccnccggtttaccccg

SEQ ID NO: 160011 - DNA, 680 bp, Homo sapiens
  misc_feature: GYAE6OF01BLAEQ.19.83.H06.1.454.CMB.1.raw
  modified_base (168)..(168): a, c, t, g, unknown or other
  misc_feature (168)..(168): n is a, c, g, or t
tcagtactctcgtgcacgaccggtgctcgatttagatcacgtgcgtcgcgggcgtagactttgtgtttctcgtagtctgctttgctcagcgtcaggtgctgctaatgctctggtctctggatccagtgggatattgtggtgactcagtctccactctccctgcccgtnattcctggagacgcccggcctccatcctcctgcaagtctagtcagacgcctcctacatagtaactggacactaacttagtttggatttcggacctgacaggaagccagggctagtcctaccacacgtcctccgtagacttcgttagtttcgggttctaacgtccgggtcccgttccggggtccctggaccgtaggttcaggtcggcaggtggactcgaggctacgtacgtattttacactagaaactcgaacgtagtacggtggaggtctaggtaaggtagttggtttacgggtttatacgtgtactagtcgtacgtaacgtcttaaccgtaacctaaaccgtccccgtaacggttaaccggttaccggggtaccggaacggggttaacccgtaaggggttacgggtaaacgtaaccggtaaccgtaaacgggttaaccgttgggttaccggtaccgtaccggtacccgtaaccgttaccttaaccggttcgttacccgtttccgtaacccg

SEQ ID NO: 160012 - DNA, 842 bp, Homo sapiens
  misc_feature: GYAE6OF01AQJYS.19.83.H06.1.454.CMB.1.raw
  modified_base (179)..(179): a, c, t, g, unknown or other
  misc_feature (179)..(179): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctcgtggatccaggtggggattagttggtggtgactcagtcctccactcctcccgtgcccgtntacttccgtggacgcggcccggccttccatcctcctcgactaacgtctacgtaccaggtacgtccctacctaactaagtaagtaacgtacggaccaacgtaacttagtttggtacgtttacggtcctacgacaggaacggccgagggcctacgtcctcccgacacggtccttaccgtagttacgttcgtttaggttttacgggtacttaaaccgggtcccggggtcccggttacccgggtcccgtagtacggtacggttacggtaggtcgggtactacggtacggtactaccggacggtacgtaaacgttaacgtttaactttaaccgaacgttaaacggtaaaactacgaaacggtaacggtaacgggtacgggaacggttacggtaacggggttacgggttaaggttttacggggttttacggggtttttaacttacggtacgtaaccgttagtaacgtacgtaacgttacccgtaaccgtttaaaccaacccgttcccggttaacccgggtaacgggttaccgggtaacgggtaacgggtaaccggtaacgggtagtaaaccgtaacgttaaaccggtaaaccggttacggtacgggtcgaccgtaccgaaccttaccccgtacgttacccgggtttcttaaccggtttccttaccccgg

SEQ ID NO: 160013 - DNA, 718 bp, Homo sapiens
  misc_feature: GYAE6OF01AFCXV.19.83.H06.1.454.CMB.1.raw
  modified_base (141)..(141): a, c, t, g, unknown or other
  misc_feature (141)..(141): n is a, c, g, or t
  modified_base (174)..(174): a, c, t, g, unknown or other
  misc_feature (174)..(174): n is a, c, g, or t
  modified_base (682)..(682): a, c, t, g, unknown or other
  misc_feature (682)..(682): n is a, c, g, or t
tcagtactctcgtgcacgaccggtgctcgatttagatcacgtgcgtcgcgggcgtagactttgtgtttctcgtagtctgctttgctcagcgtcgagggtgctgctaatgctctgggtctctggatccaggtgggatattgnggtgactcacgtctccactcctcctgacccgtnacttccgtggacgacgcccggccttccatcctcctgacgaagttctacgtcgagacgtccctacctaagagttaagtaacgtcggaacctaactaacgtttagttttacggaagtttccggtaacctagacgtaacggaacgccggaacgggtctacggttccacccacgacgtcctccgtagacctttcgttaggttttcggtactacgtcccgggtccgttcccgggtcctggaacttggtacgaggtcgctaaggtgaactcgtacggactaacgtagttaacctttaacgaacgttaacgaaaactcgaaacgagggtacggagggtacggtagttaaggggaggttaggtttaggggtttaacggtttacctaggtcgacgtactacggacctaaggtcccttaaagtaacccgtaacctcccggtacgttaccgggacggaaccgggacggtaacgtacgggactaacccgtaagacccgtaaacggtgttcggccgtaacncgtaccctactcggtaccttacgtcttacgtacccg

SEQ ID NO: 160014 - DNA, 780 bp, Homo sapiens
  misc_feature: GYAE6OF01CO22E.19.83.H06.1.454.CMB.1.raw
  modified_base (147)..(147): a, c, t, g, unknown or other
  misc_feature (147)..(147): n is a, c, g, or t
  modified_base (177)..(177): a, c, t, g, unknown or other
  misc_feature (177)..(177): n is a, c, g, or t
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
  modified_base (454)..(454): a, c, t, g, unknown or other
  misc_feature (454)..(454): n is a, c, g, or t
tcagtactctcgtgcacgaccggtgctcgatttagatcacgtgcgtcgcgggcgtagactttgtgtttctcgtagtctgctttgctcagcgtcgagggtgctgctaatgctcgtgggtctcgtggatccgaggtgggatatgtggtnactcagtcctccactcctccctcgcccgtntacgttccgtggacgacggcccggtccctccactcctccgtagactaacgttctagtacgagtacctccctaccgaatagtaacgtagtagacctataacttagttggtagttcgtacgtganaacggaacgtccgaaggacncgtaccaccgacgacgtccttacgtagtacttacgtttaggttttcggttacctaaccggtcgggtccccggttacccgggtccgtacggtaccgtacggttcggaacggtcggtacggtaggtacgggtaacnccggtaacgtacccgtaaagttaagtttaacccttttaaacgaacttaaacggtaaactaccgaaagtagggtacggtagggtaacggtagtagggtacgggttaggtttagggtttacggtttaacgttaggtacctaggtacgtcgtaacgtactacccgtttaactaaacccgtcccgtaacccggttaaccggtaccgggtaccggggtaacgggaccgggtaacggttaaggtacggaaacgtaccgttaaaccgaaacggttagacggttcgacgaccgttaactaccgttaccttccgttcgttaccgttcgtaccccg

SEQ ID NO: 160015 - DNA, 1054 bp, Homo sapiens
  misc_feature: GYAE6OF01CPGAS.19.83.H06.1.454.CMB.1.raw
tcagtactctcgtgcacgaccggtgctcgatttagatcacgtgcgtcgcgggcgtagactttgtgtttctcgtagtctgtctttgctcagcgtcgagggtgctgctaatcgtcctcgttgggtctcgtggatccgaggtggggtattagttggtggtcgacctcgtacgtcctcctaccttcctcccgtcgtcccgtactacgttcccgtagggacgaccggcccggtccctccgacttccgtcccgtagaccgtaacgttaccgttaacggtaccgaacggtacccgtaccccttaaccgtaacgtaaagttaacggtaacggtaccggaacctaaaccgttaaacgtttacggttttacggtacgtttaccggtaaccctacggaaccggaaacggtaaccggacccggtaacgggtacccgtaccggttaccccctaacccgaaccggtacccgttcccgtttaccggttaaggtttaaccgttttaccggttttttaacggggtttttaccggggtttaacccggttaaccccgggggtttccccccggggttacccccggggttttacccccggggttaacccgttacgggtaaccggtttacgggtttacggtacgggtacgggtaacggtacggttacggtaccgtaccggaacggttaacgtaacgtttaaaccgttttaaaccgttaacgtaaaccgttaaacgtaaaccgtaaccgggtaacgggtagggtaacggggttaacgggtacggttaaccgggttaaggggtttacgggttttaaggggtttttacgggttttaacgtttaaccggtacgtacggtaacgtacgtaaccgtaacgttaacccgttaacccttaacccgtaacccgttaccccggttaaccgggtaacggttaaccggggtacggaaacgggtacgtaacgggttaggaccggtaaacgtaaccgtaaacggtccggtaggtaccggtccgtaccgtacccgttaccgttaaccggtttcgttacccggttaccttcccggtaaccccgtttaccccg

SEQ ID NO: 160016 - DNA, 682 bp, Homo sapiens
  misc_feature: GYAE6OF01EBKLV.19.83.H06.1.454.CMB.1.raw
  modified_base (146)..(146): a, c, t, g, unknown or other
  misc_feature (146)..(146): n is a, c, g, or t
  modified_base (167)..(167): a, c, t, g, unknown or other
  misc_feature (167)..(167): n is a, c, g, or t
  modified_base (174)..(174): a, c, t, g, unknown or other
  misc_feature (174)..(174): n is a, c, g, or t
  modified_base (224)..(224): a, c, t, g, unknown or other
  misc_feature (224)..(224): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtgggatattgtgtgactnagtctcactctccctgccctnattccgnggagtacgccgcctccatcctcctgcaagtctagtcagacgcctcctaanatagtaatggaaccacaacttattggagtttcggtacctgcagtacgccagggtcagtctccanacgcttccngtatcgtattttgggtctaagtccgggtccgtccgggtccctagacgtaggtcagtgcgtacgtggactcgaggcactaggtacttttaacgacttaagaaaacttacgaacgtacggtaaggttacgggacgggtacgttaaggaagggttagtttaggtttagggggtttttaattacgtaggtaactacgtagaccgttaacggtacttaacccgtaaaccgttaaacccgttaccccgttaacgtaaaccgggtttccgggaacgggtaccggggtaaaccgtacggggttaggtaaggtaccgtaacgtaaaccgggtaacgtcggtacggtccgtaccgaacctacccgtagttacccttaggttccttactaccccgg

SEQ ID NO: 160017 - DNA, 790 bp, Homo sapiens
  misc_feature: GYAE6OF01EPIVS.19.83.H06.1.454.CMB.1.raw
  modified_base (100)..(100): a, c, t, g, unknown or other
  misc_feature (100)..(100): n is a, c, g, or t
  modified_base (187)..(187): a, c, t, g, unknown or other
  misc_feature (187)..(187): n is a, c, g, or t
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
tcagtactctcgtgcacgaccggtgctcgatttagatcacgtgcgtcgcgggcgtagactttgtgtttctcgtagtctgctttgctcagcgtcgagggtnctgctaatggcttcgtgggtctcgtaggactccgaggtggggattagttggtggtagactcagtcctccacgtcctccctgcccgtnattcgnggancgccgcctcatctcagctaagtctagcaggactccctactactagtagtaagtcggaacctactaagtttagttagggactttacgggacctgaccgaaggacgccgagggtcaacgttcctcccaagacgtccttacgtacgtactttacggtttacggtttcggttaaccgtaaccgggtcccggggtccccgggtaccccggggtttaccagggtaaccgttcggttacggacggtacggcgtaacggtcgtaacgtaccgtacggaactaacggttaaacgttttaacctttaaacggaaacgtaaaggtaaacctaccgaagtagggtaggttacgacggtcgtagggtagtttaggtttagggttttaggtttaaaccctgagtacctaggtacgtaaacgtaccggtttaccctaaaccgtaacccttaacccgttccggtttaaaccggggtacggggttacccgggaaacggggaaccgggttaaacggagggttaaccggaaataaccggtaaaccgtaaacggtgggtcggtaccggctaacgacccgtacgttacgttctacggtttcctacgttaccccg

SEQ ID NO: 160018 - DNA, 731 bp, Homo sapiens
  misc_feature: GYAE6OF01DYY2H.19.83.H06.1.454.CMB.1.raw
  modified_base (308)..(308): a, c, t, g, unknown or other
  misc_feature (308)..(308): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggattattgtggtgactcagtctccactcctccctcgcccgtctattcctggacgacgcccggcctccatcctcctgacaagtctagtcagacgtcctacctacataagtaatcggacaacctaacttagttggtattacggtacctgacaaggaacgccgaggcacgtctccacncgtcctccgtagtacttcttagtttcggtactaacggtccgggtcccgtcccgggtcctcgacgtacggttcgaggtcggacgtaggtcgactacggacggactaacgtaagttaactttaacaacgttaaagaaactacgaaacgtaggaacggtagggacggtaacgtagggtaaggttaggtttacgggttttaggggtttaacttacggtagtactaaggttcgaacgtaacctaccttaaacctaaccctaacccgttacccgttaacggtaacccgggtttacggggaacggggtaaccggtaacggtaacggtacgggaaaacgtaacgtaaaccggtaaaacggttacggtacggttacggaccgtaccgaacccgtaccgttaacttcccgttactttcccgttacctaacccg

SEQ ID NO: 160019 - DNA, 732 bp, Homo sapiens
  misc_feature: GYAE6OF01B08BF.19.83.H06.1.454.CMB.1.raw
  modified_base (99)..(99): a, c, t, g, unknown or other
  misc_feature (99)..(99): n is a, c, g, or t
  modified_base (175)..(175): a, c, t, g, unknown or other
  misc_feature (175)..(175): n is a, c, g, or t
tcagtactctcgtgcacgaccggtgctcgatttagatcacgtgcgtcgcgggcgtagactttgtgtttctcgtagtctgctttgctcagcgtcagggtnctgctaatgctctgggtctctggatccaggtggggattattgtggtgactcagtcctccactcctccctgcccgtnacttccgtaggacgacggcccggcctccactctcctgctaagtctagtcagaccgtcctacctacatagtaagcggacaactacttagttggacttcggtacctgacgaggaacgccgagggcctacgtcctaccacgtagtccttcctaggtacttacgtttaggttttaccgggttactaacggtcccggggtaccccggttcccggggtaccccttaggtaccggtacggttcgaaggtcgggagtaaggtcggactacggacgtacgtaacgttagtttaactttaccaacgttaacgaaactacgaacgagggtaggtcgggtacggtgtaagggaacggttgggtttacggttttaagggtttacttaggtacgtagtacgtacgtactaaccgttcttaaccgttaaccgtacccttcccggtaaccgtaaccgggtcgggacgggtaaccggtaacggagggttaacgaacgtaaacgtaaccggtaagtaaccggttggaccgtcgaccgtacccgtacttacgtccggttcttcccttcgtaccccg

SEQ ID NO: 160020 - DNA, 847 bp, Homo sapiens
  misc_feature: GYAE6OF01EZKA4.19.83.H06.1.454.CMB.1.raw
  modified_base (190)..(190): a, c, t, g, unknown or other
  misc_feature (190)..(190): n is a, c, g, or t
  modified_base (469)..(469): a, c, t, g, unknown or other
  misc_feature (469)..(469): n is a, c, g, or t
tcagtactctcgtgcacgaccggtgctcgatttagatcacgtgcgtcgcgggcgtagactttgtgtttctcgtagtctgctttgctcagcgtcgaggtgctgctaatgctcgtgggtctctggatccgaggtggggattagttggtggttcgactcagtctccactctcccgtgcccgtctactttccgngggacgcgcccggtccctaccacttcctccgtgtaccgtaacgttccttaggtccaacggtaccgtcccttaccctaacgtaacgttagtaaacgttacggtaaaccaaccgttaacttttagtttacggttaagtttacggtaccctgtaacgaacggaacgccggaacgggtcctaacgttccctaaccgacgtcgtacctcgtagttactttcgtttagtttcggtacgtacggtcccggttccgttcccggactggtcgtacggttacaggtcgngtacgtgtactcggacgactcggtaagtttacgtttaccacgtaaagtaacgtacgaacgtaggtacggtacgggttacgtggttaacgggtaacggtttagtttacggggtttacggtttaacttacggttaccggtagtacggtaacgttaaccggtacgttaccgttaaacccgtaaccgttaaacccgttaccccggttacgggtaaacccggtttacggggaaacccgggttacgggtaaacccgggtaaacgggttaacggtaaccggtaaaccggttaaaccggaaacggtttaccgtcgggttaaccgtaacggtcccgtaacgttaccgttaccttacgttttaacgtttcccgtaccgtttaccccgg

SEQ ID NO: 160021 - DNA, 873 bp, Homo sapiens
  misc_feature: GYAE6OF01CLNMN.19.83.H06.1.454.CMB.1.raw
tcagtactctcgtgcacgaccggtgctcgatttagatcacgtgcgtcgcgggcgtagactttgtgtttctcgtagtctgctttgctcagcgtcgagggtgctagctaatgctcgtgggtctcgtggactccgagggtaggggattagttggtggtcaaccttcacgttcctaccctaccttccgttccccgtcggtcccccgtactaacgtttcccgtagggaacgggacccggcccccgggtaccccttacccgtacgttccccttacccgtcggtaccttaaccggttaccgttaacggtaccgaaccgtaaccgtccccttaaccccttaagtaaacgtttaacggtaacgtaccggaacctaaccttaagtttacgtttagggtactttaccgggtaccctagacggaacggtaacggacggcgggtactacgtccgtaccacgtcctccgtcctagttacttcgtttaggtttacggtacttaccggtcccgggttcccggtccgggtcctacggtcgtacggtttcgacgtccggagtggagtacgtacgacggtaccagttaacttaacgttaccgaagtaaacgtaacaacgaaggtaggacgggtagggaccgtaggtaggttaacgggttaggttttacggggtttaacggttacttcggtacgcgttaagacggttacctaacgtacccttaaccgtaaacccgttaccgtaacccgtcgggttaaaccggtcgggaaccgggtaacggtaacggtacggaggtaaacccgttagaaaccggtaaacggtcggtacggttccggacgtaccgtaaccccgttaggtacccgttacggtttacttcccgtaacccgttacccg

SEQ ID NO: 160022 - DNA, 566 bp, Homo sapiens
  misc_feature: GYAE6OF01AVL3P.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagagcctcctacatagtaatggacacaactatttggattggtacctgcagaagccgagggcagtctccacagctcctgatcttagtttgggttctaagtcgggccgtccgggtccctgactaggttcagtggcaggtgggatcgaggcactacgtattttacactgaaatcaacgagagtggaggtctagaggtagttggtttaggggtttattacgtgactagtcgcaacgcttacaacctaaccctccctacgaccggtttcggacgggtacgggaccgtaagggtcggaagactacgaaaccgtacgtggtcggtactacgacctaccgtactcgtcgttcttcgtacccg

SEQ ID NO: 160023 - DNA, 738 bp, Homo sapiens
  misc_feature: GYAE6OF01ALICW.19.83.H06.1.454.CMB.1.raw
  modified_base (236)..(236): a, c, t, g, unknown or other
  misc_feature (236)..(236): n is a, c, g, or t
  modified_base (313)..(313): a, c, t, g, unknown or other
  misc_feature (313)..(313): n is a, c, g, or t
tcagtactctcgtgcacgaccggtgctcgatttagatcacgtgcgtcgcgggcgtagactttgtgtttctcgtagtctgctttgctcagcgtcaggtgctgctaatgctctgggtctctggactccgaggtggggatattgtggtgactcagtctccactcctccctgcccgtctattccgtggagacggcccggccttccatcctcctgactagtctagtcagcgtcctacctanatagtaagtcggacaacgtaacttagtttcggtattcggtacctgacgagaacgccgagggctacgtcctacccacncgtcctccgtgtacttcgtttaggtttacggttactacggttcccgggtccccggttcccgggtcctagtacgttacggtcgaggttcggacgtggtaggactcggacgtacaacgtattaacgtttacgaaacgtaacgtaaacgacctaacggtaggtacgggtagggtacggtaggttacggggtaaggtttacgggttttacgggttttaacggggtttttactacgtacggtccgaggttaccccgaagtaaccgttacccgttaaccgtaaacccttacccgtcccgttaacgggtaccgggttacggggaaccgggtaacggaaccggtaggtacgggtaaacgaaccgtaaccgtaaacggtaggtcggtcgtaccgacgtacgtacctcgttaggttccgttaccgttctacccgg

SEQ ID NO: 160024 - DNA, 838 bp, Homo sapiens
  misc_feature: GYAE6OF01CBP7F.19.83.H06.1.454.CMB.1.raw
  modified_base (182)..(182): a, c, t, g, unknown or other
  misc_feature (182)..(182): n is a, c, g, or t
  modified_base (190)..(190): a, c, t, g, unknown or other
  misc_feature (190)..(190): n is a, c, g, or t
tcagtactctcgtgcacgaccggtgctcgatttagatcacgtgcgtcggcgggcgtagactttgtgtttctcgtagtctgctttgctcagcgtcagggtgctgctaatgctcgtgggtctctggatccgaggtggggattagttggtggtgactcagtcctccactcctcccgtcgcccgtntattccgnggacgcgcccggtcctccattcctccgtgacaacgttcgtagtccgaacgaccgtccccttacctaactagttaagtaacgtacgggaacctaaaccgttaaacgttttaggtttacgggtacgttttaccgggtaccccttaggaaccgtaaaggtaaccggacccggtaaggggtcccttaaccggttcccctaacccgaaaccgtaccggtccctttaccgtagtaacgttttccggtttacggtttttacggggttacctaaccgggttccccggggtccccgttacccggggttaccctaggaccggttacggttcgaaggtcggacgtaggtacgtaagtaccgaaggtcctaaacgttagtttaactttaacgaaacgttaaagaacctacgaacggtaggtagggtacggtagtcgtaagggtaacggttaggtttgggttttaacgggtttaattccggaagtactaggtacgaaccgtaagtcctaaacgtaaccctaaccggtacccgtaggtaaccgggttaccgggaacgggtacggtaaccggaagggtacgaaacgtaccgaaacggttaacggtacgttggtaccgcgtaacgacccgtaacttcgttaccgttcgtaaccgtccttaccgg

SEQ ID NO: 160025 - DNA, 847 bp, Homo sapiens
  misc_feature: GYAE6OF01CW63E.19.83.H06.1.454.CMB.1.raw
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
  modified_base (320)..(320): a, c, t, g, unknown or other
  misc_feature (320)..(320): n is a, c, g, or t
  modified_base (551)..(551): a, c, t, g, unknown or other
  misc_feature (551)..(551): n is a, c, g, or t
tcagtactctcgtgcacgaccggtgctcgatttagatcacgtgcgtcgcgggcgtagactttgtgtttctcgtagtctgctttgctcagcgtcgaggtgctgctaatgctcgtggtctcgtggactccgagggtgggattagttggtggtcgactcgagtccctaccctaccttccctcccgtcggtccctntacttccgngggacgccggcccgcccttaccnttcccttaccgagacgtaacgttcgtacgcaaggcctacccttacaagtataagtagacggaacctaacgtaatttggttaggtacttcggtaccnggaacaaggaaccgccggtaggcctacgtcaccactcgtccttcctagtactttaacgttggttttccgggaacttaccgggttcccgggccccgggtttacccggtctaacggtaccggttagggttaccgaggtcggaacggtaggtcgtaactccgaaggttacgtaacgtaagtttaacgttacaagttaaacgaaactccgtaaagtacgggttaggacgggtaanaccgggtggttaacgggttagggttttagggttaacgttttacgtacggagtacgtaaccgtaacggtacgttaaacccggttacctttaaccccaaaaacccggtttcccccgttaaaccgggtacccgttaaacccgggggtcggggaaaaccgggtaagggtaacccggtaagggttaaccgaaacggttaaaccccgaaaacggggttacggtaacgttcggttcggaacccggttaccgtaacccgtaccgtttcggtttaactttcccgggcctttaaccgtaccccccg

SEQ ID NO: 160026 - DNA, 826 bp, Homo sapiens
  misc_feature: GYAE6OF01EDUAE.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtgggatattgtggtgactcagtcctccacttcctccccttcccgtctacttcccgtgggacgacggcccggtccctccactcctccgtgactaagttctagtccgagacgtccctacctactagttaagtaacgtcggaactaacctaaactttagttttaggtaacgtttacggttacccgtgaccgtaaggaacggaccggaaggggacctacggtacctacccaacgtacgtcctaccgtacgtactttacgtttagttttcggggtttaaccgtaaccggttcccggggtccccggtttccccggggtcccttacgggtaaccgtacgggtttcgacggtcgggacgtaagggttcggtaacgtacccggacgggtaaccgtaacgttaaacgtttaaacttttaaccgaacgttaaacgtaaaaacctacggtaacggtaaggttacgggtacggggtacggtacggttaacgggtaagggttacggtttaggggttttaagggttttaacgtacggtacgtcgtagtaccgaacgtacgtaccttaaccgtaacccttaaccgttacccgtacggtaaccggtacggggacggtaacgggacgtaagggtacgagtaacgtaaccgtaacggtacgttggacgtccgaccaccgtacgttacgtacgttcgttaccttcgtccttaccccg

SEQ ID NO: 160027 - DNA, 757 bp, Homo sapiens
  misc_feature: GYAE6OF01AYAN7.19.83.H06.1.454.CMB.1.raw
  modified_base (174)..(174): a, c, t, g, unknown or other
  misc_feature (174)..(174): n is a, c, g, or t
  modified_base (284)..(284): a, c, t, g, unknown or other
  misc_feature (284)..(284): n is a, c, g, or t
tcagtactctcgtgcacgaccggtgctcgatttagatcacgtgcgtcgcgggcgtagactttgtgtttctcgtagtctgctttgctccagcgtcagggtgctgctaatgctctgggtctctggatccaggtggggatattgtggtgactcagtctccactcctccctgcccgtnacttccgtggacgacggcccgccctccactcctcctgaccaagtctagtcagacgccctacctactaatagtagtcggaacaactaacttagtttggacgttcggtaccngacaagacgcgaggctacgtcaccgacgcgtcctaccgtgtacgttctttaggtttcggttacctaacggtcccgggtacccgttcccggggtacctaggacgtcggttacgaggttcggcgtgggtacgtagtcgacggactacgtaacgtttacttaacgacgtaaagaaacgtacaagtagggtaggtggacggtacgtggtaaggttacggtttgggttttaggtttacgtacgttcggtactaggtacgtacgtaacgttaccgttaaccctaaacccgtacccgttacccgtaccgggtttaccgggtttacgggacggggttaaaccgggaaccggttaaacgggtcgtaaaccggttaaccgtaaaaccggaaccggttaacgggttcgggtacccggaacgttacccggtaacctaacccgtttacgtttaccgttacccggttccttaaccgtttacccccgg

SEQ ID NO: 160028 - DNA, 754 bp, Homo sapiens
  misc_feature: GYAE6OF01ERJFJ.19.83.H06.1.454.CMB.1.raw
  modified_base (141)..(141): a, c, t, g, unknown or other
  misc_feature (141)..(141): n is a, c, g, or t
  modified_base (225)..(225): a, c, t, g, unknown or other
  misc_feature (225)..(225): n is a, c, g, or t
  modified_base (255)..(255): a, c, t, g, unknown or other
  misc_feature (255)..(255): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (645)..(645): a, c, t, g, unknown or other
  misc_feature (645)..(645): n is a, c, g, or t
tcagtactctcgtgcacgaccggtgctcgatttagatcacgtgcgtcgcgggcgtagactttgtgtttctcgtagtctgctttgctcagcgtcgagggtgctgctaatgctctgggtctctggatcgagtgggattattgnggtgactcagtcctccactcctccctgcccgtctagttcctggagacgcccggcctccatcctccgtgcaagtctagtcagacncctactacatagtaactgaacactaagttntttgggattacggtacctgacgagaacggccgagggccagttccccacacacggtcttccgtagatttccgtttaagtttgggtaccttaacgggtcccgggtccccggttaccgggtcccaggtaccgttaggttacgnggtacggntacggtgatccgggaaggacctaacgtagtttaaacgtttaacgaaacgtaactaaacgtaccgaaacgtacggtagggtagggacgttacgtaaggggtaagtaggtttacgggtttttagggtttaactcgtaagtcgttaagtacccgtaacagttaccctaaacgtaacccttaaacccccgtccgttagggtaacccgggttgggaacccggggtaccggaaacgttaacggggtanaaacggttaacgtaaaacggtaacccgtaaggtttcggccggtaccggttaccaacccggtaacctttacggtacttttccccgtttcccgtttaaccggtttaccccg

SEQ ID NO: 160029 - DNA, 592 bp, Homo sapiens
  misc_feature: GYAE6OF01C7X88.19.83.H06.1.454.CMB.1.raw
  modified_base (171)..(171): a, c, t, g, unknown or other
  misc_feature (171)..(171): n is a, c, g, or t
  modified_base (177)..(177): a, c, t, g, unknown or other
  misc_feature (177)..(177): n is a, c, g, or t
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
  modified_base (234)..(234): a, c, t, g, unknown or other
  misc_feature (234)..(234): n is a, c, g, or t
  modified_base (284)..(284): a, c, t, g, unknown or other
  misc_feature (284)..(284): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgccctnattccnggagcgcccggcctccatcctcctgacaagtctagtcagacncctctanatagtaanggacacaatattggattggacctgcagaagccagggcacgtctccaacgngctcctgtacttcgttagttttcgggttctaacgtccggggccctcccggggtaccctggacgtaggttcgaggtgcgagtggatcgaggcatagtattttacactaagaactacaagagtagggtcgaaggctaggaggtagttcgggtttaggggtttatacgtggctagtcgactagtcctaactaaccaaccttcccgtagtaccggtttacgggacggacggtaaccgagggttagaggtaactaccgaaacgtacgtggtacgcgttacgacctacgtaactcgttacgtccttataccccg

SEQ ID NO: 160030 - DNA, 898 bp, Homo sapiens
  misc_feature: GYAE6OF01AEQW3.19.83.H06.1.454.CMB.1.raw
tcagtactctcgtgcacgaccggtgctcgatttagatcacgtgcgtcgcgggcgtagacttttgtgtttctcgtagtctgctttgctcagcgtcagggtgctgctaatgctctgggtctctggatccaggtggggatattggtggtgacctcagtcctccacctcctcccctgccccgtcacttccgtggagacgcccggccctccatcctcctgacaagtctagtcagacgcctacctacatagtaagtcgacactaacttagttgattcggtacctgacagacgccgaggctacgtcctccgacacgtcctccgtacgtacttcgttacggttttcgggttaccgttaaccggtccccgggtcccccggttccccgggggttccccttacgggtaacgttacggggtttacgtaggggttaccggtacggtagggttacgggtaacctaaccggtacggacccgtaaacgttaacggttttaaaccgttttaaccgtaaaaccggtttaaaggaaaaacccgttaccgaaaccgggtagggttaacggggtacggggtaaacggggttcgttaaacggggaacgggttttacggtttaagggggtttttacggggtttttaacttaccgggtacgtaacgttacgtacggtaacgttaacccgtaaccgttaccccgttaaaacccttacccgttaccccgtttaaccgggtaaccggggttttaccggggtaacggggtaaacccgggtaaaccggttaagggggtaaccggtaaacgtaaacccgggttaaaacggtaaaacccgggttagttacggggtaccgggttaccgtaccgaacccgttaacccgttacgttacccgttccgtttaccgtttacccggttaacccccg

SEQ ID NO: 160031 - DNA, 890 bp, Homo sapiens
  misc_feature: GYAE6OF01DGDJD.19.83.H06.1.454.CMB.1.raw
  modified_base (183)..(183): a, c, t, g, unknown or other
  misc_feature (183)..(183): n is a, c, g, or t
tcagtactctcgtgcacgaccggtgctcgatttagatcacgtgcgtcgcgggacgtagactttgtgtttctcgtagtctgctttgctcagcgtcgagggtgctgctaatgctcgtgggtctctggatccgaggtggggtatagttggtggtgactcagtcctccacttcctccctcgcccgtnactttccgaggacgacgcccggtccctacatcctaccgtgactaacgtctacgtcaagacgtcctacctatagtaagtacgacgactaacctaagttagtttggtactttacggtaccctaggaccgtaaaggaaccggacccggaacggggtcctaaccgttcccctacccaacggtaccgtccttacccggttagtacttttacgttttacgggttttacgggtttaacccggttaacgggttcccccggggtccccggggttacccccggggttccccgtacgggtaaccgttcgggtttacgaagggtcgggtaccggtaaggtcggaccggttacgaaggtacaacggttaatttaaccgtttaataaaccgtaaggaaaacctaacgtaaacgggagggtaagggtacggggaacggttacggttagggttaagggttaagggttttaccggggttttaaagggttttaccgtaaccgtttcgaacggttactacccgggtaataccggttacctttaaacccgtaaacccttaacccgttcccgggttaaccggttaaccggggtacccgggtaacgggtaccggtaacgggtaacggtacggtaaacgtaaccggaaccgggtaaaaccggtagtacgggtacggtacgtacccgtaccctacgttaacgttccgttactttaccgtcccgttcccggg

SEQ ID NO: 160032 - DNA, 691 bp, Homo sapiens
  misc_feature: GYAE6OF01EUY0K.19.83.H06.1.454.CMB.1.raw
  modified_base (216)..(216): a, c, t, g, unknown or other
  misc_feature (216)..(216): n is a, c, g, or t
  modified_base (283)..(283): a, c, t, g, unknown or other
  misc_feature (283)..(283): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatcctcctgcaagtctagtcagngcctcctacatagtaatcggacaactaacttattggattggtacctgacagaagccgagggcagtcncacagctctcgattcgtagtttcggtacgttaacgtccggggtccccgttccggggtcctaggtacgacggttcgacgtggcgaggtcggatccgacggcactagttactttacaaacgttagaaactaacgaacgtaggtagggtaggtacggtacggtaaggtacggttacgggattttagggggttttaacgggtttacttacgtacggtaactacgtacgtacgtaacgtaccgttaacctaaacccgtaacccgttacccttacggtaacgggttacggggtaccgggtaacgggtaaccggtaagggtacggtaacgtaaccgtaaacggaaaccggttaacggtcggttacggtacgtacccgaaccgttaccgtacgtttccgttccgttcgttaacccg

SEQ ID NO: 160033 - DNA, 1088 bp, Homo sapiens
  misc_feature: GYAE6OF01C9J9U.19.83.H06.1.454.CMB.1.raw
  modified_base (98)..(98): a, c, t, g, unknown or other
  misc_feature (98)..(98): n is a, c, g, or t
  modified_base (183)..(183): a, c, t, g, unknown or other
  misc_feature (183)..(183): n is a, c, g, or t
tcagtactctcgtgcacgaccggtgctcgatttagatcacgtgcgtcgcgggcgtagactttgtgtttctcgtagtctgcttgctcagcgtcagggtnctgctaatgctcgtgggtctcgtggatccgaggtggggattagttggtggtgacctcgtacgtcctccactcctccctgcccgtnacttcccgagggagcggccccgtcctacctactcctaccgtgactaacgttccgtaacgtcgaacggtaccgtcccttaccctaaacgtaagttaaacggttaacgtacgggaacccctaaacgttaaactttttaggttttacgggacgttttaccgggtaacccgttcggaaccgaaacggtaaccggacccgggtacggggtaccgtaaccggttccccctaaccgtaacgtccgtcccgtttaccgtaggttacctttaccggttttaagggtttttacccgggtttaaccgtaaccgggttccccgggggtacccccgggtttcccccgggggttacccgttaaggtaacccggttacgggggtttacccgaacgggtcgggtaaccggtaggggttaccgtaccgttacggggaaacccgtctttaaccggtaacggtttttaacccgtttaaacccgaaagttaaaaccggtaaaacccgttaaccggtaaacgtaccggggggtaaggggttaccggggaacggtttaccgggtaaaggggttaaggggttttaaacgggttttacggggggtttttttaccggggtttaaatttacccgggtacggttaacggtaaccggtttaccggtaacccgttaaaaccggttcccctttaaaacccgttaaaccccggtttaacccccggttacccgttaaacccggggtttacccggggtaacccggggtaaccggggtaaaccggggtaacgggttaacgggttaaccgggtaaaccttaacgggttaaaacccgtaaacggggttaaccgggttcggttaaccggggacccctttaccgggaacccgtaaactttcgttaacccggttacgttttaccccgttaccggttaacccccg

SEQ ID NO: 160034 - DNA, 816 bp, Homo sapiens
  misc_feature: GYAE6OF01CCSTC.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccgaggtggggattagttggtggtgactcagtcctccactcctccctgcccgtcattccgtggagacgccggcctcatcctcgtgactaagtctagtcagaccgtcctaccatagtaagtactacggacaacttaacgttagttggtattacggtacctgactaacgaacgccgagggctacgtcctcgactacgcctcgtagtacgtttcgtttaggttttcgggttaccgttaccgggtcccgggtcccggttccccggggtaccctacgggtaaccgttacgggttacgtaacgggtcggtacggtaagggtcgtaaacgttccggaacggtaccgttaacgtaaacggttttaactttaaccgtaaacgggttaaacgttaaaaccgtacggaaaacgttagggtaaccggggtagggtaacgggttacgggtaagggttaaggtttacggttttagggggtttttaacgggtttacttacggtacgtacgttaacggttacgaaccgttacgtaccgtttaaccgaacccgttaaccccgttcccggtaaccgttaccggggtaccggacggggtaacggtaaccggtaggggtaccgtaacaaaccggttaaccggaaacggttacggttggtcccggtacgccgtaactcccggttacttccggttacttccggtacctaccccg

SEQ ID NO: 160035 - DNA, 915 bp, Homo sapiens
  misc_feature: GYAE6OF01BUCEM.19.83.H06.1.454.CMB.1.raw
  modified_base (144)..(144): a, c, t, g, unknown or other
  misc_feature (144)..(144): n is a, c, g, or t
  modified_base (173)..(173): a, c, t, g, unknown or other
  misc_feature (173)..(173): n is a, c, g, or t
  modified_base (222)..(222): a, c, t, g, unknown or other
  misc_feature (222)..(222): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtnactcagtctccactcctccctgccccgtnattccgtggagacgcccgcctccatcctcctgacaagtctagtcagacnccctcctaacatagtaagcgacactaacttagttggatttcggtacctgacgagaagccgagggacacgtcacccacgacgccttacctgtacttactttaggttttcggggtttacctaacggttccccgggggtccccgtttaccccgggggttacccctacggtaaccgttacggttaccgtaggttacgggcgtaagggttaggaacgtaccgaacggccgtaaccgtaagtttaactttaacgaaccgttaaaggtaaacttaaccgaaaccgtaagggtacgggtagggtacgggtacgttaaggaaggggttagttttaacgggggtttttaggggtttttaaaccttttacggacggttacgttaacggttacggtaaccgttaaccgtaacccgtttaaacccttaaaccgttaaacccccggttacccccggttaaaccgggttaaaccccggggtttacccgggggaaaccgggggtaaacccggggttaaccccgggtaaaaggggttaacgggtaaaccgggttaaaacccggttaaaccgggtaaaaacccggttacgggttaaccgggttacccggggtaaccccgggttaccgtaaaccccggttaaacccccgtttaaggtttaaccccccggttttacccggtttacccgtttaacccccgttttaaacccccgg

SEQ ID NO: 160036 - DNA, 943 bp, Homo sapiens
  misc_feature: GYAE6OF01A7Q6X.19.83.H06.1.454.CMB.1.raw
  modified_base (179)..(179): a, c, t, g, unknown or other
  misc_feature (179)..(179): n is a, c, g, or t
  modified_base (186)..(186): a, c, t, g, unknown or other
  misc_feature (186)..(186): n is a, c, g, or t
tcagtactctcgtgcacgaccggtgctcgatttagatcacgtgcgtcggcggggcgtagactttcgtgtttctcgtagtctgctttgctcagcgtcaggtgctgctaatgctctggtctctggatccgagtgggattagttggtgttgactctagtctccgtactcctccctgcccgtnattccgnggacgcgccgtcctcatcgtaccgtgaccgtaaggttctagtccgagcgtcctctactagtaggtaactacggacctactaactttagttacggtagttcgtacctaggaccgtaaggaacggtccgagggtacctagtaccgtacccgaagtcgtaccgttcccggtagttacgttaccgtttaaggtttcgggttaacctaacggttccccggggtcccggttcccggggtaccttaggaaccgtagggttaccgagggttgacccggtaggttacggacctgggaacgtaccgtaaacgttacggtttaacttttaaccgaacgtttaaacgaaaacgtaccgtaaacggtaacggtaaggggtaacggtaaggtaccgttaacgggtaacgggttttaaccggtttaacgggggtttttaagggttttaaccgttttaacgggtacggttaacccgttaagttacccgggttaaacggtaacccgtttaacccggttaaaccctttaaacccgttaaaccccggtttaaccccgggtttaaacgggttaccccgggttaaccggggggtaacccggggtaaccggggtttaaaccgggttaaacggggttaaacggtaaccggtttaaaccggttaaaaccccgggtaaaccggttaacgggttccggttaacccgggtaaccgtaaccgggtaaccccttaacgggttacctttaccgggttccttaacccggtttacccgttaacccccgg

SEQ ID NO: 160037 - DNA, 573 bp, Homo sapiens
  misc_feature: GYAE6OF01DVKHG.19.83.H06.1.454.CMB.1.raw
  modified_base (132)..(132): a, c, t, g, unknown or other
  misc_feature (132)..(132): n is a, c, g, or t
  modified_base (370)..(370): a, c, t, g, unknown or other
  misc_feature (370)..(370): n is a, c, g, or t
  modified_base (400)..(400): a, c, t, g, unknown or other
  misc_feature (400)..(400): n is a, c, g, or t
  modified_base (417)..(417): a, c, t, g, unknown or other
  misc_feature (417)..(417): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
  modified_base (498)..(498): a, c, t, g, unknown or other
  misc_feature (498)..(498): n is a, c, g, or t
  modified_base (562)..(562): a, c, t, g, unknown or other
  misc_feature (562)..(562): n is a, c, g, or t
tcagtactctcgtgcacgaccggtgctcgatttagatcacgtgcgtcgcgggcgtagacttgtgtttctcgtagtctgctttgctcagcgtcaggtgctgctaatgctctgggtctctggatccagtggggntattgtggtgactcagtctccactctccctgcccgtcattcctggagagccggcctccatcctccgtgcaagtctagtcagacgcctcctacatagtaatggacacaacttgtttcggattcggtacctgacagtacgccaggcacgtctccaagtacgtccgtcctggacttccgttatttggggttacctaagtccgggtccgtccgggtaccctggacctagggttcagttcggnacgtggatccaggctaccgagtatttaacncgttagaaatcaaacgngtagtggagtctaggagtatggttgggtttatacngactnacgtcaagtctactacaaccgtcctagacgttggtaccggnggtaaccagggtcggaagtactaccgaaaggtacgtcgttaggacttcgacctacgaatccgtntaccgtctacg

SEQ ID NO: 160038 - DNA, 864 bp, Homo sapiens
  misc_feature: GYAE6OF01EEPBA.19.83.H06.1.454.CMB.1.raw
  modified_base (176)..(176): a, c, t, g, unknown or other
  misc_feature (176)..(176): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccgaggtggggattagttgtggtgactcagtctccactcctccctgcccgtntattccgtggacgacgcccggccctccactcctcctgacgtaagttctagtacgaggaccgtcccttacctaacaagttaagttaagtacggaaacctaacttaaacgtttagttttaggtaacgtttccgggttaaccctggaccgaacggaaccggacccggtaggggtacctacgtacccgttacccaacgtaccgtcccttacgtacgtaacgtttaccgtttaaggttttccgggtttaacgttaaccgggttcccggggtaccccggttccccgggggttcccttagggtacccggttaggtttacggagggttcggtacggtaacggtcgtaacgtacggacggtaacgtaacgtaacgtttaaactttaccgtaaacgtaaagtaaactaaccgaacgtaaggtacggtagggacggtacgtagggaaggtttacggtttagggttttacgggtttaacttacgtagtacgtagacgtactaacgttacgtaaccttaaaccgtaacccgttacccgttaaccggttaacccgggttacgggaccgggtaaacgggtaaccggtaaagggtcggtaaacggtaaaccgttaaaccggtaaacggttacgggttaacggtcgggtacccgtaccgacccgtaactacggtttactttccgttaccgttacgttacccccgg

SEQ ID NO: 160039 - DNA, 798 bp, Homo sapiens
  misc_feature: GYAE6OF01CALJL.19.83.H06.1.454.CMB.1.raw
  modified_base (181)..(181): a, c, t, g, unknown or other
  misc_feature (181)..(181): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggactccgaggtaggggtattagttggtggtgacttcagtcctccactctccctgcccgtnacttccgaggacgacggcccgtcctctactcctcctgactaacgtctagtcaacgtcgcctacctaactagtaagtaacgtcggaacaacgttaacgtttagtttacgggacgtttacgggtaaccctggacgaacggtaacgaccggacgggccgtaacgtacctcccaacgtacgtccttaccgtgtaccgtttaacgtttggttttaccgggttacgtaaccgggtcccgggtcccggttaccccggggtaccgtcgggttaacggtcgtcgtacggggtactcgggtacgtagaccgtagggtaccacgtacgttaaacgtttaacctagtaaaacgtaaacgtaacgtaacagggtaacggttaggacgtacgggtacggttaggtagggtttacggtttacgggtttagttaacgtcggtacgtctaacggtactacgtaccgtacttaaccgtaaccgttacccgaccgttaacgggaccggttacggggtaaccggacgtaacgggtacgggtaagacccggtaaacgtaacggtaacggtaggttcccggtcggacgtaaccgaacccgttgtacccttaggtttaacccttgtaacccggttccccg

SEQ ID NO: 160040 - DNA, 790 bp, Homo sapiens
  misc_feature: GYAE6OF01D0NLE.19.83.H06.1.454.CMB.1.raw
  modified_base (501)..(501): a, c, t, g, unknown or other
  misc_feature (501)..(501): n is a, c, g, or t
tcagtactctcgtgcacgaccggtgctcgatttagatcacgtgcgtcgcgggccgtagactttgtgtttctcgtagtctgctttgctcagcgtcgagggtgctgctaatgctctgggtctctggactcgaggtgggatgttgtcgtgactcacgtcctcctcctcctccccgttcgccccgttctacttcccgagggacggcgtccccggacccttcctactcctccgtagactaacgttcgtacgtacaacggcctccctacgaacagttagtaacgtacgactaacctaagtttagttggtacgttacggtaccctggaccgaaggacgacccggaggtcctacgtccctaccaacggtcgtccttaccgtatacgtttacgttggttttcggtacgtaccggtcccggggtcccgttccgggtccaaggtacgtacggtagtggacgtgaggtcgaactcgaggactacgttattacttaaccgaagtaacgaactanaacggtagtagggtggaacggttgtaaagggtagggtttacggttaggggttttacgttaacgttccggtagtacgtacggacgttaaccggttacctacccgttaaccgttaaaaccccgtccccggttaacccgtacgggttacccgggttaccggggaacgggttaacgggaacgttacgggtaacggtaaacctacggtaaaccgttaaaccgggtacgttccggtacggtaccttacggaccccttgaaccctttgtaaccggttccctttaaccgtaccccgg

SEQ ID NO: 160041 - DNA, 692 bp, Homo sapiens
  misc_feature: GYAE6OF01ESHN7.19.83.H06.1.454.CMB.1.raw
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtcctccactctcctgcccgtcattccnggangccgcctcatctcctgcaagtctagtcagacgtccctacctaacattaagtaagtcggaacctaactaaacttagtttaggattacgggtacctgacaaggtaacgccgagggactacgtcctccaacgcgtccttccgtagtacttaccgttagtttcgggttactaacggtcccgggtcccgttacccggggtcctagtacgtaggttcgaggtcgtacgtaggtcgagtccgagtactaaccgtagttactttaacgaaccgtaagtaaactacgaaacgaggtaaggtagggacggtataggaaggttaggttagggtttagggtttacttacgtgtactagtacgtaccgtaagtcctaaccgtaacccgtaacccttccccgtaacgttaacggttaccgggacggtaacggaacggtaaggtaggacgtaacgtaaaccggtaaacgtacggtacggtagcgtacaacccgtaccttacgtaccttcgttcctaccttaaccg

SEQ ID NO: 160042 - DNA, 981 bp, Homo sapiens
  misc_feature: GYAE6OF01ELMBH.19.83.H06.1.454.CMB.1.raw
tcagtactctcgtgcacgaccggtgctcgatttagatcacgtgcgtcgcgggcgtagactttgtgtttctcgtagtctgtcttgctcagcgtcgaggtgctgctaatgctcgtggtctcgtgatccgaggtgggacttagttcgtggtcgactcgacgttcctaccgacttccgtccccgtgtacccttcgtacttccggtaggacgtaccggtcccgtaccctctacttccgtaccgtacgacgtaacgttctaacgtcgtagtaccttacccgtacctaacgtagttaaggttaacgacggtaaacctaacgtaaccgtttaggttttacggtaacggttaccgggtacctaggtaccgaaggaaaccgtccggaagggttacccttaccgtacccttaccgaacgtaccgttacctttaccggtacgtagttttacccggtttaggttttaccgggttacctaaccgggttccccgggtacccgggttacccgggttaccgtaggtaaccgtacgggtttaccgtaggtccgggtaagtaacgggttcgaacccgttaccggtagaaccggttaaaccgtaacggttttaaccctttaaagaacgttaaacgtaacccgtaacgtaaccggaggttaggggtaaaccgtcgggttaacgttaggggtaacggtttgggttttaaacggggttttcgtttacgacttaacgggacctttacggtaagtaacccttaaccgggttaccaaaacccgttttacccgtaacccgttccccggggtaaaacggggtttccggaccggggtaacccgggtaaaccggacggggtttaaacggacgggttaaaaccttaaacccgggggtaaaaccccgttaaagggtttcccgggttaacggtcccgttaacccgaacggttaacccccgtaaatttacgttcccggttttaaccgttaacccggttttacttaaacccccggg

SEQ ID NO: 160043 - DNA, 849 bp, Homo sapiens
  misc_feature: GYAE6OF01DTDRC.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattggtggtgactcagtctccactcctccctcgcccgtctattccgtgggagtacggcccggcccttccacttcctcctgactaacgttctacgtcaagacctccccttaccaataagttaaggttaacgacggaacctaacctaagtttacgttttaggtacgtttacgggtaccctacgacgaaggaaccggccggaacggggactacgttcccctaccgtacgtaccggtccttccgttagtacttttacgtttacggtttttcggggtttaaccttaaccgggttccccggggtaccccgggtttacccccggggtaccccgtttacggtaaccggttacgggttaccggtaagggttcgggaacggttacggttacggggtacttacccgggaacggtaccgtaagttaaaccggtttaactttttaaacaaccggttaaaacgtaaaactaaccgaaacgtaagggtaagggttacgggacgggttacggtaaggggtaagggttaaggtttaggggttttagggttttacgttaacggtgtacgtagtcgtaacgtacctacttaaccgtaacctaaccccgttcgtacgttacgggttacggtaacgggtacggaacgtaagggacgtaaacgtacgtaaacgtaaacgtaggttacggtcgtacgtaccggactaccttagtccttacgttcgttacgtacccg

SEQ ID NO: 160044 - DNA, 1040 bp, Homo sapiens
  misc_feature: GYAE6OF01E05D1.19.83.H06.1.454.CMB.1.raw
tcagtactctcgtgcacgaccggtgctcgatttagatcacgtgcgtcgcgggcgtagactttgtgtttctcgtagtctgctttgctcagcgtcgagggtgctgctaatgctcgtgggtctctggatccgaggtggggattagttggtggtgactctacgtcctcccacttcctccccgtcggccccgttatacgtttcccgtgggaacgccggtcccggtccctacctacttcccgtccgtggaactaacggttcctaacggtccgaacggtacccgtccccttacccgttaactaagttaacggttaacggtaccggaaacctaaacctttaaacgttttacggttttaaggtaccggttttaccggggtaaccctaggaaccgtaaagggtaaccggtaccccgggaagggggtacctaccggtttaccctaaccccgaacggtaccggttccctttaccggttaggtaaccgtttttaacccggttttagggtttttacccggggtttaacccttaaccggggttcccccggggggttcccccggttttacccccggggggttacccttaacgggtaaacccgggtttcgggtttacccggtagggttaccgggtaacggtagggttaccggtaacgttaccgggaaacggtcccgttaaacgtaacggtttttaactttaaacccgaaacggtttaacggaaaaacctacccggtaaaggtaacgggttaaggggtacgggtaacggttacggttaaggggtaacgggtttacggggttttaggttttacgggggttttaaccttccggagtaaccgtacggtaccggtaacgtaacggttaacccctaaaccttaaaccccggtaccccttacccgggttaaacgggttacccggggttacggggaaccggtaaacggggtaccggttaaagggtaacgtaacgtaacccgtaaaccggtaaacgtcgggtacgttacggacccgtaagacccgttaacctcggtttacgaccgtttccgttacgtaacccccgg

SEQ ID NO: 160045 - DNA, 637 bp, Homo sapiens
  misc_feature: GYAE6OF01B0CAX.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgcccggccctccatcctcctgcaagtctagtcagacgcctcctacataagtaatggacacaacttatttggattggtacctgcagaacgccgagggcagtcctccacagcctctgactcttagttttgggttactaacgtccggggtcccggttacccggggtcccctaggacgtaggttacgaggtcgggcgaggtggactcgaggacactagttactttacgaactagaaaatcaacgaaggtaggagggacggtacgtagggaggtagtttggggtttagggtttacttacgtagactagtagtacgaacgtacttacctaacctaaccgtcccgttaaccgtaacgggttccgggacggggaacgggaaccgtaaggggtggaacgtaacgtaccgaaacgtacgtaggtcggtcgacgactacctacttcgttcgttctcgttaacccg

SEQ ID NO: 160046 - DNA, 848 bp, Homo sapiens
  misc_feature: GYAE6OF01BJ6IC.19.83.H06.1.454.CMB.1.raw
  modified_base (178)..(178): a, c, t, g, unknown or other
  misc_feature (178)..(178): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatagttggtggtgactcagtcctccactcctccctcgcccgtanactttccgagggacgacggcccgtccctacctattcctccgtgactaagttctacgtcgagaccgtccctacctaactagttaagtaacgtacggaaccaactaacgtttagtttaggtacgtttacggtacctcggacgaaggaacggtcccggaggggacctacggtcccctacccgaacgtacggtccttaccgttagtactttacgtttaggttttacgggttaccttaaccgggtcccgggtccccggttacccggggtcctaggtaccgttacggtacgtaggtcggacgtacggtaggtacgtcggaccggtactacgtaacgtttaacgtttaaccaaacggtaaactaaacgtaccgtaacggtacgggtagggtacgggtacggtacggtaagggtaacgggttagggttttacgggttttacggggtttacgttacggtacgtacgttacgtacggtaaccttaacggtacctttaacccgtaaaccgttaaccccgttacccgttaaccgggtaccgggttaccgggaacggggtaaccggtaaacgggtaacgggttaacggtaaccgtaaaccgtaaaccggtaaaccgggtacggtacgggtcgtaccgtacgacccgtacttaccgttcgttaccttaccgttccttaaccccg

SEQ ID NO: 160047 - DNA, 671 bp, Homo sapiens
  misc_feature: GYAE6OF01EQ0EB.19.83.H06.1.454.CMB.1.raw
  modified_base (526)..(526): a, c, t, g, unknown or other
  misc_feature (526)..(526): n is a, c, g, or t
  modified_base (532)..(532): a, c, t, g, unknown or other
  misc_feature (532)..(532): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (567)..(567): a, c, t, g, unknown or other
  misc_feature (567)..(567): n is a, c, g, or t
  modified_base (587)..(587): a, c, t, g, unknown or other
  misc_feature (587)..(587): n is a, c, g, or t
  modified_base (595)..(595): a, c, t, g, unknown or other
  misc_feature (595)..(595): n is a, c, g, or t
tcagtactctcgtgcacgaccggtgctcgatttagatcacgtgcgtcgcggaccgaatctacgagcacagcctacatggacctgagcagcctgagatctgaggacacggccatatattactgtggcgagagcgaggctacagtaactctattcctttctactactactactacacgtggactccgtaggggcaagtcggacctacggtccaccgtcctaccgtcgacgccctaccaaccgaacggtcccaacgtccggttaccctttcccccgacgggcccaccccgtcgtaccgtaccgaacggaccgacccgtaacccgtaccggaacgaccgaccgaaccggacggcccggtacccggtcgggtaccgtaccggtacccggttacggtaaccggtaacggtaaccccgttaacccgttacccgaacggttaacggtacgttaacggtacgggacgggtaccgggtaccgtacggaccggtaacggaccgtaacgtaacgtacgagagagtagacgtgacagantatacntagacgnacgancgagananagacgagtacacganacgtacgacgacgacgaganagtacagntacgtacagcgtacgtacgtaacgtacgtatacgacgtacgtaaccaactacgaacttagttacgagtacgtaacg

SEQ ID NO: 160048 - DNA, 855 bp, Homo sapiens
  misc_feature: GYAE6OF01BCS7F.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctcgtggtctcgtggactccgaggtgggattagttggtggtcgactcacgttcctcctacctcctccctcggtccccgtactacgtttcccgtggacggtaccggcccggtacccttaccctaacgttcccttcccgtacggtacctaaaacggttccttaacgtaccgaccgtaaccgtccccttaccctaaccgtaagttaacggttaacgtaccgggtaacctaaccttaaacgttttagtttacgggtaacgttttaccgggtacccttacggaacgtaaccggtaaccgcccggtaacgggtacctacgttaccctacccgaacgtacggtcccttacgtggtaactttccgtttacggttttcggttaacctaaccgggttcccggtacccggttccccgggtaccttacggtaaccgttggtaccgtaggtccggtacggtagggtacgaacttccggaacgtacgtaacgtagtttaacgtttaacacgtaaactaactacggaacgtaggtaccggtagggtacgtacggtaggtaaggttgttttacgggtttagtttaacctcgtacgtactcgtacgtaccgtacgtccttaaccgtaacctaccggttacccggtaacggttacggtaccgggacgggtaacggtaccggtagggtaaccgacgttacgaaaccggtacgtagtcggtacgaccgtacgccctacgttacgtacgttcttcgtaccgttcccgg

SEQ ID NO: 160049 - DNA, 731 bp, Homo sapiens
  misc_feature: GYAE6OF01A2XZA.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctcgtggatccaggtggggattagttgtggtgactcacgtctccactcctccgtcgcccgtctacttccgtgggacgacggcccggccctccacttcctcctagactaagttcctagtccacgaccgtacccttaccctaactagttaacggtaacgtacggaacctaaccttaacgtttagttttaggtaacggttttacggtacccgtggacaacggtaacgccggagggcctacgtcctaccgacgacgtcctccgttagtacttgtttacggtttcggttacgtacggtccgggtcccggtccggtcctgacgtacggtcgaggtcgacgtcgtagactcggacgacgtacgtattacgttaacaacgttaacgtaaactccgaagtagggtagggtacggacggttagtagggtacggttaggtttacggggtttagtttacttacgacgtacgtagcgtacaacgttccttaaaccgtacctaccgttaccgtaacggttaccggggacggtacgggaacggtaacgtaacggtgaaacgtaaccgtaacggtaacggtgtacgggtctacgaccacgttacttcgttagttcgttacgttccgtaccg

SEQ ID NO: 160050 - DNA, 911 bp, Homo sapiens
  misc_feature: GYAE6OF01D870E.19.83.H06.1.454.CMB.1.raw
tcagtactctcgtgcacgaccggtgctcgatttagatcacgtgcgtcgcgggcgtagactttgtgtttctcgtagtctgctttgctcagcgtcgagggtgctgctaatcgctcgtgggtctcgtgatccgaggtgggattagttggtggtcgactcgacgtcctcccacctcctcccgtcgtccccgttactagttccgtaggacgaccgcccggtccctcctactcctccgtcgtacgtaacgtccgttagaccgacgtaccgtcccttacctaacgtaagttaacgtaacgtacgaacctaacgttaactttaggtttacggtacgtttacggtacctagaacgaacggaaccggtacgacgggtacctaccgttaccacccgaacgtaccgtccgttccgttacgtacgtttttaacggtttacgggttttacgggttaacccttaacggggttccccggggtcccccgggtttacccgggttacccgtaacggtacggtttacggttacggtcgggttacggaccggtaggtacggtacgtaacggaacggtaaccttaacgtaaacgtttaactttaaaccgaaaggttaaactaacgaaaccgtaacggtaacggtagggttaacgggacggttacggtaagggttaagggtttacggttttaaggggtttaacgttttacttaggtcggtacgtaacgtcggtaacgtaaccgtaccgttaaaccgtaacccgttaaacccgttccgtaaaccgggtaccgggttaacggggtaaccgggtaacggtaaccgggtaagggtaacggtaaccggtaaaccgtaacccggtaaacggtacgtcggtaccgtacgggtaccaaccggttaccttacggtactttaccgttcctttacccggtacccg

SEQ ID NO: 160051 - DNA, 1118 bp, Homo sapiens
  misc_feature: GYAE6OF01A4S5R.19.83.H06.1.454.CMB.1.raw
  modified_base (121)..(121): a, c, t, g, unknown or other
  misc_feature (121)..(121): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctcgtgggtctcnggatccgagggtggggattagttggtggtgactcagtcctacctacctcctcccgtcgcccgtactacttccgagggacgaccgcccgtccctacctactcctccgtagacgtaagttccgttagaccacggtacctcccttacctaagtaagttaacggtaaacgtacggaaacctaaacgttaacgttttaggtttagggttaacgtttaccgggtaaccgtaggaacggtaacggaaaccggtaccgggaagggtccccttaagttacccccgtacccaaccgtaccgttaccccgttaccgttaaggttaccgttttacggtttttacgggtttttacggggttaacccgttaaccggggttccccccggggttaccccggttaccccgggggttacctaacgggttaccgggttaacgggtttaccgtcgggggttaacggtaccgttaaggggttaacgtaacccggttacgggaaaccggtaacccgttaaaagtttaaacccggttttttaaaacgtttaaaccccggaacgttaaaaaaacggtaacctaaacgggttaaaccgggtaacggggttaacggggttaaggggtaacccgggtttaagggtacggggttttaaacgggttttaaacgggttttttaacggggggtttttaacgggttttaaaccgtttacgggaaccgtttaaggtaccgggtttaaaccggtaaccgttaaacccgttaccgtttaaaacccccgtaaacccggtttaaccccccggtttaaccgggttaacccgggttaaaccgggggttaacgggggaaccccggggggttaaaagggttaaccggggtaagggtaaaccgggttaaacccgtaaaaccgggttaaaaccggtaacggggttaaccccgttgggggtaaccccgtaccggttaaccgttaacccgttaccttaccggtttaacccgtcttttaaccccgggtccctttaacccccgg

SEQ ID NO: 160052 - DNA, 637 bp, Homo sapiens
  misc_feature: GYAE6OF01ESNZG.19.83.H06.1.454.CMB.1.raw
  modified_base (177)..(177): a, c, t, g, unknown or other
  misc_feature (177)..(177): n is a, c, g, or t
  modified_base (182)..(182): a, c, t, g, unknown or other
  misc_feature (182)..(182): n is a, c, g, or t
  modified_base (467)..(467): a, c, t, g, unknown or other
  misc_feature (467)..(467): n is a, c, g, or t
  modified_base (554)..(554): a, c, t, g, unknown or other
  misc_feature (554)..(554): n is a, c, g, or t
  modified_base (619)..(619): a, c, t, g, unknown or other
  misc_feature (619)..(619): n is a, c, g, or t
tcagtactctcgtgcacgaccggtgctcgatttagatcacgtgcgtcgcgggcgtagactttgtgtttctcgtagtctgcttgctcagcgtcagggtgctgctaatgctctgggtctctggatccaggtggggatattgtggtgactcagtcctccactctccctgccgtcattccnggagngcccggcctccatcctctcgcaagtctaggtcacgacgcccttacctaacataacgtaagttcgaaccaactaacttagtttggattggtacctgacaagaacgtcgaggctcgtcctaccacacgtccttccgtgtacttacgttaaggttttcgggtacttaacggtccccggggtcccgttcccggggttcccctaggtaaccggtaggttccgtagggtcggtacgtagggtcgggactaccggaggtacaaccgttaagtttaacgtttaaccacgtaanaaacgtacaacgtaggacgtggaagtcgtaggtaagtagtttacggtttgggtttaatcgtgatacgtgactagtctacaacctacncctagtcggtcggacgacgggacagggtacgagacgtacgaagtccgtagcggtacacgctaacncttactcgttcctcgtac

SEQ ID NO: 160053 - DNA, 724 bp, Homo sapiens
  misc_feature: GYAE6OF01CUSTQ.19.83.H06.1.454.CMB.1.raw
  modified_base (147)..(147): a, c, t, g, unknown or other
  misc_feature (147)..(147): n is a, c, g, or t
  modified_base (177)..(177): a, c, t, g, unknown or other
  misc_feature (177)..(177): n is a, c, g, or t
  modified_base (245)..(245): a, c, t, g, unknown or other
  misc_feature (245)..(245): n is a, c, g, or t
  modified_base (682)..(682): a, c, t, g, unknown or other
  misc_feature (682)..(682): n is a, c, g, or t
tcagtactctcgtgcacgaccggtgctcgatttagatcacgtgcgtcgcgggcgtagactttgtgtttctcgtagtctgctttgctcagcgtcaggtgctgctaatgctcgtggtctctggactccgaggtgggatagttggtggtnactcagtctaccactcctccgtcgcccgtntacttccgtggacgacgtcccggccttaccattccgtcctggacctaagtccttacggacaggtaccncccttactaactagttaagtagacggacaactaagttagtttggaactttcggaccttgaccgtaaggaactcccggaggtactacgtccctacaacgcgtcctaccgtagtaccgttccgtttaaggtttcgggttaacctaacggttccccggggtccgtacccggggtccctaagggtaaccgttaggtttacgacgggttacggacgtaaggtcggtaacctacggacggttacacgtaagtttacttaccaaggtaaacaactacgaaacgtggtaggtacggtagtcgtacggtacggtagttcgggtttagggttaactcgtacgacgtaacgttaacgctaacggttctaacccgtaacctaacccgttccgtaggtaaaccggttcgggaacggtacgaacgtacggtagacttaacgacgtaaacgnggtacgtcgctaacgcgtaacgacttgcttcgtaccgtccgg

SEQ ID NO: 160054 - DNA, 802 bp, Homo sapiens
  misc_feature: GYAE6OF01DLM2C.19.83.H06.1.454.CMB.1.raw
  modified_base (189)..(189): a, c, t, g, unknown or other
  misc_feature (189)..(189): n is a, c, g, or t
  modified_base (461)..(461): a, c, t, g, unknown or other
  misc_feature (461)..(461): n is a, c, g, or t
  modified_base (534)..(534): a, c, t, g, unknown or other
  misc_feature (534)..(534): n is a, c, g, or t
tcagtactctcgtgcacgaccggtgctcgatttagatcacgtgcgtcgcgggcgtagactttgtgtttctcgtagtctgctttgctcagcgtcgaggtgctgctaatgctcgtggtctcgtaggatccgaggtgggattagttggtggtgaccttcgactccctccacttccctcccgtcgtccccgtntacgttccgaggacgcggtcccgcctctatcctcgtggactaagtctaagtcaacggtcctccctacctagtaagttaagtaacgtacggaactacgtaaacgtttggtttaggtacgttcggtaaccctggaaccaaaggaaccgtaccggaacgggtactacgttacctaccgacgacgtcctaccgttaggtaactttcgttaggttttacggtactaaccgggtcccgggttcccggttcccgggtacctaggtaccgtaggttacgnggtacggacgtaggtcggtaactaccgggacgtaactacggttaactttaacgtttaaccgaaacggttaaanaaaacgtaaccgaaagggtaaggtaaggggtacggaacggggttcttagggtaaggtttaaggtttcggggtttttagtacctttacgacggtaagtacgtaccgaacgtacgttacctaacccgtaaccgtaacccttcgtacggtaacgggttcggaacggacgtacggaagtcggaactaacgtaacggtaactaggttccggtctaaaccgtccgaaaccgttaccttaacggttcctttacggttacccttaacgttcccccg

SEQ ID NO: 160055 - DNA, 819 bp, Homo sapiens
  misc_feature: GYAE6OF01BM47G.19.83.H06.1.454.CMB.1.raw
  modified_base (183)..(183): a, c, t, g, unknown or other
  misc_feature (183)..(183): n is a, c, g, or t
  modified_base (232)..(232): a, c, t, g, unknown or other
  misc_feature (232)..(232): n is a, c, g, or t
  modified_base (368)..(368): a, c, t, g, unknown or other
  misc_feature (368)..(368): n is a, c, g, or t
  modified_base (774)..(774): a, c, t, g, unknown or other
  misc_feature (774)..(774): n is a, c, g, or t
tcagtactctcgtgcacgaccggtgctcgatttagatcacgtgcgtcggcgggcgtagactttgtgtttctcgtagtctgctttgctcagcgtcagggtgctgctaatgctctgggtctctggatccaggtggggattattggtggtgactcagtcctccactctccctgccccgtcattccngggagacgcccggcctccactcctccgtgactaagtctagtcaggaccncccttacctaactaataggttaaacgtaggaaaccaaccttaaacgttacgttttaggtacgtttacgggtacctggacgaagggaaacgtaccggtacgggcctaacgttacctaccgacgtacgtccttacgtntacgtttacgtttaggttttcggttaccgtaacggttcccggggtaccccggtccggggtccctacgggtacgtacggggttcgtacgggtcggacgtaggtaggacgtaacggacggactaacgtagttaacgtttaaaccaacgtaagtaaaactccgaaagtaccgggtaggtacgggacggttagggtacgggtaagggttagttttacgggggtttttacggggttaattaccggtcggttaacgtacgttaacggtaaccgtaaactttaccgtaaccttaaaacccgttacccgtccgttaaaccggttacgggtacccggggtaaggggacccgttaacggaaggggtaccggtaaagtaaaccgtaacgtaaacggtagttacggtcgttaacccgngtaacccgtaacgttctttaccggtactttcccgcgttaaccccg

SEQ ID NO: 160056 - DNA, 842 bp, Homo sapiens
  misc_feature: GYAE6OF01A01V0.19.83.H06.1.454.CMB.1.raw
  modified_base (194)..(194): a, c, t, g, unknown or other
  misc_feature (194)..(194): n is a, c, g, or t
  modified_base (812)..(812): a, c, t, g, unknown or other
  misc_feature (812)..(812): n is a, c, g, or t
tcagtactctcgtgcacgaccggtgctcgatttagatcacgtgcgtcgcgggcgtagactttgtgtttctcgtagtctgcttgctcagcgtcgaggtgctgctaagtgctctcggtctcgtggactccgaggtgggtactagttgtggtcgactcgacgtcctcctactcctccctcgacccgtatacttccgnggaacgtccgcccggtccctccacttcctacctggactaacgtctacgcaggtacctccctacctaactaagttagtaacgtcggaacctaacgttaacgttaggtttcggtaacttccgggtacctggaccgaaacggaacgccccggtaaagggtcctaaccggttacccacccgaacgtaccggtacccttcgtaacggttaactttccgttttaagggttttccgggttaaccctaacgggttccccgggggtccccggtttaccccggggtaccctaagggtacccgttacgggttaccgtaggggtttacccggcgtaaaggggttcgaacccgttacgggacgggaacctaacgtaacgtttaacgtttaaccaagtttaacccaaaagtaccaagtacgggttggacgggttaaccggtagttagggtaacggttagtttaccggggttttaagggtttacccgttagacggtacgtttaacggcgaacgttacttaccgtaacccgttaacctaacccgtaccgtttaacgggaacccgtttcgggaaacgggaccggtaacgttacggaagtaaccggtaagtaaccggaacgtacggtgacgtccgntaccggtaactcgacttcgtctcgtacccg

SEQ ID NO: 160057 - DNA, 725 bp, Homo sapiens
  misc_feature: GYAE6OF01DLNVD.19.83.H06.1.454.CMB.1.raw
  modified_base (265)..(265): a, c, t, g, unknown or other
  misc_feature (265)..(265): n is a, c, g, or t
  modified_base (466)..(466): a, c, t, g, unknown or other
  misc_feature (466)..(466): n is a, c, g, or t
tcagtactctcgtgcacgaccggtgctcgatttagatcacgtgcgtcgcgggcgtagactttgtgtttctcgtagtctgctttgctcagcgtcagggtgctgctaatgcttcgtgggtctcgtggatccgaggtggggattattggtggtgacctcacgttcctcccaccttcctccccgtcgccccgtctagtttcccgtggacgacggccccggtccctcctacttcctcctggacctaagtcctagtcagactcctacctanatagtatgactagaacttagttgattcggactgacagacgccgaggactacgtccctacacacgccttccgtgtacttcgtttaggtttcggtactaacggtccgggaccgtccggtacctagagtcggtacgagtcgacgtaggtcgtatcgagtacctagtaacgttactttaacgaactaaggtaacctacgtaacgngggtaagttgggaagtaccggtaggtaacggttaaggtttcgggttttaggttacctggttacggacttagtcgtaacctacgttacccttaacgaacccgttaaccccgttcccgttaagggttaaccgggtacgggaccggggtacggtaaaccgttagggaggaaccctaacggtaacccgaaaacggttcggtcggtacggttgaacccgttaccgtaaacttcggttagtttacccgtcctttcgtacccccgg

SEQ ID NO: 160058 - DNA, 690 bp, Homo sapiens
  misc_feature: GYAE6OF01CKYVC.19.83.H06.1.454.CMB.1.raw
  modified_base (183)..(183): a, c, t, g, unknown or other
  misc_feature (183)..(183): n is a, c, g, or t
  modified_base (485)..(485): a, c, t, g, unknown or other
  misc_feature (485)..(485): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctcgtggaatccgaggtggggattattggtggtgacttcacgtcctccactctcccgtgtccccgtntacttccgtggacgacgcccggcccttaccattcctccgtgacaagttccgtagtcaacggctcccttacctaacgtaattaagtaacgtcggaacctaacgttaacgtttagtttggtacgttcgggtaacctgaccgaaggaaccgccggacgggctacgtcctaccgaacgtcgtcctaccgtagtactcgtttaggtttccggttactaacggtccgggtccgtaccgggtcctaggtacgtgtcgtagtcgacgtagtgacgtcgagacacgtaagttacttacgataagaaactanaacgtagaggtggacgtacgaggtacgtagttggtttaaggttactaagcgagtcgtaacgtactacggtactacgtaacctaaccgttccgtaacgtacggttacggacggtaacggaacgtaaggacgtaaagaacccgtaagaaccggtagtcggtacgtcgtagtacccgaccttagtaccgttacttccgtacgttaccg

SEQ ID NO: 160059 - DNA, 871 bp, Homo sapiens
  misc_feature: GYAE6OF01D9VDW.19.83.H06.1.454.CMB.1.raw
  modified_base (119)..(119): a, c, t, g, unknown or other
  misc_feature (119)..(119): n is a, c, g, or t
  modified_base (172)..(172): a, c, t, g, unknown or other
  misc_feature (172)..(172): n is a, c, g, or t
  modified_base (182)..(182): a, c, t, g, unknown or other
  misc_feature (182)..(182): n is a, c, g, or t
tcagtactctcgtgcacgaccggtgctcgatttagatcacgtgcgtcgcgggcgtagactttgtgtttctcgtagtctgctttgctcagcgtcaggtgctgctaagtgctctggtctcnggatccaggtgggatagttgagtgactcagtctccactctcccgtcgcccgtntactttccgnggacgacggcccggccctacctacttccgtccctgaccgtaagttcctaaggtccacgtaccgtcccttacctaacgagtaagtaacgtcggaaacctaacgtaacgtttagtttggaactttcggacctggacgaacgaacgccggaagggcctacggtcctaccgacgtacggtccttaccgtgtaccgtttacgtttacggttttcgggtacctaacggggtccccgggtcccgttacccgggttaccgacggtaaccggttcggtttaacgcggttacgggtaccgtacggtagggaccttaccggaacgggtacctaacggttaacggttttaaaccctttaaccggaaacttaaacgggttaaaaccgtaccgtaaacggtaacgggtacgggttaacgggaggtttaacccgtagggtaacggtttacggtttttacggggttttaacgggttttaaacgtaccgtacggtaacgttacggtttaacgacgtttaaacgccccgttaacgtaaaacccgttacccggtacccccggttaagggtttaaccgggtacccgggaacgggtaaccggtaacccgggttaagggacgtaaacggtaaccctaaacggtaaacgttacggtggtaccgtcgtaaccggacctaacgtccgtttaccgtacccgttatcccgttaccg

SEQ ID NO: 160060 - DNA, 779 bp, Homo sapiens
  misc_feature: GYAE6OF01BW8GY.19.83.H06.1.454.CMB.1.raw
tcagtactctcgtgcacgaccggtgctcgatttagatcacgtgcgtcgcgggcgtagactttgtgtttctcgtagtctgctttgctcagcgtcaggtgctgctaatgctctggtctctggatccaggtgggatattgtggtgactcagtctccactctccctgacccgtcattccgtaggacgcgcccggcctccactcctcctgacaagtctagtcagacgtccctaccgtactatagtaataggaccacgtaacttatttggatttcggtacctgacgagtaacgccgaacggtctacgtcctacccacgtacgtcctacgtgtacttccgtttagttttcgggttaactaaccggtccgggtccccgtacccgggggttcccttagggtaccgttacggttacgtacgggtcggtacggtaggtaggacgtacggacgtaccgtaacgtaacgtttacttttaaccaacgttaacgtaaaacgtcgtaaaacgaggtaagggtacgggtacggtagtaacgggtacgggttaggttttggggttttacggtttacgttacgtgtaacgtagtcgtaaccgaacgttaccgtaacctaaccctaaaccccgttccccgttaaacggtaccggtttcccggggaaccgggtaacgggtaacccgggtaagggtaggtaaaccctaagggtaaacccgtaaaaccggtgttaacggttcccggaacgttaccgacccgttaacgttctaccgtttactttacccgtacccgtttacccg

SEQ ID NO: 160061 - DNA, 1047 bp, Homo sapiens
  misc_feature: GYAE6OF01CEKA1.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccgaggtggggatattggtggtgactcagtctccactcctccctcgccccgtctacgtttccgtggggacgacggccccggtcccttaccacttccctcccttcggacctaaacggttccttaaggtccaacggtaccgtccccttaccctaaacctagttaaggttaaaacgtcgggaaccaaacctaaacgttttagtttttacgggtattttaccggggttaaccccttggaaccgtaaacggtaaaccggacccggtacgggggacctaacggttaccccttaccccgtaaaccgccggtaccctttcccggttacgtaacgtttaccggttttacggttttttacgggggtttacccttaaacgggtttcccccgggggtccccggtttacccccggggggtccccttacgggtaaccggttacggggtttaccgaacggttcggggtactaacggggttggtaaaccttacggggaacgtacccgtaacggttaaacgtttaccttttaaaccggaaacgtttaaaccgggtaaaataacccggtaaacggtaacggggttaagggtaacggggttaccgggtaccgtttaaggggaaacggggttttaggggttttaacggggtttttacggggttttaaacgttacgttacccgggtaagtttcggtaaacggtccggtaaacccttaccgttaaccgttaaaacccccgttaccccggtttaaccccgttaaaccgggttaacccggggttaaccggggacccgggggaaagggttaaaaccccggggagggtttaaccgggaaaccgttaacggtaaaacgttaaaacccgggagggtttaccggcccggggtactaccgttaacccggtacgtttacttcccggtttaccgttccttaccccggtttacccg

SEQ ID NO: 160062 - DNA, 741 bp, Homo sapiens
  misc_feature: GYAE6OF01DNTJB.19.83.H06.1.454.CMB.1.raw
  modified_base (182)..(182): a, c, t, g, unknown or other
  misc_feature (182)..(182): n is a, c, g, or t
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (491)..(491): a, c, t, g, unknown or other
  misc_feature (491)..(491): n is a, c, g, or t
  modified_base (564)..(564): a, c, t, g, unknown or other
  misc_feature (564)..(564): n is a, c, g, or t
tcagtactctcgtgcacgaccggtgctcgatttagatcacgtgcgtcgcgggcgtagactttgtgtttctcgtagtctgctttgctcagcgtcgaggtgctgctaatgctcgtgggtctcgtggactccgaggtgggattagttggtggtcgactcagtcctccactcgtccctgtcccgtntacgttccgnggacgcgcccgcctcatcctcgtganacgtctagtcaggactccctacgtaagaagttagtaacgtacggaacctactaacgtttacgtttaggtaacgtttcggacctaggaaccgtaaggaaccggtacggacgggtacacgttacccgtacccgaactcggtacctttcgtacgttaccttcggttttagttttaccggttacgaccgggttcccggtcccggttacccggtccgtataacgtcgggttcgaggtcgaacgtgtacgctccgagacctagtaccgtttataccganaaacgtaaactcgaaagtaggagttacgggacgtaggtaggtcggtttaggttgggttttaacgtaatacggngtacctaggtaccgaatacctaccgttacgaaccctaccgttaaccgtagtacccgggtagggaccggtaacgggtaacgtaggtaacggaacacgtaaacgggtacccgtgggtactcggacgttaacacccgttcccgttaagttccctttaaaccgtcccgtttagtacccccg

SEQ ID NO: 160063 - DNA, 507 bp, Homo sapiens
  misc_feature: GYAE6OF01CEUAF.19.83.H06.1.454.CMB.1.raw
  modified_base (172)..(172): a, c, t, g, unknown or other
  misc_feature (172)..(172): n is a, c, g, or t
  modified_base (277)..(277): a, c, t, g, unknown or other
  misc_feature (277)..(277): n is a, c, g, or t
  modified_base (304)..(304): a, c, t, g, unknown or other
  misc_feature (304)..(304): n is a, c, g, or t
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
  modified_base (413)..(414): a, c, t, g, unknown or other
  misc_feature (413)..(414): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (482)..(482): a, c, t, g, unknown or other
  misc_feature (482)..(482): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtnattcctggagagccggcctccatctcctgccaagtctagtcagagcctctacaatagtaatggacactaactatttggattggactgcagaagccagggcagtcncacagctcctgatctatttggtctaanccgggcctcggggtcccctggactacggttcaggtggcaggtgaatcaggnacagtatttacacgngaaaatcaaanagagnggagntgagatgttggttatacnanannananactactaactaacctacctactacgtacggacggaggaacgaaggtagagaagacgaaacgaanagtgcgtgacacactatctcgtctc

SEQ ID NO: 160064 - DNA, 737 bp, Homo sapiens
  misc_feature: GYAE6OF01BDXT1.19.83.H06.1.454.CMB.1.raw
  modified_base (145)..(145): a, c, t, g, unknown or other
  misc_feature (145)..(145): n is a, c, g, or t
  modified_base (173)..(173): a, c, t, g, unknown or other
  misc_feature (173)..(173): n is a, c, g, or t
  modified_base (179)..(179): a, c, t, g, unknown or other
  misc_feature (179)..(179): n is a, c, g, or t
  modified_base (546)..(546): a, c, t, g, unknown or other
  misc_feature (546)..(546): n is a, c, g, or t
tcagtactctcgtgcacgaccggtgctcgatttagatcacgtgcgtcgcgggcgtagactttgtgtttctcgtagtctgctttgctcagcgtcgagggtgctgctaatgctctgggtctctggatccaggtggggatattgtggngactcagtctccactctccctgcccgtnattccnggagcgccggcctccatctcctgcaagtctagtcagacgtcctcctacatagtaagtcggaacactaacttgtttggactttcggacctgacgtaagaacggccgaggggtcctacgttcctccaacgtcgtccttacctagtactttcgtttaggttttcggggttaccttaacggtcccgggggtcccgttccccgggggtccctaggtacgtacgggtttcagggtcggacgtaggtcggaacttcggaaggtctaacgtacgttaagttttaaccaaacggttaagtaaactacgaaacggtaggtaggtacgggagtacgtagggtacgggttagtttcgggtttagggtttaacttacggngtaccgtaggtacgtagaacgtcctacgtaaacctacctcccgtaacgtaacggggtaccggagggtaacgaaccggtagggtacggtacgaacgtaaccggtaaaacggtccggttaacggtcggtaaccctcggtaaaccccgtaaccgttacggttaccctttacgggtttcccttaaccgtaccccg

SEQ ID NO: 160065 - DNA, 954 bp, Homo sapiens
  misc_feature: GYAE6OF01E3M86.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggactccgagtgggatagttgtggtagactcgagtcctacctacttacgtcccttgcccgtacacttccgtagggacggacgcccggtcccttacctactccttcctcggactaaacgtccgttacgtcaggacctcccttactaccgtataagtaacgtaggaacctacgtaaacgttagttacgggtatttccgggtacctggaccaaggaaccggtaccgtaggggtactacggttccctaccacgacggtacctccgtagtactttacggttaacgttttcgggttacctacggttccgggtcccgttcccggggtacctaggtacgtacggttacgacgtacggtacgaggttacgtacggtaccggacggtacctaacggtaacgttttaacgtttaaccctaacgggtaaacgttaaaaccgtacgtaaaccgtaagggttaacgggttacggggacggtacggttaagggtaagggtttacggttttaacggggttttacggggttttacttaaccgggttacggtaccgttaggtaacgtaccgggttacgtacccgtttaaccgttaaaccccgttaacccgtttacccccgggttaacgggtaacccgggttccggggaaaacccgggggttaccgggtaacccgggtaaacggttacggggttaaaaccgtaaccgggttaaaacccggtaaaccggggtttaacggggtaacgggttttcgggacccggtttaacccggaacccccgttaaaaccgggggtttaccctttaaacccggggttttccccggtttaccccgtttaaaccgtttacccccccgg

SEQ ID NO: 160066 - DNA, 978 bp, Homo sapiens
  misc_feature: GYAE6OF01A1BLH.19.83.H06.1.454.CMB.1.raw
  modified_base (183)..(183): a, c, t, g, unknown or other
  misc_feature (183)..(183): n is a, c, g, or t
tcagtactctcgtgcacgaccggtgctcgatttagatcacgtgcgtcgcgggcgtagactttgtgtttctacgtagtctgctttgctcagcgtcgagggtgctgctaatgctcgtgggtctctggatccgaggtagggatagttgtggtcgactcagttcctccactcctccctcgtcccgtnacttccgtgggagacgcccggccctccactctcctagactaacgtctacgtacagaccgcccttaccgtaactaagttaagtaacgtacggaacctaactaaaccgttaggttttaggacgtttaccggtaccgtacggaacgaacgggtaaccggaccggtaacgggtaccgtaccgttaccgtacccgaactaccgtcccttaccgtacgtacgtttaccggtttaaggttttaccgggtttaccgtaaccgggtccccgggggtccccggtttaccccggggtaccgttaacggtaacccggttaggttacccggtaggggtacggtacccggtaagggtacggtaacgtaccggtaacgaaccgtaaacgttaaacggtttaactttaaacccgtaaacggttaaacgtaaaacgtcgtaaacggaacggttaggggtaccgggaaggttaccgggttaaggtacgggtttaaccggtttaagggggttttcgggtttaaaccgtttaccgtaacggaccgtaaggttcccggtaacgttaaacccgtttaccctaaaccccggtaaacccttacccccgtttaccccgggtaagggttaaccccggggtacggggaaaccgggttaaccgggaaaaccgggttaaggggttaaccggaaaccgtaaaccgggtttaaaccggaaaccgggttaaccccggtttgggaaacccgggttcctaaccggggttaaccctaacggttttaaccgttcctttacccgggttttaccctacggtttaaccccccgg

SEQ ID NO: 160067 - DNA, 858 bp, Homo sapiens
  misc_feature: GYAE6OF01AVTB4.19.83.H06.1.454.CMB.1.raw
  modified_base (837)..(837): a, c, t, g, unknown or other
  misc_feature (837)..(837): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctcgtggtctctggatccgaggtgggattagttgtggtgactcgagtcctccactcctccctcgcccgtactacttccgtggaacggccggcccggtccctcctacgtccgttcctcgaccgtaacgttcctaagtacgacgaccgacctaccctaactataagtaagtcggaactaacgtaacctttaggtttggtaacgtttcggtaccctgacgaaggaaccggcgaacggcctacgtacctaccgaactcgtcccttcgtctacgttccgtttaggttttcgggtacctaccgggtcccgggtcccggttcccgggtaccgtaggtacgtacggtacgtaggtcgggtacgtacggagtcggtacggacgtaacccgtaagttaacgtttacttaaaccgtaacgaaacgtaaaccgtagtaaaccgggtaagggaacgggtttcggaacgggtacgtaaaggggtttaacgggtttcggtttttaaagggggttttacgtttaacgtttaacggcgtaaacggttaccgtaggtaaccgtaccgtttaacccgttaacaaacccggttacccgtaccggttaccggttaacgggtacgggtacgggaacggtaacgtaacgggtagtaaccctaaaggtaaacccgggtaattaacccggggttgttccgggacccggtaacctaacggttaccccgtttacgtacccgttttaaacccggttntttaacccccccggttaacgg

SEQ ID NO: 160068 - DNA, 781 bp, Homo sapiens
  misc_feature: GYAE6OF01DIQZP.19.83.H06.1.454.CMB.1.raw
  modified_base (172)..(172): a, c, t, g, unknown or other
  misc_feature (172)..(172): n is a, c, g, or t
  modified_base (179)..(179): a, c, t, g, unknown or other
  misc_feature (179)..(179): n is a, c, g, or t
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
tcagtactctcgtgcacgaccggtgctcgatttagatcacgtgcgtcgcgggcgtagactttgtgtttctcgtagtctgctttgctcagcgtcgaggtgctgctaatgctctgggtctctggatccaggtggggatagttgtggtgactcagtctccactctcctgcccgtnattccgnggacgacgcccggccctacnctcctcncgtactacgtcgtacgtacacgcctcccttacctacgtataacgtagacgaacctaacttaatttagttcggtaacgttaccgtactacgaacgaacggaccgcggacggactaccgtccacgaacgcctcctcgtatactttacggtttcggtttacggttacgtaccgggtcccgggtacccggttcccgtccgtacgacgttacggtcgaggtcgacgtaggtcgaacgaacggtctaacgtaccgttaagtttaccgttaaacgagtaaaacgtacaaccggtagagggtacgggtagggtcgtaacggttaggttaacgggtttagtttaggggttttacgtttataacggcgtaacggtaccgtaataaccgtaccgttaccccttaaacgtaaacccgttacccggtaccgtacgggttaaccgggtacccggggaacggtaacgggtaaccggaagttccgggaaacttacgaaaaccgggttaaacggtgggttcggtaaacgtcccgtaacgtaacccgttaacgttacgggtttccctttcggtaccccttaccgttcccccgg

SEQ ID NO: 160069 - DNA, 492 bp, Homo sapiens
  misc_feature: GYAE6OF02ISXKO.19.83.H06.1.454.CMB.1.raw
  modified_base (490)..(490): a, c, t, g, unknown or other
  misc_feature (490)..(490): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacactatttggattggtacctgcagaagccagggcagtctccacagctcctgatctatttgggttctaatcgggcctccggggtccctgacaggttcagtggcagtggatcaggcacagattttacactgaaatcaacagagtggaggctgaggatggttgggtttattactgcatgcaagctctacaactccctcaacgttcggcggagggaccaaggtggagatacgaacgaactgtgctgcacatctgtctnac

SEQ ID NO: 160070 - DNA, 491 bp, Homo sapiens
  misc_feature: GYAE6OF02I7RB8.19.83.H06.1.454.CMB.1.raw
  modified_base (488)..(488): a, c, t, g, unknown or other
  misc_feature (488)..(488): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggtctaatcgggcctccgggtccctgacaggttcagtggcagtggatcaggcacagattttacactgaaatcaacagagtggaggctgaggatgttggggtttattactgcatgcaagctctacaactcctcaacgttcggcggaggaccaaggtgagatacgaacgaactgtggctgcacatctgtcttntac

SEQ ID NO: 160071 - DNA, 496 bp, Homo sapiens
  misc_feature: GYAE6OF02HDCYT.19.83.H06.1.454.CMB.1.raw
  modified_base (493)..(493): a, c, t, g, unknown or other
  misc_feature (493)..(493): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaatcaacagagtggaggctgaggatgttggggtttattactgcatgcaagctctacaactccctcaacgttcgcggaggaccgaaggtggagatacgaaacgaactgtggctgcacatctgtcttntac

SEQ ID NO: 160072 - DNA, 496 bp, Homo sapiens
  misc_feature: GYAE6OF02JCXFO.19.83.H06.1.454.CMB.1.raw
  modified_base (433)..(433): a, c, t, g, unknown or other
  misc_feature (433)..(433): n is a, c, g, or t
  modified_base (493)..(493): a, c, t, g, unknown or other
  misc_feature (493)..(493): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaatcaaacagagtggaggctgaggatgttggggtttattactgcatgcaagctctacaactcctanaacgttcggcggaggaccaaggtgagatacgaaacgaactgtgctgcaccatctgtcttntac

SEQ ID NO: 160073 - DNA, 495 bp, Homo sapiens
  misc_feature: GYAE6OF02HCBZ9.19.83.H06.1.454.CMB.1.raw
  modified_base (492)..(492): a, c, t, g, unknown or other
  misc_feature (492)..(492): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaactccctcaacgttcggcggaggaccaaggtgagatacgaaacgactggtgctgcaccatctgtctntac

SEQ ID NO: 160074 - DNA, 492 bp, Homo sapiens
  misc_feature: GYAE6OF02HP1AC.19.83.H06.1.454.CMB.1.raw
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
  modified_base (430)..(430): a, c, t, g, unknown or other
  misc_feature (430)..(430): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccgggtccctgacaggttcagtggcagtggatcaggcacagattttacactgaaaatcaacngagtggaggntgagatgttgggttattactgcatgcaagctctacaaactccctnaacgttcggcggaggaccaaggtgagatacgaaacgactgtggctgcaccatctgtcttcac

SEQ ID NO: 160075 - DNA, 492 bp, Homo sapiens
  misc_feature: GYAE6OF02IM871.19.83.H06.1.454.CMB.1.raw
  modified_base (432)..(432): a, c, t, g, unknown or other
  misc_feature (432)..(432): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttgggtttattactgcatgcaagctctacaactccctnaacgttcgcggaggaccaaggtgagatcgaaacgactgtgctgcaccgatctgtctctac

SEQ ID NO: 160076 - DNA, 534 bp, Homo sapiens
  misc_feature: GYAE6OF02JWQB6.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtgggatattgtggtgactcagtctccactctccctgcccgtcattcctggagagccggcctccatctcctgcaagtctagtcagagcctcctacatagtaatggacacaactattgattggtacctgcagaagccagggcagtctccacagctcctgatctatttggttctaatcgggcctccgggtcctgacaggttcagtggcagtggatcgaggcaacagtattttacactagaaatcaacagagtggagctaggaggatggtttggggttattacgtgacatgacaagcttactaactaacctaccctacgtaacggttcggacgggacggaaccgaaggtggagtatacgaaacggtaactaggtacgacgtgacctaccattctagtaccttacgtaccg

SEQ ID NO: 160077 - DNA, 355 bp, Homo sapiens
  misc_feature: GYAE6OF02JTWUL.19.83.H06.1.454.CMB.1.raw
  modified_base (344)..(355): a, c, t, g, unknown or other
  misc_feature (344)..(355): n is a, c, g, or t
tcagtactctcgtgcacgaccggtgctcgatttagatcacgtgcgtcgcggacgaatctacgagcacagcctacatggacctgagcagcctgagatctgaggacacggccatatattactgtgcgagagcaggctacagtaactctattcctttctactactactactacatggacgtctggggcaatgggaccacggtcaccgtctcctcagcctccaccaagggcccatcggtcttcccctggcgccctgctccaggagcacctccgagagcacagcggccctgggctgcctggtcaaggctactcccacgagagtactgagcggctggcaaggcgcatagnnnnnnnnnnnn

SEQ ID NO: 160078 - DNA, 612 bp, Homo sapiens
  misc_feature: GYAE6OF02IXDPK.19.83.H06.1.454.CMB.1.raw
  modified_base (147)..(147): a, c, t, g, unknown or other
  misc_feature (147)..(147): n is a, c, g, or t
  modified_base (229)..(229): a, c, t, g, unknown or other
  misc_feature (229)..(229): n is a, c, g, or t
tcagtactctcgtgcacgaccggtgctcgatttagatcacgtgcgtcgggcgggcgtaagactttgtgtttctcgtagtcgtgctttgctcaggcgtcagggtggcctgctaatgctctgggtctctggatccagtgggatattcgnggtgactcagtctccactctccctgcccgtcacttccttggagtcgcccggtcctccatcctcctgcaagtctagtcagacnccctcctacattagtaacgtggaactacaacgtatttaggtaattaggtacctagtcagtaagccagggcagtactaccaacgaagtcctaccgtgactctatttgggttactaagtccgggtccgttaccgggttcctagtactaggttcaaggtcggggtccagtcggtagtcgaggcgacagtagtttacacgtaggaaatcgaactagagtggacgctagaggtagttcggttagggtttacttacgtgacgtatgacaagtcttacgtaactaaaccttccgttacgtaacgttcggaacggtaggtaccgaaggtaggtacgacgtacgtaaacgtacgttggtggacgtagacgtacgtatctacgtactactacg

SEQ ID NO: 160079 - DNA, 502 bp, Homo sapiens
  misc_feature: GYAE6OF02F2EXA.19.83.H06.1.454.CMB.1.raw
  modified_base (499)..(499): a, c, t, g, unknown or other
  misc_feature (499)..(499): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaatcaacagagtggaggctgaggatgttggggtttattactgcatgcaagctactacaaactccctcaacgttcggcggagggaccaagggtggagatacgaaacgaactggtggctgcaccatctgtcttntac

SEQ ID NO: 160080 - DNA, 510 bp, Homo sapiens
  misc_feature: GYAE6OF02JZ115.19.83.H06.1.454.CMB.1.raw
  modified_base (352)..(352): a, c, t, g, unknown or other
  misc_feature (352)..(352): n is a, c, g, or t
  modified_base (376)..(376): a, c, t, g, unknown or other
  misc_feature (376)..(376): n is a, c, g, or t
  modified_base (482)..(482): a, c, t, g, unknown or other
  misc_feature (482)..(482): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttgggttctaatcgggcctccggggtccctgacaggttcagtgcagtggatcaggctanagattttacacttagaaatccaanagtagtggaggctaggagagtgttcggggtttattacgtgctatgcaagctctaacgaaacctcccgtcaaccgttcggacggaggaccaaggtgagatacgaaanactgtggctgacaccatctagtctctac

SEQ ID NO: 160081 - DNA, 497 bp, Homo sapiens
  misc_feature: GYAE6OF02FYG7H.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcggagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaatcaacagagtggaggctgaggatgttggggttattactgcatgcaagctctacaaactccctcaacgttcggcggaggaccaaggtggagatacaacgaactgtggctgcaccatctgtcttcatccg

SEQ ID NO: 160082 - DNA, 501 bp, Homo sapiens
  misc_feature: GYAE6OF02I7APM.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggtctaatcgggcctccgggtccctgacaggttcagtggcagtggatcaggcacagtattttacactagaaatcaaacagagtaggaggctgaggtatggttggggtttattacgtgcatgcaagctactacaactccctacaacgttcggacggaggacgaaggtgagatacgaaacgactggtgctgcacatctgtctctac

SEQ ID NO: 160083 - DNA, 510 bp, Homo sapiens
  misc_feature: GYAE6OF02FJEVK.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaatcaacagagtggaggctgaggatggttggggtttattactgtcatgacaagctactacaaactccctacaacgttcggcggacgggaccaagggtggagagtacgaaacgaactggtcggctgcaccatctcgtcttctac

SEQ ID NO: 160084 - DNA, 501 bp, Homo sapiens
  misc_feature: GYAE6OF02FO4Q4.19.83.H06.1.454.CMB.1.raw
  modified_base (498)..(498): a, c, t, g, unknown or other
  misc_feature (498)..(498): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaatcaacagagtggaggctgaggatggttggggtttattacgtgcatgcaagctactacaaactccctacaacgttcggcggaggaccaaggtgagatacgaaacgaactggtggctgcaccatctgtctntac

SEQ ID NO: 160085 - DNA, 497 bp, Homo sapiens
  misc_feature: GYAE6OF02IJ8CG.19.83.H06.1.454.CMB.1.raw
  modified_base (494)..(494): a, c, t, g, unknown or other
  misc_feature (494)..(494): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctattgggttctaatcgggcctcgggtccctgacaggttcagtggcagtggatcaggcacagatttacactagaaatcaacagagtggaggctgaggatggttaggggttattacgtgcatgcaagctactacaactccctacaacgttcggacggaggaccaagggtggagatacgaaacgactgtgctgcacatctgtcttntac

SEQ ID NO: 160086 - DNA, 498 bp, Homo sapiens
  misc_feature: GYAE6OF02GMEGA.19.83.H06.1.454.CMB.1.raw
  modified_base (328)..(328): a, c, t, g, unknown or other
  misc_feature (328)..(328): n is a, c, g, or t
  modified_base (435)..(435): a, c, t, g, unknown or other
  misc_feature (435)..(435): n is a, c, g, or t
  modified_base (495)..(495): a, c, t, g, unknown or other
  misc_feature (495)..(495): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacnggttcagtggcagtggatcaggcacagattttacactagaaatcaaacagagtggaggctgaggatggttagggtttattactgcatgcaagctctacaactccctnaacgttcggcggaggaccaggtggagatacgaaacgactggtgctgacaccatctgtctntac

SEQ ID NO: 160087 - DNA, 515 bp, Homo sapiens
  misc_feature: GYAE6OF02HLBT6.19.83.H06.1.454.CMB.1.raw
  modified_base (325)..(325): a, c, t, g, unknown or other
  misc_feature (325)..(325): n is a, c, g, or t
  modified_base (511)..(511): a, c, t, g, unknown or other
  misc_feature (511)..(511): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggtctaatcggcctccgggtccctgacnggttcagtggcagtggatcaggcacagtatttacactgaaatcaacagagtggaggctgaggattggttaggggtttattacgtgctagtgacaagcttacgtaacaacctcctacgaacgttcggacgggaggaaccgaagggtggacgagtaccgaaacggactgtagctgacacatctgtctntacg

SEQ ID NO: 160088 - DNA, 509 bp, Homo sapiens
  misc_feature: GYAE6OF02H3UM7.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcactagattttacactgaaatcaacagagtggaggctgaggatggttgggttattactgcatgcaagctactacaacctccctctaacgttcggcggacggaccgaaggtggagatacgaaacgaacgtgtcggactgccaccatcgtgtccttctacc

SEQ ID NO: 160089 - DNA, 498 bp, Homo sapiens
  misc_feature: GYAE6OF02ISPHD.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagtattttacactagaaatcaacagagtggaggctgaggatggttgggtttattactgcatgcaagctactacaactccctcaacgttcggcggaggacgaaggtggagatacgaaacgactggtgctgcacatctgtctctacg

SEQ ID NO: 160090 - DNA, 499 bp, Homo sapiens
  misc_feature: GYAE6OF02JZ8OJ.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctattgggtctaatcggcctcgggtccctgacagtcagtggcagtgatcaggcacagatttacactagaaatcaacagagtgagctgagatgttagggttattatgctatgcaagctactacaacctcctacgaacgttcggcgacggacaggtgagatacgaaacaacgtgtacgcgtacgactaccgagttctacgttcgttactacg

SEQ ID NO: 160091 - DNA, 498 bp, Homo sapiens
  misc_feature: GYAE6OF02H72UA.19.83.H06.1.454.CMB.1.raw
  modified_base (485)..(485): a, c, t, g, unknown or other
  misc_feature (485)..(485): n is a, c, g, or t
  modified_base (495)..(495): a, c, t, g, unknown or other
  misc_feature (495)..(495): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctattgggttctaatcggcctccgggtccctgacaggtcagtggcagtggatcaggcacagtatttacactgaaatcaacagagtggagctagaggatggtttgggttattactgcatgcaagctctaacaactccctacaacgttcggcggaagggaccaagggtgagactacgaacgaactgcggtctgcacntctgtccttntac

SEQ ID NO: 160092 - DNA, 518 bp, Homo sapiens
  misc_feature: GYAE6OF02H01CQ.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctctacatagtaatggacacaactatttggattggtacctgcagaagccagggcagtctccacagctcctgatctatttgggttctaagtcgggcctccggggtccctgactaggttcagtggcagtgatcaggcacagtatttacactagaaatcaacagagtggaggctgaggtagtggtttagggtttattagtgctatgacaagctactaacaaacctccctacgaacgttcggacgggaggaccgaaggtggagatacgaaacgtactggtggctgaccaccatctgtcttctaccg

SEQ ID NO: 160093 - DNA, 495 bp, Homo sapiens
  misc_feature: GYAE6OF02I7MXJ.19.83.H06.1.454.CMB.1.raw
  modified_base (492)..(492): a, c, t, g, unknown or other
  misc_feature (492)..(492): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagatttacactgaaatcaacagagtggagctgaggtatgttgggtttattactgcatgcaagctctacaactcctactaacgttcgacggacggacgaaggtggagactacgaaacgactgtgctgacacatctgtctntac

SEQ ID NO: 160094 - DNA, 527 bp, Homo sapiens
  misc_feature: GYAE6OF02G0Y5T.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccaggggcagtctccacagctcctgatctatttgggttctaatcgggcctccggggtccctgacaggttcagtggcagtggatcaggcacagatttacactagaaatcaaacagagtggaggctgaggagtggttggggtttattacgtgtactagtgacaagctactaacaactccctactaacgttcggacggagggaacctagggtacggagatacgaaacggtactggtgcgtgaccgacacgtcgtagtcttctaccg

SEQ ID NO: 160095 - DNA, 507 bp, Homo sapiens
  misc_feature: GYAE6OF02I65B0.19.83.H06.1.454.CMB.1.raw
  modified_base (438)..(438): a, c, t, g, unknown or other
  misc_feature (438)..(438): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaagtcggcctccggggtccctgacaggttcagtggcagtggatcaggcacagtatttacactagaaatcaacagagtggagctgaggatggttagggtttattactgctatgcaagctactactaaactccctanaacgttcggcggacggaccgaagggtggagatacaaacggtactggtgctgacactatctctcttctac

SEQ ID NO: 160096 - DNA, 509 bp, Homo sapiens
  misc_feature: GYAE6OF02JA87U.19.83.H06.1.454.CMB.1.raw
  modified_base (326)..(326): a, c, t, g, unknown or other
  misc_feature (326)..(326): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccgggtcctgacnggttcagtggcagtggatcaggcacagtatttacactagaaatcaacagagtggagctgaggagtggttaggggtttattacgtgcatgacaagctactaacaacctccctacaacgttcggcggacggacgaaggtgagagtacgaaacgtaactggtggactgacaccatctgttctctac

SEQ ID NO: 160097 - DNA, 549 bp, Homo sapiens
  misc_feature: GYAE6OF02JB3CD.19.83.H06.1.454.CMB.1.raw
  modified_base (412)..(412): a, c, t, g, unknown or other
  misc_feature (412)..(412): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagagccggcctccatctcctgcaagtctagtcagagcctcctacatagtaatggacacaactattggattggtacctgcagaagccagggcagtctccacagctcctgatctattgggttctaatcggcctccgggtcctgacaggttcagtgcagtggatcaggcacagattttacactagaaatcaaacgagagtggagctgaggtatggttgggttattacgtgactangtcaaggtctacgtaaccaaacctccctacgtaaccggttcggtagggtaacgggtaccgaagggtggagaagtaccgaaacggaaaccttgggtacgacgtagaccgtacccagttccgtaggttccttactaacg

SEQ ID NO: 160098 - DNA, 494 bp, Homo sapiens
  misc_feature: GYAE6OF02H81ZE.19.83.H06.1.454.CMB.1.raw
  modified_base (491)..(491): a, c, t, g, unknown or other
  misc_feature (491)..(491): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtcctgacaggttcagtggcagtggatcaggcacagattttacactgaaaatcaacagagtggaggctgaggatggttggggtttattactgcatgcaagctctaacaactccctcacgttcggcggaggaccaaggtgagatcgaaacgactgtgctgcaccatctgtcttntac

SEQ ID NO: 160099 - DNA, 493 bp, Homo sapiens
  misc_feature: GYAE6OF02FRE6Y.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggtctaatcggctccgggtcctgacaggttcagtggcagtggatcaggcacagattttacactagaaatcaaacagagtggagctgaggatgttggggtttattactgcatgcaagctctacaactccctcaacgttcggcggaggaccgaaggtggagatacgaaacgaactgtgctgcaccatctgtcttctac

SEQ ID NO: 160100 - DNA, 501 bp, Homo sapiens
  misc_feature: GYAE6OF02IQING.19.83.H06.1.454.CMB.1.raw
  modified_base (376)..(376): a, c, t, g, unknown or other
  misc_feature (376)..(376): n is a, c, g, or t
  modified_base (460)..(460): a, c, t, g, unknown or other
  misc_feature (460)..(460): n is a, c, g, or t
  modified_base (497)..(497): a, c, t, g, unknown or other
  misc_feature (497)..(497): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtcctgacaggttcagtggcagtggatcaggcacagattttacactgaaatcaacagngtggaggctgaggatggttggggttattacgtgcatgacagtctactacaactccctcaacgttcggcggaggaccaggtgganagtacgaaacgactggtgctgcacctatctggtcttntacg

SEQ ID NO: 160101 - DNA, 509 bp, Homo sapiens
  misc_feature: GYAE6OF02I47P6.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagccctcctacatagtaatggacacaactatttggattggtacctgcagaagcccagggcagtctccacagctcctgatctattgggttctaatcgggcctccggggtcctgacaggttcagtggcagtggatcaggcacagattttacactagaaatcaacagagtggagctgaggatgttggggtttattagtgcatgcaaggctctacaaactccctacgtacgttcggcggagggaccaagggtgagatacgaaacgtacctggtggctgaccaccatctcgttcttctacg

SEQ ID NO: 160102 - DNA, 622 bp, Homo sapiens
  misc_feature: GYAE6OF02I7BU6.19.83.H06.1.454.CMB.1.raw
  modified_base (350)..(350): a, c, t, g, unknown or other
  misc_feature (350)..(350): n is a, c, g, or t
tcagtactctcgtgcacgaccggtgctcgatttagatcacgtgcgtcgcgggcgtagacgtttgtgtttctcgtagtctgctttgctcagcgtcagggtgctgctaatgctctgggtctctggatccagtggggatattgtggtgactaagtctccactctccctgcccgtcattcctggagagccggcctccatctcctgcaagtctagtcagacgcctcctacatagtaatggacacaactatttggattggtacctgcagaagccagggcagtctccacagctctgatctatttggtctaatcgggcctccgggtcctgacagttcagtggcagtggatcaggcacngtatttacactagaaatcaacagacgtggaggtctagagtagtggtttaggggtttattacgtgtctagttcgacgtaacgtaccttacgttaaccaaccgttaccccgttacgttaaaccggttccggggaacgggtaacggggaaaccgtaaacggggtacgggtaacgtaacggttaaccaaaccggtaaacgtacgggttacgggtacgttacggaccctaacccgtaacgttccgttcggttacgtttacccgtacgtttaccccgg

SEQ ID NO: 160103 - DNA, 504 bp, Homo sapiens
  misc_feature: GYAE6OF02HU3UT.19.83.H06.1.454.CMB.1.raw
  modified_base (463)..(463): a, c, t, g, unknown or other
  misc_feature (463)..(463): n is a, c, g, or t
  modified_base (501)..(501): a, c, t, g, unknown or other
  misc_feature (501)..(501): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctcggggtccctgacaggttcagtggcagtggatcaggcacagatttacactagaaatcaacagagtggagcgtgaggattggttggggtttattacgtgctagtgcaagctacgtacaaactccctacgaacgttcggcggaggaccaggngagatacgaacgaactggtagctgacacatctcgtctntac

SEQ ID NO: 160104 - DNA, 586 bp, Homo sapiens
  misc_feature: GYAE6OF02JWDNZ.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttgattggtacctgcagaagccgagggcagtcctaccacagcctcctgattccttagttttcgggttacttaaacgtccgggcccgttcccggggtcccctagacgtaggttccaggtggctacgtggatcgaggacacagtactttacacgtagaaaactacaacaggaagtggaggtcgtgaaggtagttggttaggggtttacttacgtgtaccgtagtggacaacgtacgtacctaaccgtaaccttcccgtacgtaaccggttcggtagggaggtaaccgaaggtgagtatacgaaacgtagtgtacgacgtgacgtactactcgtagtaccttctac

SEQ ID NO: 160105 - DNA, 530 bp, Homo sapiens
  misc_feature: GYAE6OF02FUDL9.19.83.H06.1.454.CMB.1.raw
  modified_base (348)..(348): a, c, t, g, unknown or other
  misc_feature (348)..(348): n is a, c, g, or t
  modified_base (409)..(409): a, c, t, g, unknown or other
  misc_feature (409)..(409): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttggtctaatcgggcctccgggtcctgacaggttcagtggcagtggatcaggcanagtatttacactagaaatcaacagagtggaggctagaggtagtggttggggtttattacgngctatgacagtctacgtaacaacctccctacgtacgttcggacggacggaccgaaggtgagacgtacgaaacgtaacgtcggtacggcgttgaccaccgtactcgtcgttccttactaccg

SEQ ID NO: 160106 - DNA, 488 bp, Homo sapiens
  misc_feature: GYAE6OF02HKDED.19.83.H06.1.454.CMB.1.raw
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
  modified_base (439)..(439): a, c, t, g, unknown or other
  misc_feature (439)..(439): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagatttacactgaaatcaaacagagtggaggctgagatgttgggtttattactgcatgcaagctntacaattcctnaacgttcggnggaggacaggtgagatacgaacgatgaggctgcaccatctgttctctac

SEQ ID NO: 160107 - DNA, 522 bp, Homo sapiens
  misc_feature: GYAE6OF02IJR70.19.83.H06.1.454.CMB.1.raw
  modified_base (340)..(340): a, c, t, g, unknown or other
  misc_feature (340)..(340): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcngtggatcgaggcacagtatttacactagaaatcaacagagtggaggctgaggatggtttaggggtttattacgtgcatgcaagctactaacaacctccctacgtaacggttccggacggacgggaccgaagggtggagatacgaaacgaactgtcggactgacaccgatctgtctactaccg

SEQ ID NO: 160108 - DNA, 512 bp, Homo sapiens
  misc_feature: GYAE6OF02F6415.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagtatttacactgaaatcaacagagtggagctgaggatggttggggtttattacgtgcatgacagtctactaacaacctccctacaacggttccggacggacggaccgaaggtggagactacgaaacgactggtcggctagcactatgtcgttctctac

SEQ ID NO: 160109 - DNA, 546 bp, Homo sapiens
  misc_feature: GYAE6OF02H4TAD.19.83.H06.1.454.CMB.1.raw
  modified_base (275)..(275): a, c, t, g, unknown or other
  misc_feature (275)..(275): n is a, c, g, or t
  modified_base (496)..(496): a, c, t, g, unknown or other
  misc_feature (496)..(496): n is a, c, g, or t
  modified_base (542)..(542): a, c, t, g, unknown or other
  misc_feature (542)..(542): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctctacatagtaatggacacaactatttggattggtacctgcagaagccagggcagtcnccacagctcctgatcttatttgggttctaagtcgggcccgtccggggtccctggacgtaggttcaggtggcaggtggatcgaggcaactagtactttacactagaaatcaacagaggtggaggctaggaggtagttggttagggtttaattacgtgactattgacgtaacgtcttacctaactaacctccctacgtaacggttcggacggaggacgtaggngagactacgaacgtactggtcgacgtgacactattcgtgttccttntacc

SEQ ID NO: 160110 - DNA, 398 bp, Homo sapiens
  misc_feature: GYAE6OF02HBBTR.19.83.H06.1.454.CMB.1.raw
  modified_base (249)..(249): a, c, t, g, unknown or other
  misc_feature (249)..(249): n is a, c, g, or t
  modified_base (263)..(263): a, c, t, g, unknown or other
  misc_feature (263)..(263): n is a, c, g, or t
  modified_base (350)..(398): a, c, t, g, unknown or other
  misc_feature (350)..(398): n is a, c, g, or t
tcagtactctcgtgcacgaccggtgctcgatttagatcacgtgcgtcgcggacgaatctacgagcacagcctacatggacctgagcagcctgagatctgagggacacggccatatagttactgtgcgagagcaggctacagtaactctattcctttctactactactactacatggacgtctggggcaatgggaccacggtcacccgtctcctcagcctccaccaagggcccatcggtcttcccctgcnccctgctccaggancacctccgagagcacagcggccctgggctgcctggcaaggcctacttcccacgagagtactgagccgggctggacaaggcgcatagnnnnnnnnnnnnnnnnnnnnnnnnnnnnnnnnnnnnnnnnnnnnnnnnn

SEQ ID NO: 160111 - DNA, 526 bp, Homo sapiens
  misc_feature: GYAE6OF02GXZ91.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggtctaatcgggcctccggggtcctgacaggttcagtggcagtggatcaggcacagattttacactagaaatcaaacagagtggaggctggaggtatggttaggggtttattacgtgcatgacaagtctactaacaaacctcctactaacggttcgacgggacggaaccgaagggtggagagtacgaaacgaacttggtggacgtgacaccagttctgttcttactaccg

SEQ ID NO: 160112 - DNA, 509 bp, Homo sapiens
  misc_feature: GYAE6OF02I2819.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaatcaaacagagtggaggctgagatgttggggtttattacgtgcagtgacaagctactacaaactccctactaacgttcgcggacgggaccaagggtggagatacgaaacgaactggtaggctgccacatctgtcttctacc

SEQ ID NO: 160113 - DNA, 600 bp, Homo sapiens
  misc_feature: GYAE6OF02IZZ3W.19.83.H06.1.454.CMB.1.raw
tcagtactctcgtgcacgaccggtgctcgatttagatcacgtgcgtcgcgggcgtagactttgtgtttctccgtagtctgctttgctcagcgtcagggtgctgctaatgctctgggtctctggatccagtgggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaagtcgggcctccggggtccctgacaggttcaggtgcagtggatcaggcacagtagttttacactagaaatacaaacagagtaggaggctaggacggagttggtttaggggtttattacgtgacagtgacaacggcttacgttaaccaaacctccctactaaccggttccgggacgggaacggacccgaaagggtcggaacgtaacgtaacgaaaaccggtaaccgttagggtacggtaccgttacggacccgtaacccgtaaccgtttccgttacggtttaccttaccgtaacccg

SEQ ID NO: 160114 - DNA, 531 bp, Homo sapiens
  misc_feature: GYAE6OF02G2WCV.19.83.H06.1.454.CMB.1.raw
  modified_base (329)..(329): a, c, t, g, unknown or other
  misc_feature (329)..(329): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagccctcctacatagtaatggacacaactatttggattggtacctgcagaagccagggcagtctccacagctcctgatctatttgggttctaatcgggcctccggggtccctgacnggttcagtggcagtggatcaggcacagtattttacactagaaaatcaacagagtggagctgaggtattggtttggggtttattacgtgacatcgacaagtctactaactaaacctcccctagtaaccggtttcggaccgggtaaggaaccgtaagggtggagtactacgaaacgacgtggtgctggacacatctgtctctac

SEQ ID NO: 160115 - DNA, 525 bp, Homo sapiens
  misc_feature: GYAE6OF02HSQPF.19.83.H06.1.454.CMB.1.raw
  modified_base (475)..(475): a, c, t, g, unknown or other
  misc_feature (475)..(475): n is a, c, g, or t
  modified_base (521)..(521): a, c, t, g, unknown or other
  misc_feature (521)..(521): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcaggtggatcaggcaacagtattttacactagaaaatcaaacagaggtggaggctaggaggagttggttggggtttattacgtgctagtgcaagctactaacaactccctacgaacgttcggcggaggaccgaaggnggagagtaccgaaagacgtgtcggtctggaccacattctgtccttntacc

SEQ ID NO: 160116 - DNA, 353 bp, Homo sapiens
  misc_feature: GYAE6OF02GPD1Z.19.83.H06.1.454.CMB.1.raw
  modified_base (347)..(353): a, c, t, g, unknown or other
  misc_feature (347)..(353): n is a, c, g, or t
tcagtactctcgtgcacgaccggtgctcgatttagatcacgtgcgtcgcggacgaatctacgagcacagcctacatggacctgagcagcctgagatctgaggacacggccatatattactgtgcgagagcaggctacagtaactctattcctttctactactactactacatggacgtctggggcaatgggaccacggtcaccgtctcctcagcctccaccaagggcccatcggtcttcccctggcgccctgctccaggagcacctccgagagcacagcggccctgggctgcctggtcaaggactacttcccacgagagtactgagcgggctggcaaggcgcatagnnnnnnn

SEQ ID NO: 160117 - DNA, 529 bp, Homo sapiens
  misc_feature: GYAE6OF02F0AEI.19.83.H06.1.454.CMB.1.raw
  modified_base (524)..(524): a, c, t, g, unknown or other
  misc_feature (524)..(524): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttggttctaagtcgggcctccggggtccctgacaggttcagtggcagtggatcaggcacagtatttacactagaaatcaaacagagtggaggctggaggtattggttaggggtttattacgtgctagtgacaagctacgtaacaactccctagtaacgttcggacggaggaccgaaggtggacgagtacgaaacgtacgtggtacgctgacctactatcgtacgttccttntaccg

SEQ ID NO: 160118 - DNA, 712 bp, Homo sapiens
  misc_feature: GYAE6OF02IC7KQ.19.83.H06.1.454.CMB.1.raw
tcagtactctcgtgcacgaccggtgctcgatttagatcacgtgcgtacgcggcgtaagggactttgtgtttctcgtagtctggcttgctcagcggtcaggtgcgtcgctatgctctggggtctctggatccagtggggatacgttggtggtcgactcagtctccactcctcctgcccgtaccagttcctcggagtacgtcccggtccttcctatcctcctcgcgtaaaggtctagtcgaagtacgacctacctacacttaggtaacgtggaacacaaactatttggattggacctggtactaagtaaggtccgagggcacgtactaaccacggaacgtccctaccgtgacttcttagtttgggtactaacgtcgggcctccgggtcctgtacgaggttacgaggtcgcctaggtggactacgaggtcacgtaggttagtttaccgacggttaacgaaaacttctaaacgtacgtaacgttacggaaacggtccgttaagggacggtaacgttcgggttttacggggtttaacttaaccgtaggtaacgttaagttcgaactaaaccgttacgttacctaaacgtaaccttacccgtaagttaaccggttacgaaacggtacggtaaccctaagggtacgtacgtaccgtaacgaaacggtacgtagtacggtcgaacgtactaaccgtagttcgttacgtccttacgtaccg

SEQ ID NO: 160119 - DNA, 494 bp, Homo sapiens
  misc_feature: GYAE6OF02FNCDM.19.83.H06.1.454.CMB.1.raw
  modified_base (457)..(457): a, c, t, g, unknown or other
  misc_feature (457)..(457): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaatcaacagagtggaggctgaggatgttgggtttattacgtgcatgcaagctctacaactccctcaacgttcgcggaggaccaggtgganagtacgaaacgactgtggctgacacatctgtctctac

SEQ ID NO: 160120 - DNA, 496 bp, Homo sapiens
  misc_feature: GYAE6OF02HP4BE.19.83.H06.1.454.CMB.1.raw
  modified_base (438)..(438): a, c, t, g, unknown or other
  misc_feature (438)..(438): n is a, c, g, or t
  modified_base (493)..(493): a, c, t, g, unknown or other
  misc_feature (493)..(493): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagatttacactgaaaatcaaacagagtggaggctggaggattggttggggtttaattacgtgcatgacagctctacaactccctnacgttcggcggaggacaggtgagatacgaaacgactagtgctgcacatctgtctntac

SEQ ID NO: 160121 - DNA, 587 bp, Homo sapiens
  misc_feature: GYAE6OF02H50WO.19.83.H06.1.454.CMB.1.raw
  modified_base (181)..(181): a, c, t, g, unknown or other
  misc_feature (181)..(181): n is a, c, g, or t
  modified_base (241)..(241): a, c, t, g, unknown or other
  misc_feature (241)..(241): n is a, c, g, or t
  modified_base (385)..(385): a, c, t, g, unknown or other
  misc_feature (385)..(385): n is a, c, g, or t
tcagtactctcgtgcacgaccggtgctcgatttagatcacgtgcgtcggcgggcgtagacctttgtgtttctcgtagtctgcttttgctcagcgtcagggtgctgctaatgctctgggtctctggattccgagtggggatattggttcggtgactcagttctccgactctccctgcccgtnattcctggagagccggcctccggatctcctgccaaggtctacgtcagacgtccctcctanatagtaagtggacacaacttatttggtattacggtacctggcagaacgccgagggcagtctccacaggcctccgtgatctagttttggtctaagtcgggtccttccgggtcctgactaggttcagtgactagtggatcaggcanagtatttacactagaaatcaacagagtaggagtctagagtagtagtttagggtttattacgtgactagtacgacaagctacgtactaaacgtaccgtacgtaacgttcggtacggtacggtaacgtaagggtacggagtagtaacgaaacgtaacgtaggtcgacgtacgactaccgtacttcgttcgtaccttacgtaccg

SEQ ID NO: 160122 - DNA, 494 bp, Homo sapiens
  misc_feature: GYAE6OF02FNM9Q.19.83.H06.1.454.CMB.1.raw
  modified_base (492)..(492): a, c, t, g, unknown or other
  misc_feature (492)..(492): n is a, c, g, or t
tcagtactctcgtgcacgaccggtgctcgatttagatcacgtgcgtcgcggacgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaaacagagtggaggctgaggatgttggggtttattacgtgcatgcaagctactacaactccctcaacgttcggcggaggaccaaggtgagatacaaacgactgtgctgcacatctgtctnac

SEQ ID NO: 160123 - DNA, 501 bp, Homo sapiens
  misc_feature: GYAE6OF02JHN4U.19.83.H06.1.454.CMB.1.raw
  modified_base (325)..(325): a, c, t, g, unknown or other
  misc_feature (325)..(325): n is a, c, g, or t
  modified_base (492)..(492): a, c, t, g, unknown or other
  misc_feature (492)..(492): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggttctaatcggcctcggggtccctgacnggttcagtggcagtggatcaggcacagatttacactgaaatcaacagagtggaggctggagatggttgggtttattcgtgcatgcaaggctacacaactccctcgaacgttcggcggacggaccgaaggtgagagtacgaaacgacgtgtagcgtgacaccgatcgngtcttctac

SEQ ID NO: 160124 - DNA, 557 bp, Homo sapiens
  misc_feature: GYAE6OF02IBXX4.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctcccctgcccgtcattcctggagagccggcctccatctcctgcaagtctagtcagagcctcctacatagtaatggacacaactatttggattggtacctgcagaagccaggcagtctcacagctcctgatctatttgggttctaatcgggcctccggggtccctgacaggttcagtggcagtggatcaggcacagtattttacactagaaatcaacagagtggagctgaggtagtggttgggtttattacgtgctagtgacaagcttacctaactaacctccccgtactaaccggttcggccgggtaagggaccgtaagggtggacgtacgtaccgaaacggtaacgttggtacggtctacggaccaccgtacttccgttacgttaccttacgtaccg

SEQ ID NO: 160125 - DNA, 523 bp, Homo sapiens
  misc_feature: GYAE6OF02H2A26.19.83.H06.1.454.CMB.1.raw
  modified_base (372)..(372): a, c, t, g, unknown or other
  misc_feature (372)..(372): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaagtcggcctccgggtcctgacaggttcagtgcagtggatcgagcacagtatttacactagaaatcaanagagtggagctgaggatggttgggtttattacgtgacatgacaagctactaacaactccctacgacgttcggacgggaggaccgaagggtcgagataccgaaagtacgtggtacgtacgtacgacctaccgattcgtacgttcctctaccg

SEQ ID NO: 160126 - DNA, 548 bp, Homo sapiens
  misc_feature: GYAE6OF02G4QD4.19.83.H06.1.454.CMB.1.raw
  modified_base (536)..(536): a, c, t, g, unknown or other
  misc_feature (536)..(536): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaacttattggattggtacctgcagaagccagggcagtctccacagctcctgatctatttggttctaagtcgggcctccggggtccctggactaggttcagtggcaggtggatcgaggcacagtatttacactagaaactcaacagagtggagctaggaggtagttggttagggtttattacgtgtacgtatgacagtctactaacctaacctcccgtactaacggttcggtagggacggacgtaagggtggacgacgtacgaaacggtacgtggtacggtcgtgaccacgtattacgtnttcgttactacg

SEQ ID NO: 160127 - DNA, 508 bp, Homo sapiens
  misc_feature: GYAE6OF02G0VM2.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactagaaatcaaacagagtggaggctgaggattggttaggggtttattacgtgcatgacagctactacaactccctcaacgttcggacggaggaccaaggtggagacgtacgaaacgatagtgctcgactaccatctgtctctacg

SEQ ID NO: 160128 - DNA, 514 bp, Homo sapiens
  misc_feature: GYAE6OF02GZOR1.19.83.H06.1.454.CMB.1.raw
  modified_base (510)..(510): a, c, t, g, unknown or other
  misc_feature (510)..(510): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtcctgacaggttcagtggcagtggatcaggcacagattttacactagaaaatcaaacagagtggaggctgaggtatggttggggttattacgtgcatgacaagtctactacaaacctccctacgtaaccgttcgggacggagggaccaagggtggagatacgaaacgaactgtgctgcacatctgttcttntacc

SEQ ID NO: 160129 - DNA, 356 bp, Homo sapiens
  misc_feature: GYAE6OF02F9SW5.19.83.H06.1.454.CMB.1.raw
  modified_base (348)..(356): a, c, t, g, unknown or other
  misc_feature (348)..(356): n is a, c, g, or t
tcagtactctcgtgcacgaccggtgctcgatttagatcacgtgcgtcgcggacgaatctacgagcacagcctacatggacctgagcagcctgagatctgaggacacggccatatattactgtgcgagagcaggctacagtaactctattcctttctactactactactacatggacgtctggggcaatgggaccacggtcaccgtctcctcagcctccaccaagggcccatcggtcttccccctggcgccctgctccaggagcacctccgagagcacagcggccctgggctgcctggtcaaggactacttcccacgagagtactgagcgggctggcaaggcgcatagnnnnnnnnn

SEQ ID NO: 160130 - DNA, 489 bp, Homo sapiens
  misc_feature: GYAE6OF02FI0C4.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccagggtccctgacaggttcagtggcagtggatcaggcacagattttacactgaaaatcaacagagtggagctgaggatggttgggtttatactgcatgcaagctactacaactcctacacgttcggcggaggaccaggtgagatcaaacgactgtgctgcacctatctgtcttac

SEQ ID NO: 160131 - DNA, 561 bp, Homo sapiens
  misc_feature: GYAE6OF02IQX9G.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctattgggtctaatcggcctccgggtcctgacagttcagtgcagtggatcaggcacagtatttacactagaaatcaacagagtggagctgagtatggttgggtttatacgtgcatgcaagctactaacaaacctccctacgaaccgtttcgggacgggaacgggtaccgaagggttcgggagtaagtacccgaaaacggtaaccgttggtacgggtaccttaggaccctaacccgtacttaccggttacggttaccctttacgttaacccg

SEQ ID NO: 160132 - DNA, 504 bp, Homo sapiens
  misc_feature: GYAE6OF02GMCNB.19.83.H06.1.454.CMB.1.raw
  modified_base (326)..(326): a, c, t, g, unknown or other
  misc_feature (326)..(326): n is a, c, g, or t
  modified_base (410)..(410): a, c, t, g, unknown or other
  misc_feature (410)..(410): n is a, c, g, or t
  modified_base (500)..(500): a, c, t, g, unknown or other
  misc_feature (500)..(500): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccgggtcctgacnggttcagtggcagtggatcgaggcacagtattttacactagaaatcaacagagtggagctgaggatggttgggttattacgtgnatgcagctacacaactccctactacgttcggacggacggacgaggtggagacgtacgaaacgtaacgtggtaggctgcacatctcgtctntacc

SEQ ID NO: 160133 - DNA, 638 bp, Homo sapiens
  misc_feature: GYAE6OF02HEB03.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggttctaagtcgggcctccgggtcctgactagttcagtggcagtggatcgaggacacagtattttacactagaaaatacgaaacagaaggtaggaggcttaggaaggtagttagggtttaggggttttaacttacgttagtaccgtaatcgacaaacggtcttaccttaaacctaaaccttcccccgttaacgttaaacccgggtttaccggggaccggggtaaacggggtaaaccccgtaaaggggttacgggaacggtaacgttaaccgaaaaccggtaaccgttaggtacgggtaccgtacgaccgaaccctagttaccttcggttacttacctaaccg

SEQ ID NO: 160134 - DNA, 525 bp, Homo sapiens
  misc_feature: GYAE6OF02FY8TW.19.83.H06.1.454.CMB.1.raw
  modified_base (328)..(328): a, c, t, g, unknown or other
  misc_feature (328)..(328): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacnggttcagtggcagtggatcaggcacagtattttacactagaaatcaaacagagtggaggctgaggtatggttagggtttattactgcagtgacaagcttactaacaacctccctactaacgttcgggcggagggaaccaagggtggagtacgtacgaaacggacttggtggctgccacctatctcgttcttctaccg

SEQ ID NO: 160135 - DNA, 531 bp, Homo sapiens
  misc_feature: GYAE6OF02H50VK.19.83.H06.1.454.CMB.1.raw
  modified_base (171)..(171): a, c, t, g, unknown or other
  misc_feature (171)..(171): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagagcccggcctccatcctcctgcaagtctagtcagacgccctcctacatagtaatggacacaactatttggattggtacctgcagaagccagggcagtctccacagctcctgatctatttgggttctaagtcgggcctccggggtccctgacaggttcagtggcagtggatcgaggcacagtatttacactagaaatcaacagagtggaggctggaggtagtggtttaggggtttattacgtgacatgcaaggtctactaacaactccctacgtaacgttcgggacggacggaactaagggtgagactacgaaacgtacgtaggtgactgacctacatctcgtctcgtacc

SEQ ID NO: 160136 - DNA, 517 bp, Homo sapiens
  misc_feature: GYAE6OF02IA3UD.19.83.H06.1.454.CMB.1.raw
  modified_base (327)..(327): a, c, t, g, unknown or other
  misc_feature (327)..(327): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccgggtccctgacnggttcagtgcagtggatcgaggcacagtatttacactagaaatcaacagagtggagctgagatggttgggttattactgcatgacaagctactacaactccctagtaacgttcggacggagggaaccgtaagggtggagacgtacgaaacgtacgtggtacggctagcaccgtatctacgttcttctacc

SEQ ID NO: 160137 - DNA, 519 bp, Homo sapiens
  misc_feature: GYAE6OF02FK4ED.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagagccggcctccatctcctgcaagtctagtcagagcctcctacatagtaatggacacaactatttggattggtaccttgcagaagccagggcagtctccacagctcctgatctatttgggttctaatcgggcctccggggtcctgacaggttcagtggcagtggatcaggcacgagtattttacgactgaaatcaacagtagtggaggctggaggtatggttgggtttattactgctatgacagctactacaaactccctactacgttcggcggagggaccaaggtggagatacgaaacgtaactggtacggcgtagcacctagtactgtcttctacg

SEQ ID NO: 160138 - DNA, 538 bp, Homo sapiens
  misc_feature: GYAE6OF02I08FB.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggtctaagtcggcctcgggtcctgacagtcagtggcagtggatcaggcacagtatttacactagaaatcaaacagagtggaggctagaggattaggttggggtttaattaacgtgtcagtgacaagcctacaacaaacctcccgtactaaccggttcggacggacggtaaccgaaggttggatagtacgaaaacggtacgtaggtcggactcggaccacctattcgtacgttacttctaccg

SEQ ID NO: 160139 - DNA, 503 bp, Homo sapiens
  misc_feature: GYAE6OF02FQ245.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttgggttctaagtcgggcctccgggtccctgacaggttcagtggcagtggatcgaggcacagtattttacactagaaatcaacagagtggagctgagtattggttggggtttattacgtgctatgacaagctactaacaactccctatacgttcggcggaggaccaggtggagacgtacgaacgactggtgctgcacatctgtcttctac

SEQ ID NO: 160140 - DNA, 534 bp, Homo sapiens
  misc_feature: GYAE6OF02GM61U.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggtctaatcgggcctccgggtccctgacaggttcagtggcagtggatcaggcacagtatttacactagaaatcaaacagagtggaggctgaggattggttgggtttattacgtgactagtgacagtctactaaccaaaccgttccctacgtaacgttcggacgggacggaaccgaagggtagagatacgaaacgtaacgtggtaggactagaccaccgtatctacgtcttactacccg

SEQ ID NO: 160141 - DNA, 561 bp, Homo sapiens
  misc_feature: GYAE6OF02JG9FV.19.83.H06.1.454.CMB.1.raw
  modified_base (259)..(259): a, c, t, g, unknown or other
  misc_feature (259)..(259): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattgattggtacctgcanaagccagggcagtctcacagctcctgatctattggtctaagtcgggcctccgggtccctgactaggttcagtcggctagtggatcgaggcacgagtactttacactagaaactcaacgagagtggagtcgtagaggtacgttggttagggtttaacttacgtagctagtacgactaaggtacgttactaacaaaccttccctacgtaacggttccgggacggtaacgggaacgaagggtaggacgaacgtacgaaacggtaactgtcggctacgactacgacgttctacggttcttctaacg

SEQ ID NO: 160142 - DNA, 504 bp, Homo sapiens
  misc_feature: GYAE6OF02HMN4A.19.83.H06.1.454.CMB.1.raw
  modified_base (172)..(172): a, c, t, g, unknown or other
  misc_feature (172)..(172): n is a, c, g, or t
  modified_base (500)..(500): a, c, t, g, unknown or other
  misc_feature (500)..(500): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtnattcctggagagccggcctccatctcctgcaagtctagtcagagcctcctacatagtaatggacacaactatttggattggtacctgcagaagccagggcagtctccacagctcctgatctatttggtctaatcgggcctccggggtcctgacaggttcagtggcagtggatcaggcacagattttacactagaaaatcaaacagagtggaggctagaggattggttggggtttaattacgtgcatgacaagctactaacaactccctacaacgttcggcggacggacagggtgagactacgaacgaactgtgctgcacatctgtctntacg

SEQ ID NO: 160143 - DNA, 707 bp, Homo sapiens
  misc_feature: GYAE6OF02JCSFJ.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatcctcctgcaagtctagtcagacgcctcctacatagtaatggacacaactattggattggtacctgacagaacgccaagggcagtctccacgacgctcctgactcttagtttgggtactaacgtcgggtcccgtaccggggtccctggacctaggttcaggtcggcaggtcggatacgaggcagtagtactttaccataagaaactacgaaacgagtaggtgggacgtcgtaggaggtagtttcgggttaggggttttaacttacgtcgtactaacgttcggaaccgtaaggttaccttaaccgttaaaaccctaaacccgttttccccgttaaaccggttaaaccggggttttacggggtaacggggtaaaccggggtaacccgtaaaggggtttacgggaaggtaaccgtaaccgggtaaaaaccggttaaccggttcggggtaaccggtaccggttaccgaacccgtaacccgttacgttacccgtttacgtttaccgttaccgttaaccg

SEQ ID NO: 160144 - DNA, 646 bp, Homo sapiens
  misc_feature: GYAE6OF02I89ZV.19.83.H06.1.454.CMB.1.raw
tcagtactctcgtgcacgaccggtgctcgatttagatcacgtgcggtcgcgggcgtagactttgtgtttctcgtagtctgctttgctcagcgtcagggtgctgctaatgctctgggtctctggatccaggtggggatattgtggtgactcagtctccactctccctgcccgtcattcctggagacgccggcctccatctcctgcaagtctagtcagagcctcctacatagtaatggacacaactatttggattggtacctgcagaagccaagggcagtctccacagctcctgactctatttgggtactaacgtccgggcctccggggtccctgacgtacggttcaggtcggcaggtaggactcggacggtcaaccagtaacttttaaccgaactaagtaaaactacgaaacgtaggtaacgggtaggaacggtcgtaggtaggtaaggtttagggtttaggggttttaaacttacgtagtacgtagttcgactaacggtctacgtaacctaaccgtacccgtacgtaacggttcgggtaacgggtacggaaccgtagggtacgagtaacgtaacgtaaacggtaacgcgggttacggaccgttacgaccgtaaccgtattaccggttacgttacctacgttacccg

SEQ ID NO: 160145 - DNA, 498 bp, Homo sapiens
  misc_feature: GYAE6OF02GZPGF.19.83.H06.1.454.CMB.1.raw
  modified_base (477)..(477): a, c, t, g, unknown or other
  misc_feature (477)..(477): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggtctaatccgggcctccgggtccctgacaggttcagtggcagtggatcaggcacagtactttacactagaaatcaacagagtggagctgaggatggttgggtttattacgtgcatgcagctctacaactccctactacgttcggcggacggacgaaggtggagactacgaaacgacgtgnggctagcacatctgtctctac

SEQ ID NO: 160146 - DNA, 505 bp, Homo sapiens
  misc_feature: GYAE6OF02HCKWL.19.83.H06.1.454.CMB.1.raw
  modified_base (281)..(281): a, c, t, g, unknown or other
  misc_feature (281)..(281): n is a, c, g, or t
  modified_base (484)..(484): a, c, t, g, unknown or other
  misc_feature (484)..(484): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacngctcctgatctatttgggtctaagtcgggcctccggggtccctgacaggttcagtggcagtggatcaggcacagtatttacactgaaaatcaacagagtggaggctgaggattggttggggtttattacgtgctatgacagctactaacaactccctactaacgttcggtaggacggacgaggtgagagtacgaaacgactgngctgcacatctgtcttctacg

SEQ ID NO: 160147 - DNA, 565 bp, Homo sapiens
  misc_feature: GYAE6OF02FK4DN.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttgggttctaagtcgggccgtccggggtccctgacaggttcagtggcaggtggatcgaggcacgagtacttttacactagaaatcaacagagtggaggctgaggtatggtttagggtttattacgtgactatgacaagtctactaactaaacctcccgttacgtaaccggtttcggaccggaagggaccgaagggttggaagtacgtaaccgaaaacggacgttaggtcggtacgtcgaccgacctaacgttcgtacgttccttacctaccg

SEQ ID NO: 160148 - DNA, 509 bp, Homo sapiens
  misc_feature: GYAE6OF02FWH7C.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttgggttctaatcgggcctccggggtccctgacaggttcagtggcagtggatcaggcacagatttacactagaaatcaacagagtggaggctgaggtatggttggggtttattacgtgctatgacaagctactacaaacctccctacacgttcggacggagggaccgaaggtggagatacgaaacgactggtgcgtagcactctatcgtctctacg

SEQ ID NO: 160149 - DNA, 602 bp, Homo sapiens
  misc_feature: GYAE6OF02HOHEV.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaacttattggattggtacctgcagaagccagggcagtctccacagctcctgattctatttgggttctaagtcgggccgttccgggtccctggactaggttcaggtggctaggtggactcgaggcacgagtacttttacactagaaactacaacgaagaggtggaggcgtaggaggtagttgggtttaggggtttaattacgtgtatagtgacaacgtctactaaccaacctccctaccgtaaccggtttccggacgggtacgggaaccgtagggtaggacgtaactaaccgaaaacggtacgttacggtcggtaccgtacggtaccgtaaccgtacgttaccgttcggttaccttaccgtaaccg

SEQ ID NO: 160150 - DNA, 493 bp, Homo sapiens
  misc_feature: GYAE6OF02G1GE9.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccgggtccctgacaggttcagtggcagtggatcaggcacagattttacactagaaatcaacagagtggaggctgaggatgttggggtttattacgtgcatgcaagctctacaacctcctcacgttcggcggaggaccaggtggagatacgaacgactgtggctgcacatctgtcttctac

SEQ ID NO: 160151 - DNA, 647 bp, Homo sapiens
  misc_feature: GYAE6OF02IIDXX.19.83.H06.1.454.CMB.1.raw
  modified_base (173)..(173): a, c, t, g, unknown or other
  misc_feature (173)..(173): n is a, c, g, or t
tcagtactctcgtgcacgaccggtgctcgatttagatcacgtgcgtcgcgggcgtagactttgtgtttctcgttagtctgctttgctcagcgtcagggtgctgctaatgctctgggtctctggatccaggtggggatattgtggtgactcagtctccactctccctgcccgtnattcctggagagccggcctccatctcctgcaagtctagtcagagcctctacatagtaatggacacaacttattggattggtacctgcaagaagccgagggctagtctccgacacgtctcctgtacttcgttagtttgggttactaagtccggggccgttcccgggggtccctgacgtaggttcaggtggcaggtgactcgaggcactaagtactttacaactaagaaactacaaacgagaaggtgggaagtcgtaggaggtagtttggggttttacggggtttaattacgtagtacgtagtagacgtaaacgtccgttaacctaaacctaaaccctcccgttaacgtaaccgggtttaccgggaacgggaacgggtaaccgtaaggggtacggacgtaactaacggtaaaacgtaacggttacggtacggtacctacggaccgaacgtacgttccgtacgtttccttatacccg

SEQ ID NO: 160152 - DNA, 352 bp, Homo sapiens
  misc_feature: GYAE6OF02HJSD0.19.83.H06.1.454.CMB.1.raw
  modified_base (270)..(270): a, c, t, g, unknown or other
  misc_feature (270)..(270): n is a, c, g, or t
  modified_base (313)..(313): a, c, t, g, unknown or other
  misc_feature (313)..(313): n is a, c, g, or t
  modified_base (336)..(336): a, c, t, g, unknown or other
  misc_feature (336)..(336): n is a, c, g, or t
  modified_base (342)..(352): a, c, t, g, unknown or other
  misc_feature (342)..(352): n is a, c, g, or t
tcagtactctcgtgcacgaccggtgctcgatttagatcacgtgcgtcgcggacgaatctacgagcacagcctacatggacctgagcagcctgagatctgaggacacggccatatattactgtgcgagagcaggctacagtaactctattcctttctactactactactacatggacgtctggggcaatgggaccacggtcaccgtctcctcagcctccaccaagggcccatcggtcttcccctgcgcctgctccaggagcacctccgagngcacagcggccctgggctgcctggtcaaggctactcccagagngtactgagcgggctggcaaggcncatagnnnnnnnnnnn

SEQ ID NO: 160153 - DNA, 610 bp, Homo sapiens
  misc_feature: GYAE6OF02G5PZ0.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgactctagtttggtctaagtccgggccgtccgggtccctgacgtaggttcagtggctaggtggatcgaggcaacgtagtactttacacgtagtaaactcaaacaggagtaggaggtctaggaggtagttgggttagggtttattacgtgactagtgtaccgaagtctacgttaaccaaccgttcccgtacgtaacggttaccgggaccgggaacgggtaaccgtagggtacggacgtacgttaaccggaaacggtaaccgttgggtacggtaccttacggacctaaccgtacgttccgtttacggtttaccgttaccgtacccg

SEQ ID NO: 160154 - DNA, 560 bp, Homo sapiens
  misc_feature: GYAE6OF02IC79E.19.83.H06.1.454.CMB.1.raw
  modified_base (360)..(360): a, c, t, g, unknown or other
  misc_feature (360)..(360): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtgggatattgtggtgactcagtctccactctccctgcccgtcattcctggagacgccggcctccatctcctgcaagtctagtcagagcctctacatagtaatggacacaactattggattggtactgcaagaacgccagggcagtcctaccacagctcctagactcttatttgggtactaagcggtccgtccgggtccctgactaggtcagtcggcaggtcgatcgagcaanagtactttcactaagaaaatccaaagagaggtaggaggctagaggtagttggtttagggtttattacgtgactaagtgcaagtctactaaccaaccgtacccactaaccggttcggacgggaggaaaccgaggtaggaggaactacgaaaaccgtagtacgtgggacctgaccgaacctagttctcgttcgtacctaacg

SEQ ID NO: 160155 - DNA, 519 bp, Homo sapiens
  misc_feature: GYAE6OF02IF0OR.19.83.H06.1.454.CMB.1.raw
  modified_base (516)..(516): a, c, t, g, unknown or other
  misc_feature (516)..(516): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcgaggcacagtattttacactagaaaatcaacagagtggaggctgaggatggttggggtttattactgcagtgacaagctactaacaaacctccctactaaccggttcggacgggagggaaccaggtaggagagtacgaaacgaactggtggcagcaccagtctgttctntac

SEQ ID NO: 160156 - DNA, 526 bp, Homo sapiens
  misc_feature: GYAE6OF02HTECY.19.83.H06.1.454.CMB.1.raw
  modified_base (391)..(391): a, c, t, g, unknown or other
  misc_feature (391)..(391): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctcccctgccccgtcattcctggagacgccggcctccatctcctgcaagtctagtcagagcctctacatagtaatggacacaactattggattggtacctgcagaagccagggcagtctccacagctcctgatcttatttggttctaagtcgggcctccggggtccctgacgtaggttcagtgcagtggatcaggcacagtattttacactagaaaatcaacagagtggaggntaggaggagttgggtttagggtttaattacgtgactatgacaacgtctactaacaaacctccgtactacgttcggacggaggaccgaggtgagatacgaaacgactgtgactgacacgatcgtacgtctataccg

SEQ ID NO: 160157 - DNA, 498 bp, Homo sapiens
  misc_feature: GYAE6OF02HZBHF.19.83.H06.1.454.CMB.1.raw
  modified_base (484)..(484): a, c, t, g, unknown or other
  misc_feature (484)..(484): n is a, c, g, or t
  modified_base (494)..(494): a, c, t, g, unknown or other
  misc_feature (494)..(494): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaatcaacagagtggaggctgaggatggttgggtttattacgtgcatgcagctactacaactccctcaacgttcggcggacggacaggtgagatacgaaacgactggtggctgcaccntcgtgtcttntacg

SEQ ID NO: 160158 - DNA, 508 bp, Homo sapiens
  misc_feature: GYAE6OF02GB61V.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagagccagggcagtctccacagctcctgatctatttgggttctaatcgggcctccgggtcctgacaggttcagtgcagtggatcaggcacagattttacactgaaaatcaaacagagtggaggctggaggtatggttggggtttattacgtgcatgcaagctctaacaacctccctacaacgttcggacggaggaaccgagggtaggagatacgaaacgactaggtggactgacaccatctgtctctacg

SEQ ID NO: 160159 - DNA, 513 bp, Homo sapiens
  misc_feature: GYAE6OF02GAQDK.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagtattttacactagaaaactcaaacagagtggaggctgaggatggttaggggtttattatgcagtgcaagctactaacaactcctacaacgttcggacggacggaccgaagggtgagatacgaaacgactggtagctgcaccatcgtgttccttatacg

SEQ ID NO: 160160 - DNA, 531 bp, Homo sapiens
  misc_feature: GYAE6OF02GG8GD.19.83.H06.1.454.CMB.1.raw
  modified_base (379)..(379): a, c, t, g, unknown or other
  misc_feature (379)..(379): n is a, c, g, or t
tcagtactctcgtgcacgaccggtgctcgatttagatcacgtgcgtcgcgagcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggttctaagtcgggcctccggggtccctgacaggttcagtggcaggtggatcgaggcacagtattttacactagaaatacaanagagtggagctgaggtagttggttgggtttattactgcatgcaagctactactaaacctccctacgtacgttcggacgggacgggaccgaagggtgagacgtaacaaaccggacgtcgtacggcgtacgacgaccacgtcttcgtcttaccg

SEQ ID NO: 160161 - DNA, 538 bp, Homo sapiens
  misc_feature: GYAE6OF02FYIP2.19.83.H06.1.454.CMB.1.raw
  modified_base (411)..(411): a, c, t, g, unknown or other
  misc_feature (411)..(411): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactagaaaatcaaacagagtggagctgaggattgttggggtttattacngtcagtcgacaagcttcgtaactaaacctccctacgtaacgttccggacgggaagggaaccaagggtcggagacgtacgaaaacgtaacgtagtacggcgtagcaccgtatctacgtcttctaaccg

SEQ ID NO: 160162 - DNA, 553 bp, Homo sapiens
  misc_feature: GYAE6OF02F6Y8L.19.83.H06.1.454.CMB.1.raw
  modified_base (331)..(331): a, c, t, g, unknown or other
  misc_feature (331)..(331): n is a, c, g, or t
  modified_base (435)..(435): a, c, t, g, unknown or other
  misc_feature (435)..(435): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaagtcgggccgtccggggtccctgacgnggttcaggtggcaggtggactcaggcacgagtattttacactagaaatacaaacagagtggaggctaggaggtagttggttaggggtttaattacgtgacagtnactagctactacaacctccgtactaacggttcggacggtaacggacgaaggtggacgagtaccgtaaacgaactggtacgtacgtacgacgtaccagttccgtagttccttacgtacc

SEQ ID NO: 160163 - DNA, 573 bp, Homo sapiens
  misc_feature: GYAE6OF02GXPFO.19.83.H06.1.454.CMB.1.raw
  modified_base (395)..(395): a, c, t, g, unknown or other
  misc_feature (395)..(395): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaagtcgggcctccggggtccctggactaggttcaggtggcagtggatcgaggcacagtattttacactagaaaactcaaacagagtggaggntggaggtattgggtttagggtttaattacgtagctagtgacaacgtctacgtaaccaaccgttccctacgtaacgttcgggacggtacggaaccgtaaggtcggagacgtaccgaaaacggtacgtacggtacggacgtcgaccgtaccgtattcccgtacgttaccttcgtaacccg

SEQ ID NO: 160164 - DNA, 571 bp, Homo sapiens
  misc_feature: GYAE6OF02G1Y6F.19.83.H06.1.454.CMB.1.raw
  modified_base (512)..(512): a, c, t, g, unknown or other
  misc_feature (512)..(512): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagccctcctacatagtaatggacacaactatttggattggtacctgcagaagccaggggcagtctccacagctcctgatctagtttgggttacttaagtccggggtcccgttccgggggtcccctaggacgtagggttcaggtggcgtaggtggatcgaggcaacgtagttatttacgactagaaatacaacagaggtggagcgtaggaggtattgggtttagggttattacgtgtacagtcgacagtctactaacctaacctccgtacgtacggttcggacgggaggaaccgtaaggnggtagagtaaccgaaagtacgtgtggtactgacctacgtacttcgtcgtcttactaccg

SEQ ID NO: 160165 - DNA, 533 bp, Homo sapiens
  misc_feature: GYAE6OF02H1N1N.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagcagggcagtctccacagctcctgatctatttggttctaatcgggcctccgggtcctgacaggttcagtggcagtggatcgagcacagtattttacactagaaatacaacagagtggaggctggaggtagtggtttggggtttattagtgcatgacaagctactaaccaacctccctactaacgttcgggacggagggaccgaaggtggagtacgtacgaaacgacgtaggtcggacgtcgaccgtaccgacttcgttcgtcttcgtacc

SEQ ID NO: 160166 - DNA, 539 bp, Homo sapiens
  misc_feature: GYAE6OF02I31A5.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttgggtctaagtcgggccgtccgggtcctgacaggtcagtgcagtggatcgagcacagtatttacactagaaatcaacagagtggaggtctaggaggtattgggtttaggggttttaattacgtgtctatcgacaagtcctactaacaacctcccgtagtaaccgttcggacgggaggaccgaaggtggagactacgaaacgtacgtacggtgaccgtgacctacctagttctcgtccttctaccg

SEQ ID NO: 160167 - DNA, 578 bp, Homo sapiens
  misc_feature: GYAE6OF02ITWS1.19.83.H06.1.454.CMB.1.raw
  modified_base (281)..(281): a, c, t, g, unknown or other
  misc_feature (281)..(281): n is a, c, g, or t
  modified_base (378)..(378): a, c, t, g, unknown or other
  misc_feature (378)..(378): n is a, c, g, or t
  modified_base (428)..(428): a, c, t, g, unknown or other
  misc_feature (428)..(428): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtgggatattgtggtgactcagtctccactctccctgcccgtcattcctggagagccggcctccatctcctgcaagtctagtcaggacgcctcctacatagtaaatggacacaacttattggattggtacctgcagaagccaggcagtctccanagctcctgatctatttggtctaatcgggtcctccgggtcctgactaggttcagtcgcagtgatcaggcacgagtatttacatacgaaaatcaaacanaggtaggacgcgtagacgaagttggtcgggttttaatcgttagcaatganaacgctactaaccgaactcccttacgaaacggttcggaaccgggtacggaaacccgaggtacgggagttacgtaaccgaaaacggaacgttaggacggtacccttagggaccctaaccgtaagtacctttacggttccttaacttcccgg

SEQ ID NO: 160168 - DNA, 548 bp, Homo sapiens
  misc_feature: GYAE6OF02G4Z2U.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaagtcgggcctccggggtccctgacaggttcagtggcagtggatcaggcacagtattttacactagaaatcaaacagagtggaggctagaggtatggtttaggggtttattacgtgcagtgacaagctactaacaaactccctactaacgttcggaggacggaaccgtaagggtcggagtaagtacgaaacggtaactaggtaggtactaggactaccgtaagttccgtcgttaccttactaccg

SEQ ID NO: 160169 - DNA, 516 bp, Homo sapiens
  misc_feature: GYAE6OF02I0DO3.19.83.H06.1.454.CMB.1.raw
  modified_base (512)..(512): a, c, t, g, unknown or other
  misc_feature (512)..(512): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagcccagggcagtctccacagctcctgatctatttgggttctaatcgggcctccggggtccctgacaggttcagtggcagtggatcaggcacagatttacactagaaatcaaacagagtggaggctgaggtagtggttggggtttattactgacatgcaagctactaacaaactccctactaacgttcggtggacggaaccgaaggtggagatacgaaacgtaacgtgtggctagcaccatctgttcctntacg

SEQ ID NO: 160170 - DNA, 429 bp, Homo sapiens
  misc_feature: GYAE6OF02IXVOQ.19.83.H06.1.454.CMB.1.raw
  modified_base (328)..(328): a, c, t, g, unknown or other
  misc_feature (328)..(328): n is a, c, g, or t
  modified_base (429)..(429): a, c, t, g, unknown or other
  misc_feature (429)..(429): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctagtttggtactaagtcgggcctccgggtccctgacnggttcagtggcagtgatcgaggcacagtatttacagtagaaaatacaacagaggtggaggcgtagaggtagttggttagggtttagttacgtgacgagtan

SEQ ID NO: 160171 - DNA, 547 bp, Homo sapiens
  misc_feature: GYAE6OF02I8FAP.19.83.H06.1.454.CMB.1.raw
  modified_base (417)..(417): a, c, t, g, unknown or other
  misc_feature (417)..(417): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccgcctccatctcctgcaagtctagtcagagcctcctacatagtaatggacacaactatttggattggtacctgcagaagccagggcagtctccacagctcctgatctatttggttctaagtcgggccgtccgggtccctgactaggttcagtggcagtggatcgaggcagagtatttacactagaaatacaacagagtggagctggagtagttggttagggtttattacgtgntagtgactaagtcgtactaacgtaaacctcccgtacgtaacggttcggacgggacggaaccgagggtagagacgtacgaaacggtacgtggtggtacgtcgacgacctacttcgtcgttccttactaccg

SEQ ID NO: 160172 - DNA, 636 bp, Homo sapiens
  misc_feature: GYAE6OF02H2PX6.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagagccggcctccatctcctgcaagtctagtcagagcctcctacatagtaatggacacaactatttggattggtacctgcagaagccagggcagtctcacagctcctgatcttatttgggttctaagtccgggccgtccgggtcctgacgaggttctagtggcaggtgagtcgaggcacagtatttacactagaaatcaagagagtaggaggcgtaggaggtagttaggttttaggggttttaatttacgttgtacgtagttgaacgagtcttactaacctaaacccgttaccctaaccgtaaccggtttaccgggaccgggtaacgggtaacccgtaaaggggtacggtaacggtaacgtaacccggaaaacggttaaaccggttcgggtacggtacccgtacggtacccgtaacccgtacgttaccgttaccggtttcctttaccgttaacccg

SEQ ID NO: 160173 - DNA, 527 bp, Homo sapiens
  misc_feature: GYAE6OF02GOZNJ.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcaggtggatcaggcacagatttacactagaaatcaacagagtggaggctggaggatggttggggtttattacgtgcatgacaagtctactaccaactcccgtctaacgttcggcggagggaccaagggtcggagactacgaaaccggaacttaggtcggacgtgacaccgtattcgtgttccttctacc

SEQ ID NO: 160174 - DNA, 586 bp, Homo sapiens
  misc_feature: GYAE6OF02JB7IQ.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgattcttagtttgggttctaacgtccgggcccgtcccggggtccctgactaggttcaggtggcaggtggatcgaggcacgagtacttttacactagaaatacaacgagagtggaggctaggaggtagttgggtttaggggttttaattacgtgactagtcgactaagtacctactaacctaaacctccctacgtaaccggttccgggacgggaacggaaccgaagggtacggagactaacgaaacggtacgtaggtacgtacgtacgacctaccgtattaccgtcgttccttacgtaccg

SEQ ID NO: 160175 - DNA, 523 bp, Homo sapiens
  misc_feature: GYAE6OF02IUZBI.19.83.H06.1.454.CMB.1.raw
  modified_base (352)..(352): a, c, t, g, unknown or other
  misc_feature (352)..(352): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttggttctaagtcgggcctccgggtccctgacaggttcagtggcagtggatcgaggcanagtatttacactgaaatcaacagagtggaggtctagaggtagttggtttaggggtttattacgtgcagtgacagtctacgtaacaacctccctacgaacgttcggacggacggaccgaaggtggagatacgaaacgactggtagactgaccacgtatcgtgttcttctacg

SEQ ID NO: 160176 - DNA, 520 bp, Homo sapiens
  misc_feature: GYAE6OF02GYQBB.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagagccggcctccatctcctgcaagtctagtcagagcctcctacatagtaatggacacaactatttggattggtacctgcagaagccagggcagtctccacagctcctgatctatttgggtctaagtcgggcctccggggtccctgacaggttcagtggcagtggatcaggcacagtatttacactagaaatcaacagagtggagcgtgaggtatggttagggtttattacgtgcagtgacaagctactaacaactccctacgtaacgttcggacggacgggaccgtaaggtggagacgtacgaaacgacgtgtggctagacactatcgtgttctctacg

SEQ ID NO: 160177 - DNA, 575 bp, Homo sapiens
  misc_feature: GYAE6OF02F7DMJ.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttgggttctaatcgggcctccggggtccctgacaggttcagtggcaggtggatcgaggcacagtattttacactagaaatcaacgagaggtggaggctggaagggtattggtttaggggtttaattacgtgtacagttgacgaagtctacttaaccgaaaccttccccgtaacgtaaccggtttccgggacgggtaacgggaccaaggggttacggagactaacggaaacggtaacgtaggtacggactggacctaccgtagttccgtcgttcttactaccg

SEQ ID NO: 160178 - DNA, 631 bp, Homo sapiens
  misc_feature: GYAE6OF02IRF0Y.19.83.H06.1.454.CMB.1.raw
  modified_base (403)..(403): a, c, t, g, unknown or other
  misc_feature (403)..(403): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcccggagagccggcctccatctcctgcaagtctagtcagagcctcctacatacgtaaatggaccaacaacctatttaggattaggtaccttgctagaagccgagggcaggtctcacagctcctgatcttatttggttctaagtcgggccctccggggtccctggacgtcggttcaggtcggctacggtggagtcacgggcacaagtacttttacactagaaaatccaanacgtaagtgggaggtctaggaggtaagttgggtttaggggttttaacttaacgttgactagtgtacgaacgtcctactaaccgtaacccttaccctacgtaaccggttcggtacgggaacgggtaccgaagggttacgggagtactaacggtaaaccgaacgttcggtaggccgttacggacctaccgtacgttccgttacggttcctttaccgtaacgtttcccccg

SEQ ID NO: 160179 - DNA, 519 bp, Homo sapiens
  misc_feature: GYAE6OF02H7U9O.19.83.H06.1.454.CMB.1.raw
  modified_base (427)..(427): a, c, t, g, unknown or other
  misc_feature (427)..(427): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtcctccacagctcctgatctatttgggttctaagtcgggcctccggggtccctgacaggttcagtggcaggtggatcgaggcacagtattttacactagaaatcaacagagtggagctgaggattggttgggtttattactgcagtgcaagctntaaccaactccctacacgttcgggcggacgggaccagggtcgagagtacgaaacgtacgtggtcggcgtagcaccatcgtcgttctctaccg

SEQ ID NO: 160180 - DNA, 709 bp, Homo sapiens
  misc_feature: GYAE6OF02H8Z7M.19.83.H06.1.454.CMB.1.raw
  modified_base (338)..(338): a, c, t, g, unknown or other
  misc_feature (338)..(338): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagagccggcctccatctcctgcaagtctagtcagacgcctcctacatagtaatggaacacaacttatttggattcggtacctgcagaagccgagggcagtctccacagcctctgattcttagtttgggttctaagtccgggccgtccgggtcctgacnggttcagtcggcaggtcggactcgaggacacgtaagtaattttaaccgaacttaagaaaacttacgaaaacgtaaggtaacgggttagggaacgggtcttagggaaggttacggtttaggggtttttaacgggggttttaactttacggcgggtactaggttacgaccgtaagtacccttacgtaaacccgtaaacccgtttaccccgtaacggtttaaccgggtccggggtaaacggggaaccgggtaaaccggttaagggttacgtaacggtaacgttaaccggaaaaccggtaacccggttgggtaaccgggtcctaaggtacccgtaacctacgtttaccggttactttaccgttaccgttaacccg

SEQ ID NO: 160181 - DNA, 563 bp, Homo sapiens
  misc_feature: GYAE6OF02IPDQA.19.83.H06.1.454.CMB.1.raw
  modified_base (351)..(351): a, c, t, g, unknown or other
  misc_feature (351)..(351): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctctacatagtaatggacacaactattggattggtacctgcagaagccgagggcagtctccacagctcctgatctatttggtactaagtcgggcctccgggtccctgacgaggttcagtgcagtgatcgaggcanagtatttacatagaaatacaacagagtggagctgaggattaggttgggtttaattacgtgacgtatgactaagctacgtaaacaacctcccgtacgtaacggttcgggacgggaacgggtaaccgaagggtaggacgtaacgtaccgaaaacggtaacgtggtacggtcctaacgtactaacccgtattaccgttagttaccttactacccg

SEQ ID NO: 160182 - DNA, 526 bp, Homo sapiens
  misc_feature: GYAE6OF02GPALX.19.83.H06.1.454.CMB.1.raw
  modified_base (522)..(522): a, c, t, g, unknown or other
  misc_feature (522)..(522): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggtctaatcggcctccgggtccctgacaggttcagtggcagtggatcgaggcacagtatttacactagaaatcaaacgagagtaggaggctaggaggagtggttaggggtttattacgtgacgattgacagctacgtaccaaactccctactaacgtttcggacggacggaccgaaggtgagactacgaaacgactggtacgcgtagacaccgatcttcgtactntacc

SEQ ID NO: 160183 - DNA, 567 bp, Homo sapiens
  misc_feature: GYAE6OF02FYB2F.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggttctaagtcgggcctccggggtccctgacaggttcaggtggcagtggatcgaggcacagtattttacactagaaatcaacagagtggaggctagaggagttggttaggggtttacttacgtgtactagtgactaaggcttctaacctaaaccttccccttacgaaccggtttcgggacggaacgggtaacccgaagggtcggagacgtaccgaaacggaacgttggtacggacttacggaccaccgtagtcgtcgttccttcttacccg

SEQ ID NO: 160184 - DNA, 499 bp, Homo sapiens
  misc_feature: GYAE6OF02FHUPF.19.83.H06.1.454.CMB.1.raw
  modified_base (465)..(465): a, c, t, g, unknown or other
  misc_feature (465)..(465): n is a, c, g, or t
  modified_base (481)..(481): a, c, t, g, unknown or other
  misc_feature (481)..(481): n is a, c, g, or t
  modified_base (496)..(496): a, c, t, g, unknown or other
  misc_feature (496)..(496): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaatcaacagagtggaggctgaggatgttggggtttattactgcatgcaagctctaacaacctccctctaacgtttcggcgagggaccaaggtggagancgaaacgactagtgcngcaccatctgtcttntac

SEQ ID NO: 160185 - DNA, 679 bp, Homo sapiens
  misc_feature: GYAE6OF02ILKRK.19.83.H06.1.454.CMB.1.raw
  modified_base (231)..(231): a, c, t, g, unknown or other
  misc_feature (231)..(231): n is a, c, g, or t
  modified_base (433)..(433): a, c, t, g, unknown or other
  misc_feature (433)..(433): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactcctccctgcccgtcattccgtggagacgccggccctccatctccctgccaagtctagtcagacgccctcctanaatagtaaatggaacacaacttattggtaattggtactgacagaagccgagggacagtctccacagctcctgactcttattgggttactaacgtcgggccgtcccggggtccctggactacggttcacggtggacgtagtggatcgaggcaacgtagtaattttacagttacgaaaatacgaaacaggaaggtgggaacggngtaggaggtaggtttagggtttagggttatttaacgtgacgtaagtgtacaacgtcgtaaccttaaacgtaacccgtaccccgttacgtaaaccgggttacgggaccggggtaaacgggtaaacccgtaaaggggtacggaacggtaaacgtaccggaaaaacccggtacgttacgggtaaccggttaccgtaccgacggtacccgtaccgtttacggttccggtttaccttaccgttaaccccgg

SEQ ID NO: 160186 - DNA, 518 bp, Homo sapiens
  misc_feature: GYAE6OF02GOIQN.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgtaagtctagtcagagcctcctacatagtaatggacacaactattggattggtacctgcagaagccagggcagtctccacagctcctgatctatttgggttctaatcgggcctccggggtccctgacaggtcagtggcagtggatcaggcacagattttacactagaaaatcaacagaggtggaggctgaggattggttaggggtttattacgttgcatgcagctactacaaactccctacaacgttcggacggaggacaaggtggagtagtacaaacggaacgtggtacggcttgacaccagtctgtcttcattcccg

SEQ ID NO: 160187 - DNA, 632 bp, Homo sapiens
  misc_feature: GYAE6OF02GPZAM.19.83.H06.1.454.CMB.1.raw
  modified_base (325)..(325): a, c, t, g, unknown or other
  misc_feature (325)..(325): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatctcctgcaagtctagtcagacgcctcctacatagtaatggacacaactattggattggtacctgcagaacgccgaggcagtctaccacagctcctgatctatttgggtactaatcgggcctccgggtccngacnggttcagtgnagtgatcgaggcacagtactttaacactaagaaatacaaacgaggacgtagggaggtcgtaggtaaggtagttagggtttaggggttttaacgttacgtgggtactaagtacgtacgaaagtaccttaccgtaaccttaaaaccgtcccttaaccgtaaaccggtttccggggaacggaacgggtaaaccgtaacgggtaggacgtaagtaaccgtaaaaccggtaacgttacggtacggttacgtacgaaccgtaccgtactttacgtacggtttaccttaccgttaacccg

SEQ ID NO: 160188 - DNA, 598 bp, Homo sapiens
  misc_feature: GYAE6OF02IS5RH.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatcctcctgcaagtctagtcagacgcctcctacatagtaatggacacaactatttggattggtacctgcagaagccgagggcagtctccacagcctccgtgactcttagttttcgggtactaagtccgggtccgtcccggggtccctaggacgtaggttcaggtcggcgtaggtggatcgaggcaactagtactttacacgtaagaaactcaacgagagtaggaggctaggagtagttaggtttaggggtttattacgtgactagtcgactaacgtctaactaacaaccttcctacgtaacggttcgggacgggaacggaacgagggtaggacgtacgtaacgaaacggtaacgtgggtacgtacgtacgaccgtacgtacgttcgttacgttccttactacccg

SEQ ID NO: 160189 - DNA, 695 bp, Homo sapiens
  misc_feature: GYAE6OF02HLJAG.19.83.H06.1.454.CMB.1.raw
  modified_base (174)..(174): a, c, t, g, unknown or other
  misc_feature (174)..(174): n is a, c, g, or t
tcagtactctcgtgcacgaccggtgctcgatttagatcacgtgcgtcgcgggcgttagacgttttgtgtttctcgtagtctgctttgctcagcgtcagggtgctgctaatgctctgggtctctggatccagtggggatattgtggtgactcagtctccactctccctgcccgtnattcctggagagccggcctccatctcctgcaagtctagtcagagcctcctacatagtaatggacacaacttatttggattggtacctgacaagaacgccgagggcagtcctacacagcctcctgtacttcttagtttcgggttactaacggtccggtacccggttcccgggtcctaggaacgtgggttacgaggtcggactaggtaggtacgtacgacggtacaacgttagttaacttttaacaacgtaaagaaaacttacgaaacgtaaggtaaggggtaggacggtacgtagggaacggttaggtttagggttttaggggttttaacttaacggtgtaacgttagtacggaactaacggttccttaaaccttaaaacccgtaaccttcccgttaacgttaaccgggttacggggaacgggtaaacggaaaccgtaagggtaggaacgtaactaaaccggtaacggtagtacgggtcgacgtacggacccacgtacttcgttacgttaccgttactaccg

SEQ ID NO: 160190 - DNA, 600 bp, Homo sapiens
  misc_feature: GYAE6OF02IJ8CR.19.83.H06.1.454.CMB.1.raw
  modified_base (217)..(217): a, c, t, g, unknown or other
  misc_feature (217)..(217): n is a, c, g, or t
  modified_base (294)..(294): a, c, t, g, unknown or other
  misc_feature (294)..(294): n is a, c, g, or t
tcagtactctcgtgcacgaccggtgctcgatttagatcacgtgcgtcgcgggcgtagacttttgtgtttctcgtagtctgctttgctcagcgtcagggtgctgctaatgctctgggtctctggatccaggtggggatattgtggtgactcagtctccactctccctgcccgtcattcctggagagccggcctccatctcctgcaagtctagtcaganccctcctacatagtaatggacacaaactattggattggtacctgcagaagccagggcagtcctcacagctcctgatnttagtttggttactaagtccgggccgtccggggtccctgacaggttcagtgggacagtggatcgaggcacgagtatttacactagaaatcaacagagtgggagctaggaggtattaggtttgggtttaattacgtgtactagtacgcaaaggcttactaacctaaaccttccccgacgtaaccggttcgggaccgggtaacgggaacccgtaagggtaggagtaacgtaaccgtaaaacggtaaaccgtgggttaacggaccttacggacctaaccgtagttacgtacgtttccttacttaacccg

SEQ ID NO: 160191 - DNA, 514 bp, Homo sapiens
  misc_feature: GYAE6OF02HWX44.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtgcagtggatcaggcacagattttacactagaaatcaacagagtggaggctgaggatggttgggtttattacgtgcatgacagctactacaacctccctacacgttcggacggacggaccgaaggtggagatacgaaacgtacgtggtacgcgtgacacctagtcttgtccttactacg

SEQ ID NO: 160192 - DNA, 575 bp, Homo sapiens
  misc_feature: GYAE6OF02IS9SF.19.83.H06.1.454.CMB.1.raw
  modified_base (327)..(327): a, c, t, g, unknown or other
  misc_feature (327)..(327): n is a, c, g, or t
  modified_base (340)..(340): a, c, t, g, unknown or other
  misc_feature (340)..(340): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggacagcccggcctccatcctcctgcaagtctagtcagagccctcctacatagtaatggacactaactatttggattggtacctggcagaacgccagggcagtctcacagctcctgatctattgggtctagtcggctccgggtcctgacnggttcagtgcagngatcgaggcaacngtatttacacgtanaaatcaacacgngtacggnggcgtagtaggtagtgggtttagggtttacttacgttgacgtatcgtacgaagtccgttataacccgtaaaccgttcccttacgtaaaccggttcggggaacgggacgggtaaccgagggttacgagtactaacgaaaccgtaagttcggtacgtgtacgaccacgtacttcggtcgttctacgttacg

SEQ ID NO: 160193 - DNA, 512 bp, Homo sapiens
  misc_feature: GYAE6OF02G7NH5.19.83.H06.1.454.CMB.1.raw
  modified_base (324)..(324): a, c, t, g, unknown or other
  misc_feature (324)..(324): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttgggtctaatcgggctccgggtccctgacngttcagtggcagtggatcaggcacgagtatttacactagaaatcaacgagagtggaggctggagagtggttgggttattctgacatgcagctactacaactcctacgtaacgttcgacgggaggaaccaagggtagacgatacgaaacgtaactcgtggcgtcgacaccattccgtgttcttacgtac

SEQ ID NO: 160194 - DNA, 555 bp, Homo sapiens
  misc_feature: GYAE6OF02IJY9G.19.83.H06.1.454.CMB.1.raw
  modified_base (385)..(385): a, c, t, g, unknown or other
  misc_feature (385)..(385): n is a, c, g, or t
  modified_base (548)..(548): a, c, t, g, unknown or other
  misc_feature (548)..(548): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagagccctcctacatagtaatggacacaactatttgattggacctgcagagccagggcagtctccacagctctgatctagtttggttctaagtcggcctccgggtccctgacaggttcagtgcaggtgatcgaggcacagtatttacactagaaatcaacaggaggtggaggngtaggaggtattgggtttagggtttacttacgtgtctatcgactagtccgtactaaccaaccttcccgtacgtaacggttcgggacggacgggaaccgtaagggtggagtaactacgaacgtacgtcggtagtacctggacctaccgtagttctcgttacctnttacccg

SEQ ID NO: 160195 - DNA, 637 bp, Homo sapiens
  misc_feature: GYAE6OF02FJ7B5.19.83.H06.1.454.CMB.1.raw
  modified_base (172)..(172): a, c, t, g, unknown or other
  misc_feature (172)..(172): n is a, c, g, or t
  modified_base (289)..(289): a, c, t, g, unknown or other
  misc_feature (289)..(289): n is a, c, g, or t
  modified_base (347)..(347): a, c, t, g, unknown or other
  misc_feature (347)..(347): n is a, c, g, or t
tcagtactctcgtgcacgaccggtgctcgatttagatcacgtgcggtcgcgggcgtagactttgtgtttctcgtagtctgctttgctcagcgtcagggtgctgctaactgctctggtctctggatccagtggggatattgtggtgactcagtctccactctccctgcccgtnattccgtggagagccggcctccatctcctgcaagtctagtcagagcctcctacatagtaatggacacaacttatttggattggtacctgacagaacgccgagggcacggtctccacngctacctgatctagtttggtctaagtcgggcctccgggtcctgactggttcagtcgcngtgatcgagcacgagtactttacactagaaactgaaacgagaggtggaggacgtaggaggtacgttagggtttacggggtttaattccgtaggtcctagtacggactaaaggtccttaaccgtaaacctaaacccgtttccccgtaacgttaaccgggtttccggggaacgggtacgggtaaccggtaacgggtgggaacgtattaacccggtaaaacggtaccgttaggttaccggacgtaccggactaacccggtacgttcccgttacgttcccgttacgttaacccg

SEQ ID NO: 160196 - DNA, 517 bp, Homo sapiens
  misc_feature: GYAE6OF02F14UP.19.83.H06.1.454.CMB.1.raw
  modified_base (328)..(328): a, c, t, g, unknown or other
  misc_feature (328)..(328): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacnggttcagtggcagtggatcaggcacagtatttacactagaaatcaaacagagtggagctagaggattggttaggggtttattacgtgcagtgacaagctactacaactcctactaacggtttcggtaggacggaccgaagggtggagatacgaaacgaacgtgtcggctgacacatctcgttcttctac

SEQ ID NO: 160197 - DNA, 513 bp, Homo sapiens
  misc_feature: GYAE6OF02H09L4.19.83.H06.1.454.CMB.1.raw
  modified_base (389)..(389): a, c, t, g, unknown or other
  misc_feature (389)..(389): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtgggatattgtggtgactcagtctccactctccctgcccgtcattcctggagagccggcctccatctcctgcaagtctagtcagagcctcctacatagtaactggacacaactatttggattggtaccctgcagaagcccagggtcagtctccacagctcctgatctatttgggttctaatcgggcctccgggtcctgacaggttcagtggcagtggatcaggcacgagagttttacactgaaaactcaacagagtggagngtgaggagtgttaggggtttattacgtgtcagtgcaagctactacaactccctacgacgttcggcggtaggaccaaggtgagagtacaaacgtaactgtggctgacacagtctcgtacttctac

SEQ ID NO: 160198 - DNA, 520 bp, Homo sapiens
  misc_feature: GYAE6OF02HMVZE.19.83.H06.1.454.CMB.1.raw
  modified_base (516)..(516): a, c, t, g, unknown or other
  misc_feature (516)..(516): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagagccggcctccatctcctgcaagtctagtcagagcctcctacatagtaatggacacaactatttgattggtacctgcagaagccagggcagtctccacagctcctgatctatttgggttctaatcgggcctccgggtccctgacaggttcagtgcagtggatcgaggcacagtattttacactagaaatcaacagagtggaggctgaggattggttaggggtttattacgtgctagtgcaagtctactaacctaacctccctacgaacgttcgacgggacggaacgagtaggagatacgaaacgacgtagtggctgacactactcgtcgtcttntacc

SEQ ID NO: 160199 - DNA, 552 bp, Homo sapiens
  misc_feature: GYAE6OF02IIID0.19.83.H06.1.454.CMB.1.raw
  modified_base (388)..(388): a, c, t, g, unknown or other
  misc_feature (388)..(388): n is a, c, g, or t
  modified_base (408)..(408): a, c, t, g, unknown or other
  misc_feature (408)..(408): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttgattggtactgcagaagcaggcagtctccacagctcctgactctattgggttctaacgtcggcctccgggtccctgactaggtcagtgcagtgatcaggcacgagtatttacactagaaatcaaacagagtaggagctgaggntggttgggttatacgtgacntgacaagctactaacaaacctccctactaaccggttcgggacgggtaacggaccgtaagggtaggagaacgtaccgaaaacgtaccgtaggtacgggaccttacggaccaaccgtacgttacttcggttaccttacgtaacccg

SEQ ID NO: 160200 - DNA, 523 bp, Homo sapiens
  misc_feature: GYAE6OF02IPBLO.19.83.H06.1.454.CMB.1.raw
  modified_base (171)..(171): a, c, t, g, unknown or other
  misc_feature (171)..(171): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagagccggcctccatctcctgcaagtctagtcagagcctcctacatagtaatggacacaactatttggattggtacctgcagaagccagggcagtctccacagctcctgatctatttgggttctaatccgggccttccggggtccctgacaggttcagtggcagtggatcaggcacagtatttacactagaaaactcaacagagtggagctgagtgtggttgggtttattacgtgctatgacaagctactaacaactccctacgtacgttccgggcggacggaaccgaagggtggagactacgaaacgtactggtgcgtgacctactatcgtcgtcttctaccg

SEQ ID NO: 160201 - DNA, 560 bp, Homo sapiens
  misc_feature: GYAE6OF02I08BI.19.83.H06.1.454.CMB.1.raw
  modified_base (389)..(389): a, c, t, g, unknown or other
  misc_feature (389)..(389): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatcctcctgcaagtctagtcagagcctcctacatagtaatggacacaactattggattggtacctgcagaagccagggcagtctccacagctcctgatcttagtttgggttctaagtccgggtcccgttcccggggtccctgacgtaggttcaggtggcaggtggatcgaggcacagtatttacactagaaatcaanagagtggagctagaggtagtggtttagggtttattacgtgacagtgacagctactaactaacctccctacgtacgttcgggaccggacggaaccgaagggtaggagtacgtaacgaaacgtacgtaggtcgaccgtacgaccgacctacgttactcgttccttaccgtacc

SEQ ID NO: 160202 - DNA, 635 bp, Homo sapiens
  misc_feature: GYAE6OF02JBAJF.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatctcctgcaagtctagtcagagcctcctacatagtaatggacacaacttattggattggtacctgacaagaacgccgagggcagtcctccacacgcctcctgtactcttagtttgggttactaacgtccgggtcccgtcccggggtccctagacgtaggttcaggtcggctaggtggatacgaggaccactagtactttacaacgtaagaaaactacgaaacgaggtacggtagggacggtcgtagggtaggttagtttagggtttagggttttaatacgtagactagtcgacgtaagtcctaaccttaaacaaccctacccgtagtaacggttcgggacggtaacggaaccgtaaggtacggtacgtaacgtaacgaaaccggtaagtcgggtaacgaccgtacgaccgtaaccgtagttcgtacgttcctacttacccg

SEQ ID NO: 160203 - DNA, 556 bp, Homo sapiens
  misc_feature: GYAE6OF02GW1ZW.19.83.H06.1.454.CMB.1.raw
  modified_base (289)..(289): a, c, t, g, unknown or other
  misc_feature (289)..(289): n is a, c, g, or t
  modified_base (331)..(331): a, c, t, g, unknown or other
  misc_feature (331)..(331): n is a, c, g, or t
  modified_base (342)..(342): a, c, t, g, unknown or other
  misc_feature (342)..(342): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccgagggcagtctccacagctcctnatcttagtttgggttctaagtccgggcctccgggtcctgacnggttcagtgcngtgatcagcactagtatttacactagaaactcaagagagtggaggtctaggaggtagttgggttagggtttattacgtgtctagtacgacaagtctactaacctaaccgtcccgtacgtaaccgttcgggacggacggaacgtaaggtaggagtagtacgtaaacgtaacgtggtacggctagacctacctcgttacgttcgttacctctaccg

SEQ ID NO: 160204 - DNA, 634 bp, Homo sapiens
  misc_feature: GYAE6OF02F5BAU.19.83.H06.1.454.CMB.1.raw
  modified_base (434)..(434): a, c, t, g, unknown or other
  misc_feature (434)..(434): n is a, c, g, or t
tcagtactctcgtgcacgaccggtgctcgatttagatcacgtgcgtcggacggggcgtagactttgtgtttctcgtacgtctgctttgctcacgcgtcagggtgctgctaatgctctgggtctctggatccaagtggggatattgtggtgactcagtctccactctcccctgcccgtcattcctggagagccggcctccatctcctgcaagtctagtcagagcctcctacatagtaattcgacacaactattggattggacctgcagagccaggcagtctccacagctcctgactcgtagtttgggttactaacgttccgggcccgttccccgggggttccctggtaccgtacgggtttcgagggttgggacgtaggtggattccgaggtccacgtagtatttaccactagaaactcgaacagtagtggaggtntggaggtagttggttagggtttattacgtgacgtatgacctaacgtccttacctacctaacccgttccccgttacggaaccgggtttcggggaaccgggtacgggaaccgtaagggtacgggatacgtaaccggtaaacggtacgttgggtacggtccgtacgaccgtacctacgtccgtttacgttccgttcctacccg

SEQ ID NO: 160205 - DNA, 593 bp, Homo sapiens
  misc_feature: GYAE6OF02HIK0T.19.83.H06.1.454.CMB.1.raw
  modified_base (172)..(172): a, c, t, g, unknown or other
  misc_feature (172)..(172): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtnattcctggagagccggcctccatctcctgcaagtctagtcagagcctcctacatagtaatggacacaactattggattggtacctgcagaagccgagggcagtcctccacagctcctgattcgttagtttcggttactaacgtccggggtcccgtccggggtccctgacgtaggttcaggtggctaggtggactcgaggcaacgtagtattttacactagaaactacaacgaggtagtgggaggtacgtaggtaggtagttagggtttaggggtttacttacgtgactagtacgacacgtctacctaacctaacctcccgtacgtacggttcggaggacggacgagggtaggagtacgtaacgaacgtacgtaggtacggtacgtacgacctaccgtagttcgttcgttacttcgtacccg

SEQ ID NO: 160206 - DNA, 578 bp, Homo sapiens
  misc_feature: GYAE6OF02FXSJL.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggtctaagtcgggcctccgggtcctgactaggttcagtggcagtggatcgaggcaacagtatttacactagaaatcaacagagtagggaggtctaggaggtagttggtttaggggttttaattacgtgtacgtagttgactaacgcttactaaacctaaacccttccctacgtaaccggttccgggacgggacgggtaaccgaagggtcggagtaacgtaccgaaaacgtacgtaggtcggtacgtcgaccgtaccgtagtccgttcgttaccttactaccg

SEQ ID NO: 160207 - DNA, 663 bp, Homo sapiens
  misc_feature: GYAE6OF02I580P.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagacgccctcctacatagtaatggacacaactatttggattggtacctgcagaacgccagggcagtctccacagtcctcctgattcttagttttcgggttactaacgtccggggtcccgtcccggggtccctgacgtaggttcgaggtggcgaggtggactcgagcaactagttaatttacacttaagaaactacgaaacgtaggaggtgggaaggcgtaggaaggtagtttgggttttaggggtttattaacgtgacgtagtcgaactacgtacctaccgtaacctaaacccgttacccgtaaccgtaaccgggttcccgggaacggggaacgggtaaccgtaaacggggtagggtaacgtaacgtaaccggtaaaacggtaacgtacgggtacggtaccgtacggtacccgaacgttacgttacgtacggtttaccttacccgttacccg

SEQ ID NO: 160208 - DNA, 557 bp, Homo sapiens
  misc_feature: GYAE6OF02GM661.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagagccggcctccatctcctgcaagtctagtcagagcctcctacatagtaatggacacaactattggattggtacctgcagaagccagggcagtctccacagctcctgatctatttggttctaatcgggccgtccggggtccctgacaggttcagtggcagtggatcgaggcacagtatttacactagaaatcaacagagtggagctggaggtattggttaggggtttattacgtagtcgtatgacaaggtctcgtaaacaacctccctacgtaaccggtttcggtaggaacgggaaccgtaagggtcggagtataaccgaaacggaacgttcggtcggtaccgtacgacaccgtatacgtcgttaccttatacccg

SEQ ID NO: 160209 - DNA, 627 bp, Homo sapiens
  misc_feature: GYAE6OF02IWRCX.19.83.H06.1.454.CMB.1.raw
  modified_base (354)..(354): a, c, t, g, unknown or other
  misc_feature (354)..(354): n is a, c, g, or t
  modified_base (377)..(377): a, c, t, g, unknown or other
  misc_feature (377)..(377): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagacgcctcctacatagtaatggacacaactatttggattggtacctgcagaacgccgagggcagtctccacagctcctgatctatttgggtctaagtcggcctccgggtcctgacaggttcagtcgcagtgatcgaggcacngtatttacactagaaatcgaaanagagtggaggtctaggaggtaacgttgggtttaggggtttaattaccgtaggtcctaattcggacaacggtacttacccgtaaccctaaacccgttccccgttaaccgtaaccgggtttccggggaccgggtaaacgggaacccgtaaggggtacggaagtaacgtaaccgaaaacggtaaccgttagggtacggtaccgttaggtacccaacccgttagttacccgttcggttaccttccgttaacccg

SEQ ID NO: 160210 - DNA, 730 bp, Homo sapiens
  misc_feature: GYAE6OF02IT6JO.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattccgtggagacggcccggcccttccatcctcctgcaagtctagtcagacgccctccaacatagtaagtggacaactaacttattggtattggtacctgacaagaacgccgagggcagtcctccacacgcctcctagattcttagtttgggttcttaacgtccgggtcccgttcccggggttccctaggaccgtaggttacaggtacggctaggtcggatcgaggactacgaagttacttttacaacgttagaaaactaacgtaaacgaaggtaaggtaggacggggggggactagggtagggtagttagggtttaggggtttacgttaacgttgtacgtacgtagtacgtaacgtaccgttaacctaaccgtaaacccgtaacccgttaccggtaaccgggttaccggggtaaccggggtaacgggtaaacccgggtaacgggtacgggtaacggtaacgttaaccggtaaaccggttaaaccggttacggtaccggtacgtaaccggtacgtaaccgtaaccgttaccgtttaccgttaccgttaccttaacccg

SEQ ID NO: 160211 - DNA, 594 bp, Homo sapiens
  misc_feature: GYAE6OF02JC2ER.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatctcctgcaagtctagtcagacgcctcctacatagtaatggacacaactattgatggtactgcagacgccgaggcacgtctcacacgctcctgatcttagtttgggttctaacgtccgggccgtcccggggttccctgacgtaggttcagtggcaggtggagtcacggacacacgtaatttacacttaagaaatacaacgtagacgtaggaggtcgagtaggtagttaggtttagggttaattacgtcgtctagtagtacacgtacctacgtaactaaaccctcctacgtaccggttacggaccgggtacggtaacgagggtacgagtacgtaccgaaacgtaacgtcggtacggacgttacgaccgttaaccagttcctacggttaccttacgtacccg

SEQ ID NO: 160212 - DNA, 613 bp, Homo sapiens
  misc_feature: GYAE6OF02G4FVP.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcggacctccggggtccctgacaggttcagtggcaggtgatcagcacagattttacactgaaactcaacagagtggaggctgaggtagttggttggggtttattaacgtgctagtgacaagtctacgtaacctaaaccttcccgtacgtaaccggtttcgggttacgggaacgggtaacccgaagggttacgggaacggtaacgttaaccggaaaaaccggtaaaccgttacgggttaaccgggtaccgttacggaaccgtaacccgttaacgttaccgtttccggtttacgtttaccttaaccccgg

SEQ ID NO: 160213 - DNA, 538 bp, Homo sapiens
  misc_feature: GYAE6OF02FLAR4.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttgggttctaatcgggtcctccggggtccctgacaggttcagtggcagtggatcgaggccacagtattttacactagaaatcaacgagagtggaggtctgaggtatggttaggggtttattactgctatgcaagctactaactaacctcctacgtaacgttcgggacggacgggaaccgtaggtaggagacgtacgaaacggactaggtggactcgaccaccgtattcgtcgttccttactaccg

SEQ ID NO: 160214 - DNA, 535 bp, Homo sapiens
  misc_feature: GYAE6OF02I1CSG.19.83.H06.1.454.CMB.1.raw
  modified_base (329)..(329): a, c, t, g, unknown or other
  misc_feature (329)..(329): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagcccagggcagtctccacagctcctgatctatttgggttctaagtcgggcctccggggtcctgacnggttcagtgcagtggatcaggcacagtatttacactagaaatcaacagagtgggagcgtggaggtagttggttaggggtttattacgtgctagtgacaagtctataaccaacctcctctaacggttcggacggaggaccgaagggtgagactacgaaacgtaacgtggtcggacgtgactaccgtattcgtcgttccgttctaccg

SEQ ID NO: 160215 - DNA, 629 bp, Homo sapiens
  misc_feature: GYAE6OF02F02I3.19.83.H06.1.454.CMB.1.raw
  modified_base (284)..(284): a, c, t, g, unknown or other
  misc_feature (284)..(284): n is a, c, g, or t
  modified_base (368)..(368): a, c, t, g, unknown or other
  misc_feature (368)..(368): n is a, c, g, or t
tcagtactctcgtgcacgaccggtgctcgatttagatcacgtgcgtcgtcggggcgtagactttgtgtttctcgtagtctgctttgctcagcgtcagggtgctgcgtaatgctctgggtctctggatccagtggggatattgtggtgactcagtctccacctctccctgcccgtcattcctggagagccggcctcgatctcctgcaagtctagtcagacgcctcctacatagtaatggacactaactattggattggacctgacagaagcagggcagtctccangctcctgatctagtttgggttctaacgtccgggtccttccggggtcctgacgtaggtttcaggtgcgagttcggatcgaggcanacgtatttacactagaaactcaaacagtacgtggacgtcgtgaggtagttggtttaggggtttaacttacgtagtactagttcgacgtaacggtccttaacgtaaaccgtaacccttacccgttacggttaacccggtttcggggacggtaacggggtacccgtaaggggtcggtagtaacgtaaccgaaacggtaagttccgggtggtaccgttacggacctaaccgtacgttaccggtttacgttccttaccttacccg

SEQ ID NO: 160216 - DNA, 540 bp, Homo sapiens
  misc_feature: GYAE6OF02JEXB4.19.83.H06.1.454.CMB.1.raw
  modified_base (357)..(357): a, c, t, g, unknown or other
  misc_feature (357)..(357): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaagtcgggcctccggggtccctgaccaggttcagtggcaggtggatcgaggcanagtatttacactagaaatcaacagagtggaggctggagtattggttggggtttattactgctatgacaagctactaaccaaaccttccctacgtaacgttcgggacggacgggaccgaagggttggagacgtacgaaacgacgtaggtcggcttgaccgtactactcgtacgttcttctaccg

SEQ ID NO: 160217 - DNA, 1004 bp, Homo sapiens
  misc_feature: GYAE6OF02IW7FW.19.83.H06.1.454.CMB.1.raw
  modified_base (265)..(265): a, c, t, g, unknown or other
  misc_feature (265)..(265): n is a, c, g, or t
tcagtactctcgtgcacgaccggtgctcgatttagatcacgtgcgtcggcgggcgtagtactttgtgtttctcgtagtctgtctttgctcagccgtcgagggtgctgctaatgctcgtgggtctcgtggatccgaggtggggtattagttggtggtagacctcgagtcctaccacttcctcccgtcggtcccgtactactttccgtagggaggacggcccggtccttccacttcctcctcgactaacgttcgtagtacacggacnccttcctacaagttaagtaagtacggaactaacctaactttagtttggtaagtttacgggttaacctgacgaacgaacgccggtagggctacgtcctaccgacgacgtccttccgtgtactttacgtttaggttttacggttaccgttaacgggttccccggggttcccggtttccccgggggttaccccgtacgggtaaccggttacgggggttttaccgtaacgggggttcgggtacggttaacgggttacggggtaacgttaccggtaacgggtaaccgtaaacggttaacctttttaaacgtttttaaaacccgttaacggtttaaaaacgtaaaaccgtttaaaacccgaaacggttaaaggggtaacggggttaaacgggggtaccgggttacgggttaaacgggggtaagggtttaacggggtttttacgggggtttttttaacgggggtttttaacctttaaccgggttacgtacggtaaccgtttaacggaacccggtttaaacggtaaccctttaaacccgttaaaacccttaaccccgttaaccccgtttacgggttaaacccgggtttaccggggtaaacggggtaaaccgggtaaccgggttaaagggttacggggtaaacttaacggtaaaccgtaaaacgggttaccggttaggggttaccgaccgtttaccgaaccgtaaccgtttccgttaccggtttaccgtttccttaccggttaacccg

SEQ ID NO: 160218 - DNA, 563 bp, Homo sapiens
  misc_feature: GYAE6OF02H6HV9.19.83.H06.1.454.CMB.1.raw
  modified_base (340)..(340): a, c, t, g, unknown or other
  misc_feature (340)..(340): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattcctggagagccggcctccatctcctgacaagtctagtcaagacgcctactacatagtaatggacactaactattggattggtaacctgcagaagccgaggcagtctccacagctctgattctagtttggtctaagcggccgtccgggtcctgactaggtcagtgnagtgatcaggcacagtactttacaatagaaatacgaacgagagtggaggctagaggtacgttggttttagggttacttacgtgactagtgacaagtctacctaaacctaacctaccctacgtaaaccgttcgaaaccgggtaggaacgtaacgggtaggataactaacgaaaccgtattgggacggtactacggcaaccgtattccgtaagtttcctagtacc

SEQ ID NO: 160219 - DNA, 514 bp, Homo sapiens
  misc_feature: GYAE6OF02FMIAB.19.83.H06.1.454.CMB.1.raw
  modified_base (465)..(465): a, c, t, g, unknown or other
  misc_feature (465)..(465): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctggacaggttcagtggcagtggatcaggcacagattttacactgaaatcaaacagagtggaggctgaggtatgttggggtttaattacgtgcatgcaagctactacaaactccccaacgttcggcgaggaccaaggtggagntacgaacgtaactgtacggctgacaccattaccgtgtccttcattcccg

SEQ ID NO: 160220 - DNA, 527 bp, Homo sapiens
  misc_feature: GYAE6OF02GECI7.19.83.H06.1.454.CMB.1.raw
  modified_base (328)..(328): a, c, t, g, unknown or other
  misc_feature (328)..(328): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacnggttcagtgcagtggatcaggcacagtattttacactagaaatcaacagagtggagctgaggtatgggtttgggtttaattacgtgactagtgacagtctctaacaaccgtccctacgacgttcggacggacggaccaagggtgagtatacgaaacgtactggtcgcgtgaccacctagtcctagttccttcttacccg

SEQ ID NO: 160221 - DNA, 565 bp, Homo sapiens
  misc_feature: GYAE6OF02HC2WQ.19.83.H06.1.454.CMB.1.raw
  modified_base (278)..(278): a, c, t, g, unknown or other
  misc_feature (278)..(278): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagacgcctctacatagtaatggacacaactattggattggtacctgcagaagccaggcagtctccanagctcctgatctatttgggttctaagtcgggcctccgggtcctgaccaggttccaggtggacagtcggatcgaggcaacgagtatttacactagaaactcaacagagtggagtcgtagaggtagttggttagggttattacgtgactagtagctaagcttacgtaacctaacgtccctacgtaacggttcggtaggaacggtaaccgaagggtcgacgtagtaaccgaaacggtaacgttcggtcgtacgtagaccgacctagttacgtacgttaccttataacccg

SEQ ID NO: 160222 - DNA, 559 bp, Homo sapiens
  misc_feature: GYAE6OF02G2UM4.19.83.H06.1.454.CMB.1.raw
  modified_base (349)..(349): a, c, t, g, unknown or other
  misc_feature (349)..(349): n is a, c, g, or t
  modified_base (416)..(416): a, c, t, g, unknown or other
  misc_feature (416)..(416): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagagcctcctacatagtaatggacacaactatttggattggtacctgcagaagccagggcagtctccacagctcctgatctatttggtctaatcgggcctccgggtcctgacaggttcagtgcaggtgatcgagcanagtatttacactagaaatcaacagtagtaggagcgtaggaggtattggttagggtttattacgtgtntatgacagctacgtactaacctcctacgtaacgttcgggtacggacggaaccgagggtacggacgtaacgtaaccgaaacggtaaccgttaggtacggtccgtaggacctaaccgtacgttcgttacgttccttacgtacccg

SEQ ID NO: 160223 - DNA, 502 bp, Homo sapiens
  misc_feature: GYAE6OF02H4HPH.19.83.H06.1.454.CMB.1.raw
  modified_base (223)..(223): a, c, t, g, unknown or other
  misc_feature (223)..(223): n is a, c, g, or t
  modified_base (410)..(410): a, c, t, g, unknown or other
  misc_feature (410)..(410): n is a, c, g, or t
  modified_base (460)..(460): a, c, t, g, unknown or other
  misc_feature (460)..(460): n is a, c, g, or t
  modified_base (484)..(484): a, c, t, g, unknown or other
  misc_feature (484)..(484): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctanatagtaatggacacaactatttggattggtacctgcagaagccagggcagtctcacagctctgatctatttggttctaagtcgggcctccgggtcctgacagtcagtgcagtggatcgaggcacagtatttacactagaaatacaacagagtggaggcgtagaggatggtttagggtttatacgtgnagtgacagtctactaacaactcctacgtacgtacggcggaggaccgaggngagatacgaaacgactggtcgacngaccacatctgtctctac

SEQ ID NO: 160224 - DNA, 621 bp, Homo sapiens
  misc_feature: GYAE6OF02IBC6T.19.83.H06.1.454.CMB.1.raw
  modified_base (171)..(171): a, c, t, g, unknown or other
  misc_feature (171)..(171): n is a, c, g, or t
  modified_base (389)..(389): a, c, t, g, unknown or other
  misc_feature (389)..(389): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagagccggcctccatctcctgcaagtctagtcagacgcctcctacatagtaatggacacaactatttggattggtacctgcagaagcccagggcagtctccacacgctcctgatctagtttgggtactaagtcgggcctccggggtcctgaccaggttcagtggcagtgatcaggcacagactttacactagaaatcaacagagtggagntagaggtagtacggtttaggggtttaacttaacgtcggtactaagttggaccaaaggtccttaaccgtaaacctaaaacccgttaccccgttacgtaaacgggtttaccgggacgggaaccggggtaaacccgtaaaggggttaggtacggtaacgtacggaaaacggtaaaccgttgggtacggtaccgttagacccgtaaccacgttacgtcgttaccgttaccgtaacc

SEQ ID NO: 160225 - DNA, 669 bp, Homo sapiens
  misc_feature: GYAE6OF02J1RGP.19.83.H06.1.454.CMB.1.raw
  modified_base (239)..(239): a, c, t, g, unknown or other
  misc_feature (239)..(239): n is a, c, g, or t
  modified_base (288)..(288): a, c, t, g, unknown or other
  misc_feature (288)..(288): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattggtggtgactcagtctccactcctcccctgccccgtcattcctggagagcccggcctccatctcctgacaagtctagtcaagcgcctcctacatagtaanggacactaactattgattggtacctgcagacgccaggcacgtctcacanctcctgatctagtttggttctagtccgggtcctccgggtccctgaactaggtcagtcgcgtagtcggatacgaggcaacgacgttagttttaacaacttagtaaaacacgtaaacgagtaggtacggaggcgtggacggtagtttcgggttttagggttaactttagtcggtactacgtacgacgtaacgttccttaccgttaaccgtaaaccccgttcccgtaaccgttaaccgggtttacgggacccgggtaaacgggtaacccggtaaacggggttacgggaacgttaacgttaacccggaaacggttaacgtcgggttagggtacctccggacctaaccggttacgttccgttacgttacccgttaccgttaacccg

SEQ ID NO: 160226 - DNA, 540 bp, Homo sapiens
  misc_feature: GYAE6OF02GCJ5P.19.83.H06.1.454.CMB.1.raw
  modified_base (376)..(376): a, c, t, g, unknown or other
  misc_feature (376)..(376): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagagccggcctccatctcctgcaagtctagtcagagcctcctacatagtaatggacacaactattggattggtacctgcagaagccaggcagtctccacagctcctgatctattgggttctaatcgggcctccggggtccctgacaggttcagtggcagtggatcgaggcacagtacttttacactagaaatcaanagagtggaggctgaggtatggttgggtttattacgtgtctatgactaagtcttactaactaaactccctacgaacggttccggacggacggaaccgaagggtgagactacgaaacgtaacgtcggtacggcgtagacctaccgtatctcggttaccttctaccg

SEQ ID NO: 160227 - DNA, 773 bp, Homo sapiens
  misc_feature: GYAE6OF02IEZU3.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattcctggagacgccggcctccatctcctgacaagtctagtcagagcctctacatagtaatggacacaactatttggattcggtacctgacgagaacgcagggcagtcctccacacgcctccgtgtacttcttagtttcgggttactaacgtccggggtcccgttcccggggttcccctaggtaccgtagggtttccgaggtcgggccgtaaggtcggtaactcgaacggcctaacgtaacgttaacgttttaccaagttaacggtaaaacttaccgaaacgaaggtaagggttagggtacgggttaggtaagggttaggtttggggttttaacgggggttttattaaccgttacggtaccgtaaggtcgtaacgtaacgtaccttaaccgttaaacccgtaaaaccgtttccccgttaaaccggtaaccgggtttacccgggggaacgggtaaaccgggggtaacctaaacgggggtacggtaaccggtaacggttaaacccggaaaccggttaaacgtttacgggtaccggtaccgttaaccggacctaaccgttacgttaaccgttcggttacccgtttaccgaaccttttcccccgg

SEQ ID NO: 160228 - DNA, 588 bp, Homo sapiens
  misc_feature: GYAE6OF02IO42T.19.83.H06.1.454.CMB.1.raw
  modified_base (404)..(404): a, c, t, g, unknown or other
  misc_feature (404)..(404): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtgggatattgtggtgactcagtctccactctccctgcccgtcattcctggagagccggcctccatctctgcaagtctagtcagagtccctctacagtagtaatggacacaactatttggattggtacctgcagaagccgagggcagtctccacagcctcctagatcctagttttggtactaagtccgggccgttccgggtccctgtacgtaggttccgagtggcagtgatcgaggcacgtagtattttacgactagaaatcaacagagtaggacgntcggaggtataggttaggtttacttacgtgacagtgactagtacctcgtaaacctaaactccctagttaaccgggtcggaccgggagggtaaaccgtagggtacggagacgttaaccggaaagtaaccggttaggtacggtaccgtaggtacctacgtcttacgtcgtttacctacgtacccgg

SEQ ID NO: 160229 - DNA, 594 bp, Homo sapiens
  misc_feature: GYAE6OF02G8J5Y.19.83.H06.1.454.CMB.1.raw
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (347)..(347): a, c, t, g, unknown or other
  misc_feature (347)..(347): n is a, c, g, or t
  modified_base (369)..(369): a, c, t, g, unknown or other
  misc_feature (369)..(369): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctctacatagtaatggacacaactattgattggtacctgcagaagccagggcagtctccacagctcctgatctagtttggtctaagtcgggcctccgggtccngacnggttcagtgcagtgatcaggcaanagtatttacactagaaatcaanagagtggaggctaggacggtagttggtttaggggtttacttaacgtgtactagtcgactaacgtccgttactaaaccgtaaccttaccccgttacgtaacggtttccggggtaagggtaacgggaaccgtaagggtacggaacgtaacgtaacgaaaacggtaacgttcggtacggccgtaggcccgtaaccgttacgtaccgttacggttaccttactaacccg

SEQ ID NO: 160230 - DNA, 538 bp, Homo sapiens
  misc_feature: GYAE6OF02IRELZ.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatcctcctgcaagtctagtcagacgcctcctacatagtaatggacacaactatttggattggtacctgcagaagccagggcagtctccacagctcctgatctatttggtctaagtcgggcctccggggtcctgacaggttcagtgcagtgatcgaggcacagtacttttacactaagaaatcaacgaaggaggtggaggcgtgaggtattggttagggtttattacgtgctatgacagtctactaactaacctccctacgtacgttcgggaacgggacggaaccgaggtggagacgtaacgaaacgtacgtggtacggctagacacgtactcgtgttcctctaccg

SEQ ID NO: 160231 - DNA, 535 bp, Homo sapiens
  misc_feature: GYAE6OF02GYIKP.19.83.H06.1.454.CMB.1.raw
  modified_base (343)..(343): a, c, t, g, unknown or other
  misc_feature (343)..(343): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagacgcctcctacatagtaatggacacaactatttggattggtacctgcagaagccagggcagtctccacagcctcctgatctagtttcgggttctaagtcgggcctccggggtcctgactggttcagtgcngtgactcaggtcacgagtatttacactaagaaatcaacgagtaggtaggaggctaggaggtagttggtttggggtttattacgtgactagtgacagtctactaacctaacctcctacgtacgttcggacggacgaacgaggtgagatacgaaacgactggtgcgtagactacgtatcgtacgtcctataccg

SEQ ID NO: 160232 - DNA, 554 bp, Homo sapiens
  misc_feature: GYAE6OF02I1EQU.19.83.H06.1.454.CMB.1.raw
  modified_base (389)..(389): a, c, t, g, unknown or other
  misc_feature (389)..(389): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagagccctcctacatagtaatggacacaactatttggattggtacctgcagaagccagggcagtctccacagctcctgatctatttgggttctaagtccgggcctccggggtcctggactaggttcaggtggctaggtggatcgaggcacgagtattttaacactagaaactcaaanaggagtaggaggctggaggtagttggttagggtttattacgtgctagtcgacagtctactaactaacctcctacgtacggttcgggacggaggaccgaaggtggagtacgtaccgaaacgtaacgtggtacgtcgtacgacacctagttctacgttcttctaccg

SEQ ID NO: 160233 - DNA, 627 bp, Homo sapiens
  misc_feature: GYAE6OF02JWP19.19.83.H06.1.454.CMB.1.raw
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagacgcctcctacatacgtaatggaacacaactatttggattggtacctgcagaacgccaggcagtctccanagctccngatctnttggtctaagtcggcctcgggccctgacgtagtcgagtcggcacgtgactcgaggacataaggtactttacactttaagaaactcgtaaacagacggttaggacggactggaaggtagttaggtttacggggtttattaacgttcggactagtaggtacgaacgttcgttaacctaacctaacccgttcccgtaagtaacccgggtttcgacccggggaaggtaaacccgtaacgggttacgggtacgtaagtacccgaaaaggtaacccgtgggtaccggacttagggtaccctaccgtaacgtcccgttacgttccgttacgtacccg

SEQ ID NO: 160234 - DNA, 563 bp, Homo sapiens
  misc_feature: GYAE6OF02FVEIO.19.83.H06.1.454.CMB.1.raw
  modified_base (353)..(353): a, c, t, g, unknown or other
  misc_feature (353)..(353): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggacctccatctcctgcaagtctagtcagagcctccacatagtaatggacacaactatttggattggtacctgcagaagccagggcagtctccacagctcctgatctatttggtctaagtcggccgtccgggtccctgacgaggttcgagtggcagtggatcagacanagtattttacactagaaatctaaacagagtggagcgtaggaggtatggttaggggtttaattacgtagcattgactaagctacctaacaaacctccctacgtaacggttacggacggacggaccgaagggtagggagtacgtaacgaaaacggaacgttacggtacggactacggccaaccgtacgttactacgttaccttactaacccg

SEQ ID NO: 160235 - DNA, 563 bp, Homo sapiens
  misc_feature: GYAE6OF02JF3J5.19.83.H06.1.454.CMB.1.raw
  modified_base (328)..(328): a, c, t, g, unknown or other
  misc_feature (328)..(328): n is a, c, g, or t
  modified_base (339)..(339): a, c, t, g, unknown or other
  misc_feature (339)..(339): n is a, c, g, or t
  modified_base (355)..(355): a, c, t, g, unknown or other
  misc_feature (355)..(355): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctctgatcttagtttgggtctaatcgggcctccggggtccctgacnggttcagtggnaggtggatcgaggcanagtatttacactagaaatcaacaggagtggagctggaggtagttggttggggtttaattacgtgtacagtgaccagtccttactaacctaaccgtcccttaacgtaaccgggtttcgggacgggtaacgggtaaccgaagggtaggacgaataccggaaacgaagtcggtaggtacgtacgactacgacttcgtgtccttcgtaaccg

SEQ ID NO: 160236 - DNA, 503 bp, Homo sapiens
  misc_feature: GYAE6OF02JHJ4I.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcgaggcacagatttacactagaaatcaacagagtggaggctgagatgttgggtttattactgcatgacaagctactacaaacctcctacaacgtttcggaggaggaccaagggtgagatacgaaacgacgtgtggctggcaccatctgtcttctacg

SEQ ID NO: 160237 - DNA, 541 bp, Homo sapiens
  misc_feature: GYAE6OF02I6SRP.19.83.H06.1.454.CMB.1.raw
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (420)..(420): a, c, t, g, unknown or other
  misc_feature (420)..(420): n is a, c, g, or t
  modified_base (423)..(423): a, c, t, g, unknown or other
  misc_feature (423)..(423): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagaggcccggcctccatctcctgcaagtctagtcagagcctccctacatagtaatggacacaacttatttggattggtacctgccaagaagccaggcagtcctcangcctcngatctagtttggtctaatccgggtcctccggggtcccctgacgaggttcagtggcaggtgatcgaggcacagtatttacatagaaatcaacagagtggagtctgaggtattgggttagggttattagngangtgacaacgtctataacccgtaactcctacgtacggttcggacggtacggacgtaggagagaatacgaacgtaactggtacggccgtagaccgacctacgttcgtacgttctctaccg

SEQ ID NO: 160238 - DNA, 565 bp, Homo sapiens
  misc_feature: GYAE6OF02FOP10.19.83.H06.1.454.CMB.1.raw
  modified_base (326)..(326): a, c, t, g, unknown or other
  misc_feature (326)..(326): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaagtcggcctccgggtcctgacnggttcagtggcaggtggatcgaggcactagtactttacactagaaatcaaacgagagtggagtcgtagaggtagttggtttaggggtttaattacgtgtactagtcgacaaggtctactaaccaaccgttccctacgtaacggttccgggacggtaacgggaaccgtaagggtggagactaacgaaacgacgttaggtgtacgtacgacctaccgtattcgtacgttccttacgtaccg

SEQ ID NO: 160239 - DNA, 612 bp, Homo sapiens
  misc_feature: GYAE6OF02I6RQM.19.83.H06.1.454.CMB.1.raw
  modified_base (283)..(283): a, c, t, g, unknown or other
  misc_feature (283)..(283): n is a, c, g, or t
  modified_base (375)..(375): a, c, t, g, unknown or other
  misc_feature (375)..(375): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagccctcctacataagtaatggacacaactatttggattggtacctgcagaagccagggcagtctccacngcctcctgatcttagtttggttactaagtccgggccgtccgggtcctgactggttcaggtgcagtggatcgagcactagtatttacacgtanaaactcaacagacgtggagtcgtggaggtagttgggtttagggtttattacgtcgtactagttcgacgaacgtctaacctaaccgtaacccttcccgtaaccgtaaccgggttaccgggacggggtaacgggaacccgtaagggtacggacgtaacgtaaccgaaacggtaccgttagggtaccggtccgtacggaccaaccgttcgttaccgtcggtttaccttaccgttaacccg

SEQ ID NO: 160240 - DNA, 529 bp, Homo sapiens
  misc_feature: GYAE6OF02GBVAS.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctagtttgggttctaagtccgggccgtccgggtccctgactaggttcagtgcagtggatcgaggcacgagtatttacactagaaatcaacagagtggaggctaggaggtagttggttagggtttattacgtgacgtatgacagctactaacaactccctacgtacgttcggacggacggacgaggtaggagatacgaaacgacgtggtgactcgaccggactagtctcgtactctaccg

SEQ ID NO: 160241 - DNA, 548 bp, Homo sapiens
  misc_feature: GYAE6OF02G5S93.19.83.H06.1.454.CMB.1.raw
  modified_base (171)..(171): a, c, t, g, unknown or other
  misc_feature (171)..(171): n is a, c, g, or t
  modified_base (276)..(276): a, c, t, g, unknown or other
  misc_feature (276)..(276): n is a, c, g, or t
  modified_base (430)..(430): a, c, t, g, unknown or other
  misc_feature (430)..(430): n is a, c, g, or t
  modified_base (521)..(521): a, c, t, g, unknown or other
  misc_feature (521)..(521): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagagccggcctccatctcctgcaagtctagtcagagcctcctacatagtaatggacaacaactatttggattggtacctgcagaagccaggcagtcnccacagctcctgatctatttgggttctaatcgggccgtccgggtccctggacaggttccagtggcagtggatcgaggcaacagtattttaacgactagaaatcaacagtaggtggagcgtagaggtagttaggtttggggtttattacgtagtnaagtcgcaagcttataacctaactccctacgtaaccggttccgacgggaacggaacgaagggtggagacgtaccgaaacgacgtaggtcgngtacgcgacgattcgtctcgtctaccg

SEQ ID NO: 160242 - DNA, 618 bp, Homo sapiens
  misc_feature: GYAE6OF02GP5JM.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagtccctcctacataagtaatcggacaacaacttatttggattggtacctgacagaacgccgagggctagtcctaccaacacgcctcctgattcgttagtttggttactacggtccggtccgtccgggtcctgacgtaggtcgagtggctaggtagtatcgagaccatagtactttaccagtaagaaactacaaagaggtaggtaggacggtgtaggaaggtaggttaggtttaggtttattcgtagcgtatcgacgtagtctactaaccgtaaccttaccgtaccgttaaccggttcgggacggtaacgggaaccgtaggggtacggaacgtacgtaaccggtaaacggtaacgttagtacggtaccacgtacctacgtaattcgtcgttaccttacctacccg

SEQ ID NO: 160243 - DNA, 579 bp, Homo sapiens
  misc_feature: GYAE6OF02F0D9P.19.83.H06.1.454.CMB.1.raw
  modified_base (573)..(573): a, c, t, g, unknown or other
  misc_feature (573)..(573): n is a, c, g, or t
tcagtactctcgtgcacgaccggtgctcgatttagatcacgtgcgtcggcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctagtttggttctaagtcgggcctccggggtccctgacgaggttcaggtggctagtggatcgaggcacagtatttacactagaaatcaaacagtaggtggaaggtcgtggaacggtagttagggtttaggggtttattacgtgtacctagtgtacagtcttactaacctaaacccgtccctacgtaaccggtttacgggaccggtaacgggtaccgaaagggtggtaagacgtacgaaaacggtacgttaggtcggcgtcgaccgtactacgtctcgttactntacccg

SEQ ID NO: 160244 - DNA, 643 bp, Homo sapiens
  misc_feature: GYAE6OF02IBS1T.19.83.H06.1.454.CMB.1.raw
  modified_base (171)..(171): a, c, t, g, unknown or other
  misc_feature (171)..(171): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagagccggcctccatctcctgcaagtctagtcagacgcctcctacatagtaatggacaactaactatttggatttcggtacctgacagaacgccgaagggcagtctaccacagccttcctgtacttacttagtttcgggttactaacgtccgggtcccgttccggggtccctaggacgtaggttccaggttggacgtaggtggactacgaaggcctaactagttacttttacgaactaggtaaaactacaaacgaggtacgtagggagtcgtaggacggtaggttgggttttagggtttattacgtagtactatacgactaagactaccgtaactaaacccgtcctaacgtaacggttccgggaacgggtacggaaccgtaagggtgagtacgtaaccgtaaacggactgggtacgacgttaccggacctaaccggtacgttacgtcgtttaccgtattacccg

SEQ ID NO: 160245 - DNA, 523 bp, Homo sapiens
  misc_feature: GYAE6OF02HGYFW.19.83.H06.1.454.CMB.1.raw
  modified_base (327)..(327): a, c, t, g, unknown or other
  misc_feature (327)..(327): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccgggtccctgacnggttcagtggcagtggatcgaggcacagtattttacactagaaatcaacagagtggaggctaggaggagttggtttaggggtttattacgtgcatgacaagctactaacaacctccctacgtaacgttcggacggacggacaagggtggagtataccgaaacgaactggtagctgcacctactcgtcgtcttctac

SEQ ID NO: 160246 - DNA, 496 bp, Homo sapiens
  misc_feature: GYAE6OF02FGTA0.19.83.H06.1.454.CMB.1.raw
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagagccagggcagtctccacagctcctgatctatttgggttctaatcgggcctccggggtccctgacaggttcagtggcagtggatcaggcacagtattttacactgaaatcaacagagtggaggctgaggtatggttaggggtttattactgcatgcaagctactacaacctccctacaacgttcggcgaggaccaggtganancgaaacgactgtgctgcaccatctgtcttctac

SEQ ID NO: 160247 - DNA, 650 bp, Homo sapiens
  misc_feature: GYAE6OF02HRLD9.19.83.H06.1.454.CMB.1.raw
  modified_base (335)..(335): a, c, t, g, unknown or other
  misc_feature (335)..(335): n is a, c, g, or t
tcagtactctcgtgcacgaccggtgctcgatttagatcacgtgcgtcgcgggcgtagactttgtgtttctcgtagtctgctttgctcagcgtcagggtgcttctaatgctctgggtctctggatccagtggggatattgtggtgactcagtctccactctccctgcccgtcattcctggagagccggcctccatctcctgcaagtctagtcagagcctcctacatagtaatggacacaaactatttggattggtacctgcagaagccagggcagtctccacagctcctgatctatttgggtctaagtcgggcctcggggtccctgacggtacgtntacggtggcgtaggtgtacgtacgaggaccagtaagttaacttaactacgaagtaaaactacgaacgtaacggtaggtagggacggtacgtaggaaagggtattggggtttaacgggttttaattacgtacggactaagtacgaacgaagttacctaacgtaaacctaaacccttcccgtaacgtaccgggttacggggaacgggtaacgggaaacgtaagggtagaagtacttaacgaaaacggtacgttagggacggtaccgtacgtaacctacccgtagtcctttacggttaccttccgttacttaccccgg

SEQ ID NO: 160248 - DNA, 649 bp, Homo sapiens
  misc_feature: GYAE6OF02HXTHP.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggccctccatctcctgcaagtctagtcagagcctcctacatagtaatggacacaactattggattggtacctgcagaagccgagggcagtctccacagtctcctgatcttagtttgggttctaagtccgggccgtccgggtccctgactaggttcagtggctaggtggatacgaggacacgtagttacttttaccaacgtaagtaaaactacgaaacgtaggaagggtaggacgggtcgtaggaagggtagtttagggtttagggtttaacttacgtagacgtagtgacgtaacgtacttactaaccctaaaccgtacccttaacgtaaccgggtttaccggggaccggggtaacgggaaccgtaaggggtacggtacggtaacgtaaccggaaaacggtaccgttagggtacggtacgtacggacccgtaccgtagttaccgttcgttaccgttcttaacccg

SEQ ID NO: 160249 - DNA, 590 bp, Homo sapiens
  misc_feature: GYAE6OF02FKTWD.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagagcctcctacatagtaatggacacaactatttggattggtacctgcagaagccagggcagtctccacagctcctgatctagtttgggttctaatcgggcctccggggtcccctgactaggttcaggtggcagtggatcgaggcacagtattttacactagaaatacaacagagtggaggactagaggagttgggttagggtttattacgtagcgtagtgactaaggtaccttactaaccgtaaacctacccgttacgtaaccggtttaccgggaccgggtaacgggtaaccgaagggtacggaaggtaactaccggaaaacggtaacgttaggtacggtcgtacggaccaccgtacttcctgttccttacctaccg

SEQ ID NO: 160250 - DNA, 655 bp, Homo sapiens
  misc_feature: GYAE6OF02JMK46.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattcctggagagccggcctccatctcctgcaagtctagtcagagcctctacatagtatcggacactaactattgattggtactgcagaacgccgaggcagtctaccacagctcctgactctatttgggttacttaagtcgggccgttcccggggtcctcgacgacggttcgaggtcggtacgaggtggaacgtcgagggtccaactagtaacttttacgacttaagaaacttacaaacgagtagtgggacggtacgtagtaggtagttgggtttaggggtttttaacgttcgttaggccgtagttacgacaacggtccttaccgttaaacaaccccgttacctaccgtaacggtttaccgggggtacgggtaaacgggaaccgttaaggggtaggtaccgtagtaccggtaaaaccggtaacgttgggtaacggtctaaccggacctaacccgtctttacggtcgttccctttactaacccgg

SEQ ID NO: 160251 - DNA, 577 bp, Homo sapiens
  misc_feature: GYAE6OF02J187Q.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgacttcgttatttgggttctaacgtcgggcccgttcccggggtccctgacgtaggttcaggtggcaggtggactcgagcaacagtactttacactagaaatcaacagagtggacgtgtagaggtattagggttagggtttattacgtgactagtgactagtctactaactacctacccgtacgtaacggttacggacgggtaacggtaccgaaggtcggagtacgtacgaaacggtacgtacggtacggacgtacgtacgtaccgacgttcgtacgttccttactacccg

SEQ ID NO: 160252 - DNA, 732 bp, Homo sapiens
  misc_feature: GYAE6OF02IDXQN.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatcaggtggggatattgtggtgactcagtctccactcctccctcgtcccgtctacttccgtgggacgacggcccggcccttccatcctccgtgactaacgtctaagtcaagcgcctacctacatagtaaagtcggaaccaacaattagttaggagttcgtacctgaccaaggaacgcgaacggactagtccctaccacacgtccttactgtaacttctttaggtttcggttactaagtccggggcccgttccccgggtcctagtacctaggttccaaggtcggacgtaaggtggactcgaacgcgaacttaaggttaactttaccgaagttaagaaaactacgtaagacggtaagggtggacggtcgtaggaaggttacggttagggttttacggggtttaattaccgttaggacttacggtagtaacgtacgtacccgtaaccgttaaccaacccggttcccttaaccggtaaaccgggttccgggtaacgggaaacccggggtaaccgtaagggtacgggaacgtacgttaaccgaaaacggtacgttagggtaccgttacgtaccgacgtaaaccctcgttacgttacgtttccgttacttaccccg

SEQ ID NO: 160253 - DNA, 615 bp, Homo sapiens
  misc_feature: GYAE6OF02IJ62C.19.83.H06.1.454.CMB.1.raw
  modified_base (425)..(425): a, c, t, g, unknown or other
  misc_feature (425)..(425): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagccctcctacatagtaatggacacaacttatttggattggtacctgacagaacgcgaggctagtcctccacagtcctccgtagacttcgtttagttttcgggttactaacgtccgggtcccgttcccggggtaccctggtacgtaggttcaggtgacgtaggtggatcgagcactagtactttacatagaaactacgaagagagtaggagngtagaggtagttgggttagggtttatacgtgactagtagtacacgtctacctaactaaccgtcccgtacgtaacggttccgggaacgggtaacggtaacccggtaagggtacgaacgtaacgtaaccgaaaaccggtacgtcggtacggtacctacgacgtacctagttccgtgttaccgtacgttaccg

SEQ ID NO: 160254 - DNA, 597 bp, Homo sapiens
  misc_feature: GYAE6OF02IAF4X.19.83.H06.1.454.CMB.1.raw
  modified_base (171)..(171): a, c, t, g, unknown or other
  misc_feature (171)..(171): n is a, c, g, or t
  modified_base (182)..(182): a, c, t, g, unknown or other
  misc_feature (182)..(182): n is a, c, g, or t
  modified_base (222)..(222): a, c, t, g, unknown or other
  misc_feature (222)..(222): n is a, c, g, or t
  modified_base (397)..(397): a, c, t, g, unknown or other
  misc_feature (397)..(397): n is a, c, g, or t
  modified_base (446)..(446): a, c, t, g, unknown or other
  misc_feature (446)..(446): n is a, c, g, or t
  modified_base (560)..(560): a, c, t, g, unknown or other
  misc_feature (560)..(560): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattccgtgganagccggcctcatctcctgcaagtctagtcagcgcctctanatagtaatggacataactattgattggtacctgcagaagccaggcagtctcacagctcctgacttcttactttcgggttactaagtcgggaccgtcccgggtcctggactaggtacaggtggacgagtgatcgaggcaatagtatttacacgtagaaatcaagacggagtggagngtaggacggtagttagggtttagggtttacttacgtgtactagttcganaacgtacttactaaccgtaaccctcccgtaacgttaaccgggttacgggacgggaacgggtaaccgtaagggtacggaacgtaacgtacgaaacggtaccttggaccggttacncgtaccacgtattccgttacgttccttacgttacccg

SEQ ID NO: 160255 - DNA, 557 bp, Homo sapiens
  misc_feature: GYAE6OF02F60ZZ.19.83.H06.1.454.CMB.1.raw
  modified_base (367)..(367): a, c, t, g, unknown or other
  misc_feature (367)..(367): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagagccctcctacatagtaatggacacaacttatttggattggtacctgacagaagccagggcagtcctccacagctcctgactcttagtttgggttctaacgtccgggccgtccgggtccctgacgcggttcagtggcaggtgatcgaggcaanagttatttacactagaaactcaacagaggtggagcgtaggaggtagttgggtttagggtttaattcgtgtactagtgactacgtctactaactaccttccctacgtaacggtcggacggaaggacgaggagagaactacggaaacgtaacgtggtaggtcgtacgacgtacattcctagttcctctaccg

SEQ ID NO: 160256 - DNA, 766 bp, Homo sapiens
  misc_feature: GYAE6OF02I95PB.19.83.H06.1.454.CMB.1.raw
  modified_base (168)..(168): a, c, t, g, unknown or other
  misc_feature (168)..(168): n is a, c, g, or t
  modified_base (193)..(193): a, c, t, g, unknown or other
  misc_feature (193)..(193): n is a, c, g, or t
  modified_base (201)..(201): a, c, t, g, unknown or other
  misc_feature (201)..(201): n is a, c, g, or t
  modified_base (597)..(597): a, c, t, g, unknown or other
  misc_feature (597)..(597): n is a, c, g, or t
  modified_base (647)..(647): a, c, t, g, unknown or other
  misc_feature (647)..(647): n is a, c, g, or t
  modified_base (731)..(731): a, c, t, g, unknown or other
  misc_feature (731)..(731): n is a, c, g, or t
tcagtactctcgtgcacgaccggtgctcgatttagatcacgtgcgtcgcgggcgtagacttgtgtttctcgtagtctgcttgctcagcgtcaggtgctgctaatgctcgtgggtctctggataccagtgggatattgtaggtgactcagtctccatctcctgaccgtnattccgaggacgacgtccgcctacntcctccgngcgaagtctagtcaacgcgtcctactaacagtacgtaatcggtaaccacgtaacgttaggtttcggaactttcgggaacccttggaaccgaacgaacggcccctaaacggggtccaacgggttcccgttaaccccaaagggtacgttaccccttaccgttggaactttaccgtttaaggttttccggggtaccttaaaacgggttcccgggggttaccccgttccccgggggttacccctaagggtaaccggttacgggtttacccgaggggtaccggtttaccaggttacggggttactacccggaagggttaaccaaccgggttaaagtttaccttttaaaccgaaccggttaaaggtaaaaactccggaaacggtaaggtagggttaaccggnggtaccgtaggaacgggttaagttcgggtttacgggttaattaacgggtnttacgagtcgtacgtacgtacttacaaccgtacctccgtagttaaccggtggacggagtaacgaggtacgatacggacaaacgntacgtgcctgaactcggtaattctacgcttacgcg

SEQ ID NO: 160257 - DNA, 600 bp, Homo sapiens
  misc_feature: GYAE6OF02F9A92.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagacgcctcctacatagtaatggacacaactatttggattggtacctgcagaagccagggcagtcctccacagctctgatctagtttggtctaagtccgggccgtccggggtccctgacgtaggttcaggtggcgtagtggatcgaggcaactagtactttaacgactagaaactaccgaaacgtagtaggtgggaggtcgtggaggtagttgggtttaggggtttattacgtgacgtagtgactagtcctacgtaacctacctccgtacgtaacggttcgggacggtaacggtaccgtaagggtacggtagtacgtaaccggaaacgtaccgtaggtacggacgttacgaccgtaaccgtacgtccgtttcgttaccttacgtacccg

SEQ ID NO: 160258 - DNA, 678 bp, Homo sapiens
  misc_feature: GYAE6OF02JSIN6.19.83.H06.1.454.CMB.1.raw
  modified_base (233)..(233): a, c, t, g, unknown or other
  misc_feature (233)..(233): n is a, c, g, or t
  modified_base (446)..(446): a, c, t, g, unknown or other
  misc_feature (446)..(446): n is a, c, g, or t
  modified_base (658)..(658): a, c, t, g, unknown or other
  misc_feature (658)..(658): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggccctccatcctcctagacgaagtctagtcagacgtccctacctanattagtaatcggaaccaactaacttagtttaggtattcggtacctgacaagaacgccgtagggcacggtcctaccacgtagcctacctgacttacttaggtttgggttactaacggtccgggtcccgtcccggggtaccttaggacttacgggttcaggttggacgtaggtagggactacgaaggcaacgtaagttacctttacgaccgtaanaaaatacaacgtagaggtgggaggctaggagtagttacggttaggttactaacgtgagacgtagacgtaatccgtactaaaccgtaaccctccgtaacggttaccggttacgggaaccgggtaaacggaacccgtaaggggtacggtactaacggttaacccgaaacggttacgtgggtccgtaccgtccgggacttacccgagtttcccgngtttacccgtacgttacccg

SEQ ID NO: 160259 - DNA, 603 bp, Homo sapiens
  misc_feature: GYAE6OF02H95F6.19.83.H06.1.454.CMB.1.raw
  modified_base (459)..(459): a, c, t, g, unknown or other
  misc_feature (459)..(459): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagagccggcctccatcctcctgcaagtctagtcagacgcctcctacatagtaatggacacaactattggattggtacctgcagaacgccgagggcacgtcctaccacagcctctgatctagtttggtctaacgtccgggcccttccggggtcctgacgtaggttcaggtcggactaggtggactcgaaggacaacgtagtactttaacacgtaagaaaactcgaaactaaggacgtaggaaggtctaggacggtagtttcggttagggtttacttacgngactagtacgactacgtctactaaccgtaaccgtcccgtacgtaacggttcggacggaacggtaaccgtaagggtacgagtacgtaacgaaacggtactaggtcgtaccgtacgacgtaccgtagttacgtacgttctacgtac

SEQ ID NO: 160260 - DNA, 590 bp, Homo sapiens
  misc_feature: GYAE6OF02HP3MK.19.83.H06.1.454.CMB.1.raw
  modified_base (333)..(333): a, c, t, g, unknown or other
  misc_feature (333)..(333): n is a, c, g, or t
  modified_base (359)..(359): a, c, t, g, unknown or other
  misc_feature (359)..(359): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatcctcctgcaagtctagtcagacgccctcctacatagtaatggacacaactatttggatttggtacctgcagaagcagggcagtctccacagctcctgactcgttatttggttctaagtcggccgtccgggtcctgacgngttcagtgcagtggatcgaggcaacngtacttttacactagaaactcgaactaggagtggaggcgtagaggtagtttagggttagggtttatttacgtagtctacgtgtactaacgtcttacctaaccgtaacccttccccgtacgttaaccggttccgggtaaccgggacgggaaccgtaagggtaggagacgtaacgaaaccgtacgttcggtaggacctaggacctacctagtccttcgttccttcgttacccg

SEQ ID NO: 160261 - DNA, 660 bp, Homo sapiens
  misc_feature: GYAE6OF02F8LPH.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattcctggagagccggcctccatctcctgcaagtctagtcagacgcctcctacaatagtaatcggacacctaacttatttggattgggtacctgacaagaacgccgagggcagtcctccacacgctcctggacttctagttttgggttctaagtccgggtcccgttcccggggtccgtgacgtggttcgaggtcggcgacggtggtatcgaggcaacaggttaacttttacacgtaagaaaactacgaacgaggtaggtacgggaggtacgttagggacggtagttaggggtttacgggttttattacgtggtacgtagtcgtaactacgtaccttaacctaacctaccgttacccgtacgtaaccgggttccgggacgggtaacggaaccggtagggtacggacgtaacgtaaccggtaaacggaaccgttgggtaccgtacggtacgaccgtaccgtacgttaccgttacggttcttacgtaaccc

SEQ ID NO: 160262 - DNA, 671 bp, Homo sapiens
  misc_feature: GYAE6OF02I1R2X.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattgattggacctgcagaagccagggcagtctccacagctcctgactctagtttgggttcctaagtccggggtacctccggggtcccttgacgtaggtttcaggtggacctaggtcgggaatcgaggacaacgtagtacttttaacgacttaagaaactacaaacagagtgggacggtactaggagggtattagggttacgggttttaattaactcgtacgtagttcggaactaagtccgttaactaaacctaaaccgttccccgtaagtaacccgggtttaccggaaccggggtaacgggtaaccgaaacggggttgggaacgtaacgtttaacccggaaaacggttaaacgttacgggtacgggtaccgtacggtaccgtaaacccgtaacgttacccggtttacgttaccggtttacctaaccccgg

SEQ ID NO: 160263 - DNA, 614 bp, Homo sapiens
  misc_feature: GYAE6OF02HAM3M.19.83.H06.1.454.CMB.1.raw
  modified_base (599)..(599): a, c, t, g, unknown or other
  misc_feature (599)..(599): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgcccggcctccatcctcctgcaagtctagtcagagccctcctacatagtaatggacacaactatttggattcggtacctgcagaagccgagggcagtctccacagcctcctgattctagttttgggtctaacgtccgggtcccgttcccggggtcccctaggaccgtaggttcaggtcggacgaggtggatccgacggacacgtagttactttacgaacgttaagaaactcaacaggtaggtggagtcgtggtaggtgttagggtttagggtttaattcgtagtactagtacgactaagtctacctaaacctaaccctccgttaacgtaccggttacgggacgggtaacggaaccgtaagggtcggatacgtaacgaaacgtacgttggcgtacgacggactaccgtattccgttnttaccgtcttaaccg

SEQ ID NO: 160264 - DNA, 523 bp, Homo sapiens
  misc_feature: GYAE6OF02FUCV8.19.83.H06.1.454.CMB.1.raw
  modified_base (328)..(328): a, c, t, g, unknown or other
  misc_feature (328)..(328): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggccctccatctcctgcaagtctagtcagagcctcctacatagtaatggacacaactattggattggtacctgcagaagccagggcagtctccacagctcctgatctatttgggttctaatcgggcctccggggtccctgacnggtcagtggcaggtgatcaggcacagtatttacactagaaatcaacagagtggaggctagaggagttggttggggtttaattactgtcatgcaagcttactaacaaacctccctacgaacgttcggacggagggaccaagggtgagacacgaaacgaacgtggtagcgtagcaccattcgtcgtacttacgtacc

SEQ ID NO: 160265 - DNA, 621 bp, Homo sapiens
  misc_feature: GYAE6OF02F97GH.19.83.H06.1.454.CMB.1.raw
  modified_base (182)..(182): a, c, t, g, unknown or other
  misc_feature (182)..(182): n is a, c, g, or t
  modified_base (400)..(400): a, c, t, g, unknown or other
  misc_feature (400)..(400): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtgggatattgtggtgactcagtctccactcctccctgcccgtcattcctggagngccggcctccatctcctgcaagtctagtcagacgccctcctacatagtaatggaacacaaattatttggattcggtacctgacagaacgccgagggcagtctccaacacgctcctgattacttagtttgggttctaagtccgggtccgttcccggggtcctgacgtaggttcgagtggcagtgatcgagcacagtatttacactagaaaactcaaacngtaggagggagtcgtagaggtagttgggtttagggttttaagttacgtacgtcgagtacgactacgtacctaccgtaacctaaccttaccgtacgttaacggttacgggaccggaacgggtaacgaacgggttggactaacgtaccgtaaacggtaaccgttagggtacggaccgttacggacctaaccgttacgttcgtaccgtttaccgttactacccg

SEQ ID NO: 160266 - DNA, 631 bp, Homo sapiens
  misc_feature: GYAE6OF02H7B16.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtgggatattgtggtgactcagtctccactctccctgcccgtcattcctggagagccggcctccatctcctgcaagtctagtcagagcctcctacatagtaatggacacaacttattggattggtacctgcagaagccagggcagtctccacagctcctgatctatttggttctaagtcgggccgtccgggtccctgacgaggttcagtgcagtggatcgaggtcacgagtattttacactaagaaaatcaaacgagacgtaggaggcgtgaggtagttggtttaggggtttatttaacgtgaccgtagtcgctaacgggtcttaccgtaaacctaaaccttccccttacggttaacccggtttccgggaacggggaaccgggtaaaccgtaaggggtcggaacggtaacgtaaccggaaaacggtaacggttcggtaacggggtccgttacggaccgttaacccgagtttacccgtttacgtttcccgtttaccttaacccgg

SEQ ID NO: 160267 - DNA, 582 bp, Homo sapiens
  misc_feature: GYAE6OF02IHDNN.19.83.H06.1.454.CMB.1.raw
  modified_base (172)..(172): a, c, t, g, unknown or other
  misc_feature (172)..(172): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtnattcctggagacgccggcctccatctcctgcaagtctagtcagacgcctctacatagtaatggacacaactattggattcgtacctgcagagccgagggcagtcctccacacgctccgtgattcttagtttcgggttactacgtacgggtcccgttccggggtccctgacgtaggttcaggtggctaggtgatcgagctacgagtacttttacacttagaaactacaagagtaggtggacgacgtaggaggtagttgggtttagggtttacttacgtgtactagtgtacaacgtctaacgtaacctaacctcctacgtacggttcggacgggacggtaccgaggtacgacgacgtaacgaaacgtacgtaggtacgtacgacgacaccgtcgtacgtcgttcctataccg

SEQ ID NO: 160268 - DNA, 567 bp, Homo sapiens
  misc_feature: GYAE6OF02INGF7.19.83.H06.1.454.CMB.1.raw
  modified_base (171)..(171): a, c, t, g, unknown or other
  misc_feature (171)..(171): n is a, c, g, or t
  modified_base (355)..(355): a, c, t, g, unknown or other
  misc_feature (355)..(355): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagagccggcctcatctcctgcaagtctagtcagagccctcctacatagtaatggaccacaactatttggattggtacctgacagaacgccagggcagtctaccacagcctcctagatcttatttggtactaagtcggccgtccgggtcctgacaggttcagtgcagtgatgagcanatatttacactagaaatcaacagagtggagctgaggtattaggttagggtttaattacgtgactagtacgactaagcttacctaactaaaccttcccgtacgtaaccggttggaaccgggtaaggaacccgtaagggtacggagtaactaccggtaaaagtaacgttggtacggctacgactaccgtattccgttcttaccgttactacccg

SEQ ID NO: 160269 - DNA, 608 bp, Homo sapiens
  misc_feature: GYAE6OF02GE368.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaagtctagtcagacgccctcctacatagtaatggacaacaacttatttggattggtacctgacaagaacgccgagggcacgtcctaccacacgcctcctgacttcttagttttcgggttactaacgttccggggacccgttccggggtccctgacgtaggttcgagtggctaggtgatcgaggcactagttactttacacgtagaaatacaaacgagaggtggaggtcgtaggaaggtagttagggtttagggtttaattacgtagtactagtacgactaagtcctactaacctaaccttcccgtacgtaaccggttcgggacggaacggacgtaagggtagacgtacgtaacgaaacgtacgtcggtacgtacgtcgactacgtactcgtcgttactactacccg

SEQ ID NO: 160270 - DNA, 745 bp, Homo sapiens
  misc_feature: GYAE6OF02HGJJK.19.83.H06.1.454.CMB.1.raw
  modified_base (149)..(149): a, c, t, g, unknown or other
  misc_feature (149)..(149): n is a, c, g, or t
  modified_base (172)..(172): a, c, t, g, unknown or other
  misc_feature (172)..(172): n is a, c, g, or t
  modified_base (184)..(184): a, c, t, g, unknown or other
  misc_feature (184)..(184): n is a, c, g, or t
  modified_base (233)..(233): a, c, t, g, unknown or other
  misc_feature (233)..(233): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactnagtctccactctccctgcccgtnagttcctggagngcccggcctcatctcctgcagtctagtcagacgccctcacattagtaanggaacacaacttagttggattcggtacctgcagaacgccgacgggcacgtcctccacacgccttcctagacttacgtttagttttcgggttaccgtaacgtccggggtccccgttcccgggggttcccctcggtaacgtaggttaccgtagggtcggggcgtaaggtcggtagtcgacggtacctaagttacgttaacttttaacgaacgttaacgaaactaccgaaacgtacggtaaggtgggacggtcgtagggtaaggttaggtttggggttttaggggtttaacttagtacgtacgtaagttacgaaccgtaccgttccttaaaccgtaacccttaaaccccgttacccgttaaccggttaaccggggttaccgggaaccgggggtacgggtaaacccgtaacgggggtaggtaacgtaaccgtaacggaaaaccgtcggttacgggtacggacccgttacggaccccgtacgttagttaccggtacgtttaccgttacccttacccg

SEQ ID NO: 160271 - DNA, 568 bp, Homo sapiens
  misc_feature: GYAE6OF02HVJ5N.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctctacatagtaatggaacacaactatttggattggtacctgcagaagccgagggcagtctccacagctcctgatcttagtttgggtttactaacgtccgggcccgttcccggggtccctggacaggttcaggtggcaggtgatgacggcacagtatttacatagaaactacaacagaggtggaggcgtgtaggtgttggttaggggtttattacgttgcgtatgacgaagtctactaaccgaaacctccctactacggttcggaccgggtaagggaaccgaaggggtggaagtacgtaaccgaaaccgtaacgtggtcgtcgtagcgaacctatcgttgtccttactaccg

SEQ ID NO: 160272 - DNA, 560 bp, Homo sapiens
  misc_feature: GYAE6OF02IDD3E.19.83.H06.1.454.CMB.1.raw
  modified_base (402)..(402): a, c, t, g, unknown or other
  misc_feature (402)..(402): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagagccggcctccatctcctgcaagtctagtcagagccctcctacatagtaatggacacaacttatttggattggtacctgcagaagccagggcagtctcacagcctctgatctagtttggttctaagtccgggccgtccggggtcctggacaggttcagtggcaggtggatcgaggcaactagtactttacgactagaaatcaacgtagaggtaggaggtntagaggtagttggtttagggtttattcgtgctagtgacacgtctactaactaaccctccgtacgtaacggttcggacggaaggtaaccgaagggtagacgacgtacgaaacggtacgtcggtacggctacggactaccgtatccgttgtcctataccg

SEQ ID NO: 160273 - DNA, 583 bp, Homo sapiens
  misc_feature: GYAE6OF02I70G7.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccgagggcagtctccacagctcctgactctatttgggttctaagtcgggtccgtccggggtcccttgacgtaggttctaggtggacagtggactcgaggcactagtacttttacgaactaagaaactacaacgtaagaggtaggaggtacgtaggaggtagttagggtttagggtttaacttacgtagtctattcgacgtaagtcctactaacctaacctcccttaacgtacgttcgggaggtacggaacgagggtacgagtacgtacgaaacgtacgtaggtcgtacgtagaccactacgtgtcgtcttacgtacccg

SEQ ID NO: 160274 - DNA, 634 bp, Homo sapiens
  misc_feature: GYAE6OF02JCSRL.19.83.H06.1.454.CMB.1.raw
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgcccggccttaccatcctcctagcaagttctagtcagagccctctaacatagaatcggacacaactattgattggtacctgcagaagccaggcagtctaccanagctccngatctagtttgggtctaagtccgggccgttaccgggtccctcgactacggttactaggtcggcgaggtggatcgacgggcaacaggttaacttttaccacgttanaaaactccgaaacaaggngtacggaaggtcgtaggaggtaggttggttaggggtttaattaacgttcgtacgtagtacggtcaaacggtcttaacgtaaacccgtaaacctccccgtaagtaacccggtttacgggacggtaaacgggtaaccgtagggtacggtacgaacttaaccggaaaacggtaactggggttacgacttggacctactaccgtgttaccgtcttactaccg

SEQ ID NO: 160275 - DNA, 769 bp, Homo sapiens
  misc_feature: GYAE6OF02HT0E3.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattggtggtgactcagtctccactctccctgcccgtcattcctggagacgccggcctccatctcctgacaagtctagtcagacgccctactacatagtaatcggaccactaacttagtttggagttacggtacctgacgaagaacgcccgaaggggtacctacggttaccctacccgaacgacgtcccttcccgttagtaacttcgttttaagttttcggggtttactaacggttcccgggtcccggttaccccggggtcccttacggacggtacggttacgacgggtcggtaccgtaggtcggagttcgacggtaccgtaacgtaagtttaacttttacgaacgtaacgtaaaactaccgtaaacgtaaggtaaggggtacgggaacgggtacgttagggtaagggttaggtttagggttttagggtttaattacggtcgtacgtagtacgtactaacgtaccttaaccgtaaccgtaacccgttacccgtaaccggttaacgggtttacgggtaaccggggaacgggtaaccggtaagggttacggtacgaccgttaacggaaacgtacggttgggtacgtaccgtacgaccctacgttccgttaccggtttacgtcccgttattaccccg

SEQ ID NO: 160276 - DNA, 530 bp, Homo sapiens
  misc_feature: GYAE6OF02FNC21.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattgtacctgcagaagccagggcagtctccacagctcctgatctatttgggtctaagtcgggcctccggggtccctgacaggttcagtgcagtggatcgaggcacagtatttacactagaaaatcaacagagtggagctaggaggtattggtttaggggtttattacgtgcagtgactaagctactaaccaacctccctacgtaacgttcgggacggacggaccgaaggtgagactacgaaacgaactggtaggcgtacgcacgtagttctgttccttactacg

SEQ ID NO: 160277 - DNA, 592 bp, Homo sapiens
  misc_feature: GYAE6OF02FL0FY.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatcctcctgcaagttctagtcagagccctcctacatagtaatggacacaacttatttggattggtacctgcagaagccaggggcagtctccacagctcctagatcttatttgggtttactaagtcgggccgtccggggtccctgtacaggttcagtggcaggtggatcgaggcacgagtatttacactagaaatcaacagagtaggaggtcgtggaggtagttggttacggggttttattacgtggtacgatcgacgaacgtacttaccttaacctaaacccgttacccgtaccgtaaaccggttccggggacgggtaacgggtaaccgtaagggtaggagaacgtaccaaaacggactaggtcggcgtgaccgacgtactacgtcgttacttactaccg

SEQ ID NO: 160278 - DNA, 594 bp, Homo sapiens
  misc_feature: GYAE6OF02GCSBC.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagccctcctacatagtaatggacacaactattggattggtacctgcagaacgccgagggcagtcctccacagcctcctgattcttagttttgggttactaagtccgggcccgttccggggtccctggactaggttcagtggcagtggatcgaggcacgagtatttacactagaaactacaacagaggtggaggctaggaggtagttggtttagggtttattacgtgctagtgactacgcttacctaacctaaccgtcccgtacgtaaccggttcgggacggtaacgggaccgtaagggtggaacgtacgtaaccggaaacggtaacgttgggtacggctacggacccaaccgtagttccgttacgttccttacgttacccg

SEQ ID NO: 160279 - DNA, 726 bp, Homo sapiens
  misc_feature: GYAE6OF02GD7RR.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactcctccctgcccgtcattcctggagacgccggcctccatctcctgcaagtctagtcagacgtcctcctacatagtaatggacaactaacttatttggattggtacctgacaagaacgccgagggcagtcctaccacacgcctctgactcttagtttgggtactaagtccgggtccgtccgggtccctgacgtacggttcgaggtcggactaggtacggactcgaaggaccaacgtagtttaacttttaacgaacgttaaagaaaactcctaaaacgaaggtaagggtacgggaacggtacgttaagggaagggttagtttaggggttttaggggttttaaacttacgtaggtacgtaagttacgtaccgtaaacgtacctttaaccgtaaaaccgttaaacccgttaccccgtaaccggttaaccgggttaccggggaacggggtaaacgggtaaccggtaaaggggtacgggtaacgtaacgtaaaccggtaaaaccggtaacgttaccggtacggtacgtaccgtacctaccgtaacgttccgtacggtttacctacgttaacccg

SEQ ID NO: 160280 - DNA, 653 bp, Homo sapiens
  misc_feature: GYAE6OF02F3F24.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctcccctgcccgtcattccgtggagagcccggcctccatctcctgcaagtctagtcagagcctcctacagtagtaatcggacactaactattggattggtacctgacagaacgccagggcagtctccacacgtctcctgactcttagtttgggttctaagtccgggtaccgtccgggggtccctggacgtacggttcgagtcgggctaggtggactcgaggcaacgtagtatttacacgtagtaaactcgaacaggtagtcgggaggcgtggtaacggtagttagggtttgggttttaactacggttgtacgtagtgaccgagtcctacttaaccctaaccgtacccgtacgtaaccggttacgggaccgggaacggggtaacccgtaagggtacggtaacgtaacgttaaccgaaacggtaaccgttacggtcgggtaccgtacggtacccgtaaccgtacgttacccgtcggtttacccgttacttaccccgg

SEQ ID NO: 160281 - DNA, 801 bp, Homo sapiens
  misc_feature: GYAE6OF02I4OZM.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattcctggagagcccggcctccatctcctgcaagtctagtcagagccctcctacgatagtaatggaacacaacttatttggattggtacctgacagaacgccagggacacgtctccacagcctctgatctagtttggttctaacgtccgggcccttccggggtccctagacgtacggttcgacgtggccgtaggttgggaactcgacggactaaccgtaagttaacgttttaaccaacgttaaacggtaaaaacttaccgaaaaccgaagggtaaacgggttacgggtaagggtacgttacgggaagggtaacgtttagggggtttttacggggggttttaaactttacggttacggttacgtaagttacgggtaaccgtaaaggttacccgttaaccgttaaacccgtaaaacccctttaaccccggttacccgttaaacccggggttaccgggggtaaccgggggtaaacccgggggtaaacccgtaacgggggttaacggggacgttaaaccggtaaaccgggtaaaaacccggttaacggttacggggtaacgggttaccggtaccggtaaccccgtaaccgtaaaccgtttcccgtttaacggttacccgttaccgttaacccc

SEQ ID NO: 160282 - DNA, 720 bp, Homo sapiens
  misc_feature: GYAE6OF02I2N2H.19.83.H06.1.454.CMB.1.raw
  modified_base (99)..(99): a, c, t, g, unknown or other
  misc_feature (99)..(99): n is a, c, g, or t
tcagtactctcgtgcacgaccggtgctcgatttagatcacgtgcgtcgcgggcgtagactttgtgtttctcgtagtctgctttgctcagcgtcagggtnctgctaatgctctgggtctctggatccagtggggatattgtggtgactcagtctccactctccctgcccgtcattcctggagacgcccggcctccatctcctgcaagtctagtcagtacgcccttcctactatagttaatcggaccacctaacttagtttaggatttacggtacctgacaaggacgcccgagggtacagtcctaccacgacgtcctcgtgtacttcgtttagtttcgggttacctaagtcccggggtccccgttcccggggtaccctgtaccgtacggttacgaggtggacgtggtggactcgcggaccagtacgttactttaaccacgttaacaaacgtacgaacgaggaggtacgggaggtcgtaggtaacggttagtttgggtttacgggtttagttacgtacgtagtacgttacgacgtaaccgtaccttaaccgtaacccgtaacccgttacccgttaaccggttaacgggttcccggggaaccgggtaacgggtaaccgtaacggggtacggacgttacgtaaccgtaaacgggttacgacgggtacggaccgttaccgacccgttaccggtacttaccggttcctttaccgttaccgttacccg

SEQ ID NO: 160283 - DNA, 628 bp, Homo sapiens
  misc_feature: GYAE6OF02HC3SQ.19.83.H06.1.454.CMB.1.raw
  modified_base (235)..(235): a, c, t, g, unknown or other
  misc_feature (235)..(235): n is a, c, g, or t
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
  modified_base (367)..(367): a, c, t, g, unknown or other
  misc_feature (367)..(367): n is a, c, g, or t
  modified_base (379)..(379): a, c, t, g, unknown or other
  misc_feature (379)..(379): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatctcctgcaagtctagtcagagcctctacatagtaatgganacaatattgattggtacctgacagaagccgaggcagtctccacagctcctgatctagtttggtactagtcggcctccgggtccctgacngtcagtgnagtgatcgaggcatagtatttacatagaaatcaanagagtaggacgntagaggtagttggtttagggtttattacgtgactagtacgacgtacgtacgttacctaaaccgtaaacccgtcccgttaaaccgttaacccggggtttaccgggaaccggggtaaacgggtaaacccggtaaaggggttacgggaacgtaacgtaaacggtaaaaacccggtaagttacggtaaccgggtacgtaccggtacccgaacccttagttacccggttagtttacccgttaaccttaacccgg

SEQ ID NO: 160284 - DNA, 707 bp, Homo sapiens
  misc_feature: GYAE6OF02IHN3C.19.83.H06.1.454.CMB.1.raw
  modified_base (178)..(178): a, c, t, g, unknown or other
  misc_feature (178)..(178): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctcgtggactccaggtggggattagttggtggtgactcagtcctccactctccctgcccgtnatttccgtggagacgccggccttccgatcctcctggactaagttctaggtcgagcgtccctctacagtagtaaatcggacaactaacttattggatttcggtacctgactagaacgccgagggtcacggtcctaccacgacggtccgtccgtgaacttcgtagttttggggttacctaaggtccgggccgttcccggggtaccttacggacgtggttaccgaggttcggaccgtaggtcggtaactcggaacggtccaactaacggttacttttaaccgacgttaacgaaaacttacgaaacgtacggtaaggtcgggaagtcgttaagggaggttagtttcggggtttaagggtttaacttagtcggacgtagtcgacgaacgtctaccgtaaacaccgttcctaacggttacggttacgggtacggaacgggtaactaaggggtcgtaacgtagttaaccgaaaggtaacgtcggttacggacgttagaccgtaccgttaagtcgttacgttcccgttaactaccgg

SEQ ID NO: 160285 - DNA, 523 bp, Homo sapiens
  misc_feature: GYAE6OF02I1KP5.19.83.H06.1.454.CMB.1.raw
  modified_base (472)..(472): a, c, t, g, unknown or other
  misc_feature (472)..(472): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcgaggcacagtattttacactagaaactcaacagagtggaggctggaggattggtttgggtttattacgtgcatgcaagctactacaactccctacgacggttcgacggaggaccgaaggtagganacgtacgaaacgactggtacgctagacaccgtatcgtacgttcttccgtac

SEQ ID NO: 160286 - DNA, 612 bp, Homo sapiens
  misc_feature: GYAE6OF02I7QMY.19.83.H06.1.454.CMB.1.raw
  modified_base (324)..(324): a, c, t, g, unknown or other
  misc_feature (324)..(324): n is a, c, g, or t
  modified_base (374)..(374): a, c, t, g, unknown or other
  misc_feature (374)..(374): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctaccacagctcctgatctatttggtctaagtcggcctccgggtcctgacnggttcagtggctagtgatcgaggcacagtatttacactagaaatcaaacngaagtgggagtcgtaggaggtagttggttaggggttttaattacgtgtactagtacgactaacgtccttacctaaccgtaaacctaccccgttacgttaaccgggttccgggaaccggggaaacgggtaacccggtaaaggggtacggaacggtaacgtaaccgtaaaaccggtaacgttgggtaacggccgttacggaaccacccgttacgttcgttacgttaccttacttacccgg

SEQ ID NO: 160287 - DNA, 607 bp, Homo sapiens
  misc_feature: GYAE6OF02H5J10.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgacaagtctagtcagacgcctctacatagtaatggacactaactatttggattcggtacctgacaagaacgcgagggcagtctaccacagctacctgattcttagtttgggtactaacgtccgggtacccgtccggggtccctagacgtaggttcaggtggcgaggtggatcgaggcaacagtatttaacactaagaaactcaaacgtagaggtggaggtacgtaggacggtagttcgggtttagggtttaattacgtgactagtagacgaagtctactaaaccgaacctacccgtacgtaacgggttccgggacgggaacggaaccgtaagggtaggagtaacgtaacgtaaacggacgttcggtagtctacgacctacgtacgttcgttacgtaccttacgtaccg

SEQ ID NO: 160288 - DNA, 603 bp, Homo sapiens
  misc_feature: GYAE6OF02HZA1C.19.83.H06.1.454.CMB.1.raw
  modified_base (171)..(171): a, c, t, g, unknown or other
  misc_feature (171)..(171): n is a, c, g, or t
  modified_base (379)..(379): a, c, t, g, unknown or other
  misc_feature (379)..(379): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagagccggcctccatctcctgcaagtctagtcagagcctcctacatagtaatggacacaactatttggattggtacctgcagaagccagggcagtcctccacagctcctgatcttagtttgggttactaagtccgggcctccggggtccctgactaggttcagtggcgagtggatcgaggcaatagtactttacacgtanaaaacttcaacgagtagtaggaggctaggacggtagttcgggtttagggtttaacttacgtggtactagtcgtacaacgtctaacctaaccgtaaacccttcccgtacgtaaccgggttcggtacgggaaacggaaccgtaagggtacggagtaacgtaccgaaacggtaacttggtaccggctaccgacctaaccgtacttccgtaacgttccgtactacccg

SEQ ID NO: 160289 - DNA, 642 bp, Homo sapiens
  misc_feature: GYAE6OF02HE7DH.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatcctcctgcaagtctagtcagacgcctcctacatagtaatggacacaacttatttggattggtacctgacaagaacgccgagggctagtcctccacgacgcctccgtgactcgttagtttcgggttactaacgtccgggccgttccggggtccctgacgtacggttcgaggtcggtctaggtggactcgaggccaatagtactttacgactagtaaactcgaaactaggaggtaggagtcgtaggaggtagttgggttagggtttaacttacgtgtactagtacgtacgtaacgtaccttaacctaaccgtaacccttacccgtacgtaaccggtttaccgggacgggtacggaaccgtaagggacggtacgtacgtaaccggtaaacgtaacgttcgggtacgtcgtacgaccgtactacgttccgttacggttccttaccgtacccg

SEQ ID NO: 160290 - DNA, 654 bp, Homo sapiens
  misc_feature: GYAE6OF02GF03C.19.83.H06.1.454.CMB.1.raw
  modified_base (171)..(171): a, c, t, g, unknown or other
  misc_feature (171)..(171): n is a, c, g, or t
  modified_base (224)..(224): a, c, t, g, unknown or other
  misc_feature (224)..(224): n is a, c, g, or t
  modified_base (478)..(478): a, c, t, g, unknown or other
  misc_feature (478)..(478): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagagccggcctcatctcctgcaagtctagtcagacgcctacctanatagtaatggacacaactattggattggtactgcgagacgccgaggcagtcctccacgtacgctcctgatcgttagtttcggttactaagtccggggcccgttcccggggtccctggaccgtaggttcaggtcggtcgaggtggtaactcgtacggctaacgtaagttacgttttacaacgtaacaaactacgaaacgaggtacgtaggacggtcgtaggtaggtagttaggggtttagggttttaattacgtntacgtagtacgactaacgtccttaacgtaacctaacccgtcccgttaacgtaaccgggtttcgggaacgggaacgggtaaccggtaacgggtacggtacaacgtaccggtaaacgtaacggttcggtaaggaccttcgaccgtacgtaccgttcgttacgttaccttacgtacccg

SEQ ID NO: 160291 - DNA, 611 bp, Homo sapiens
  misc_feature: GYAE6OF02H54R8.19.83.H06.1.454.CMB.1.raw
  modified_base (182)..(182): a, c, t, g, unknown or other
  misc_feature (182)..(182): n is a, c, g, or t
  modified_base (588)..(588): a, c, t, g, unknown or other
  misc_feature (588)..(588): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagnggccggcctccatctcctgacaagtctagtcagagcctctacatagtaatggacactaacttattggattggtacctgacagaagccgagggcagtctccacacgcctctgattcttagtttcgggttctaacgtcgggccgttccgggtccctgacgtacggttcagtggcaggtggactacgaggctaactagtactttacataagaaactacaacgagagtacggaggacgtaggaagtagttgggtttagggttaattacgtgtacgtagtacgactaaacgtctaacctaacgtaaccctacccgtaacgtaaccgggtttccgggaacgggtaacggaaccggtaagggtacggacgtaacgtaacggaaacgtacgtaggtacggacgtacgacacgtnttacgtcgttaccttacgtaccc

SEQ ID NO: 160292 - DNA, 716 bp, Homo sapiens
  misc_feature: GYAE6OF02G7ME9.19.83.H06.1.454.CMB.1.raw
  modified_base (171)..(171): a, c, t, g, unknown or other
  misc_feature (171)..(171): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagacgccggcctccatctcctgctaagtctagtcagagcctcctacatagtaatggacaactaacttagtttggattggtacctgcaaggaacgccgagggtcagtcctaccacacgcctcctagacttcttagtttcgggttactaacgtcgggtccgtcccggggtcctagacgtggttacaggtcggcaggtgactcgaggcacgtagtactttacgactagaaactcaacgaggtagtggacgtcgtaggaacggtagtttagggttttagggtttaactacgttacgtactaaggtcgtaaccgtaaacggtccttaaaccgttaaacccgtaaacccttaccccggttaaacggttaacccggggtttaccggggaacccggggtaaaacggggtaacccggtaaacggggttacggaaacggttaacggtaaccccggtaaaaacggtaccggttaccggggtacggtacccgttacggtaccgtaacccgttacgttccggtttaaccgttcccgttaaccttacccgg

SEQ ID NO: 160293 - DNA, 560 bp, Homo sapiens
  misc_feature: GYAE6OF02F3IYX.19.83.H06.1.454.CMB.1.raw
  modified_base (347)..(347): a, c, t, g, unknown or other
  misc_feature (347)..(347): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctctgatctatttgggtctaagtcgggcctccgggtcctgactggttcagtgcagtgatcgagcanagtatttacactagaaactcaacaggagtaggagtcgtaggaggtagttgggtttaggggtttaattacgtgactagtgactagtcctactaacctaaccgttccctacgtaaccggttcgggaccggaacgggtaaccgaagggtaggacgagtaaccgaaacgtacgttaggtacggacgtagacctacctattccgtcgttctactaccg

SEQ ID NO: 160294 - DNA, 615 bp, Homo sapiens
  misc_feature: GYAE6OF02FXHA3.19.83.H06.1.454.CMB.1.raw
  modified_base (395)..(395): a, c, t, g, unknown or other
  misc_feature (395)..(395): n is a, c, g, or t
  modified_base (444)..(444): a, c, t, g, unknown or other
  misc_feature (444)..(444): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatcctcctgcaagtctagtcagacgccctacctacattagtaatcggacacaacttatttggattggtacctgcagaacgccgagggcagtcaccacacgctcctgattccttagtttcgggttctaagtccgggccgtccggggtccctggactaggttcaggtggctagtaggatcaggcacgagttactttacacttanaaatcaacgagagtggagctgggagtagttgggttagggtttattacgnggtacatcggaactagtccttactaaacctacccgttccctaacgttaccggttacgggaccgggtagggtaaccgagggtagggacgtacgtaaccggtaaacgaccggttggtacggaccttaccggactaacccgtacgttcccgacgttttacctacgttaaccccg

SEQ ID NO: 160295 - DNA, 632 bp, Homo sapiens
  misc_feature: GYAE6OF02JI1SH.19.83.H06.1.454.CMB.1.raw
  modified_base (178)..(178): a, c, t, g, unknown or other
  misc_feature (178)..(178): n is a, c, g, or t
tcagtactctcgtgcacgaccggtgctcgatttagatcacgtgcgtacgcgggcgtagactttgtgtttcttcgtaggtctggcttgctcagcggtcagggtgctgactaatgctctgggtctctggactccagtggggatattgtggtgactcgagtctcctactctcctgcccgtnagttcctggagagccggcctcatcgtcctagccaagtctagtcacgagcctcctacataggtactggaccactacctgtttggacttcggtacctgacgacgaacgtcccgagggactacgtcctaccacgcgtcctccgtgtactcgttagttgggttactaacgtcccggtacccgtccggggttccagtcgtacggttcaggtcggcgtagtcggtatcgacggcacgtagtatttaccgatagaaactcgaacagtagtgggagtcgtaggtacggtgttaggttaggggttttataacgttggtacagttcgacgtacgtactactaactaacccgtccgtacgtaacggtccgggtacgggacggtaaccggtaaggtacggaggtactaaccgtaacggttactagggtcgtccgagttcacctagttcgtacgttacgtcttaccg

SEQ ID NO: 160296 - DNA, 583 bp, Homo sapiens
  misc_feature: GYAE6OF02IKOCM.19.83.H06.1.454.CMB.1.raw
  modified_base (320)..(320): a, c, t, g, unknown or other
  misc_feature (320)..(320): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattgattgacctgcagagccaggcagtctcacagctcctgatctagtttggtctaagtccgggcctccgggtcctgacnggtcagtgcaggtgatcgaggcacgtagtatttacagtagaaatacaacaggagtaggacggcgtagaggtagttggtttagggtttattacgtgacgagtacgacaacgtcctactaaaccgtaaacccttcccgtacgtaaccgggttaccgggtacgggaaacgggtaaccgtaagggtacggagtaacgtaaccgtaaacgaacgtggtacggtacgtacgacctaaccctagttaccgtaggttaccttacgtacccg

SEQ ID NO: 160297 - DNA, 588 bp, Homo sapiens
  misc_feature: GYAE6OF02GERQ2.19.83.H06.1.454.CMB.1.raw
  modified_base (282)..(282): a, c, t, g, unknown or other
  misc_feature (282)..(282): n is a, c, g, or t
  modified_base (392)..(392): a, c, t, g, unknown or other
  misc_feature (392)..(392): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagagccggcctcatctcctgcaagtctagtcagagtccctcctacatagtaatggaacacaactatttggattggtacctgcagacgcgaggcagtctccanacgctcctgatctagtttgggttctaagtccgggcctccggggtcctgacgtacggttcacggtggcaggtcggatcgaggcacagtatttacactagaaactccaaagngtaggtggagtcgtaggacggtagttagggtttggtttaattacgtgctagtgacctagtctacctaacaaccttccctactaaccgggttcggacggtaacgggtacgtaagggtcggaataacgtacgaaaccggtacgttacggtaacggtcctacggaccaccgtattccgtacgttacccgttataacccg

SEQ ID NO: 160298 - DNA, 574 bp, Homo sapiens
  misc_feature: GYAE6OF02GALHJ.19.83.H06.1.454.CMB.1.raw
  modified_base (567)..(567): a, c, t, g, unknown or other
  misc_feature (567)..(567): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaacgccagggcagtctccacagctcctgatctagtttggtctaagtcgggcctccggggtcctgacaggttcagtggcaggtgatcaggcacagtattttacactagaaaactcaaacagaggtcggaggtctagacgggtattggttaggggtttattaacgtgacgtagtgtacgaagtccttacgtaaccaaaccgttccctacgtaaccggttcgggacggtagggaacctaagggtggatacgtaccgaaacggtaacgttcggtacggtcgtagtaccacgtacttcgttcgttaccgttntaacccg

SEQ ID NO: 160299 - DNA, 740 bp, Homo sapiens
  misc_feature: GYAE6OF02JBQH7.19.83.H06.1.454.CMB.1.raw
  modified_base (176)..(176): a, c, t, g, unknown or other
  misc_feature (176)..(176): n is a, c, g, or t
  modified_base (217)..(217): a, c, t, g, unknown or other
  misc_feature (217)..(217): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccgaggtggggatagttggtggtgactcagtctccactctccctgcccgtcnttcctggagcgccgcctcatctcctgacagtctagtcagcncctacctacattagtatacggacctactaacttagttaggtagttcgtacctgtacgagaacgccgaggctacgtactccacacgtcctccgtagtacttacgttaggtttacgggtttacgttaacggtcccgggtcccggttcccggggttcccgtacggtaccgtacggttcgtaacggtcggtacgtaggtacggtacgtcggaaaaacggcgtaacgtacgttaactttaccgtaacgtaaacggtaaacctaacgtaaacgtaaggtaaggtacgggtaacgggtacgtaaggtagggttaggtttaagggttttagggtttaacgttacgttcgtacgtaagtcgtacgtacgtactaacctaaccgtaaccgtacccgtaaccggttaaccggttaccgggtaccgggaacgggtaacggtacgggtaacggtacgtaacggtaaccgtaaacggtaccggttacggtacggtacgtaccggacctacgtacgttctacgttaccgttcgtaccc

SEQ ID NO: 160300 - DNA, 627 bp, Homo sapiens
  misc_feature: GYAE6OF02G2Z9L.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgcccggcctccatctcctgcaagtctagtcagacgcctcctacatagtaatgacacaacttatttggattcggtacctgacagaacgcgagggcagtctccacacgcctcctgattcgttagtttgggttactacgtccggggtcccgttccggggtccctggacgtacggttcgaggtggacgaggtggatcgaggctaacgtagttatttacacgtaagtaaactcgaaacgtagtaggtagggacggtagtagggtagtaggtttggtttagggttttacttacgtgactagtagactaagtcctaacgtaaccctaaccgtcccgttacgtaaccggtcgggaccgggtaacggaaccgtaagggacggtaacgtacgaaccggtaaacgtaccggtggaccggtctacgactacctacgttcgtacgttctactacccg

SEQ ID NO: 160301 - DNA, 767 bp, Homo sapiens
  misc_feature: GYAE6OF02F5GU7.19.83.H06.1.454.CMB.1.raw
  modified_base (175)..(175): a, c, t, g, unknown or other
  misc_feature (175)..(175): n is a, c, g, or t
  modified_base (731)..(731): a, c, t, g, unknown or other
  misc_feature (731)..(731): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctcgtgggtctctggatccaggtagggatattgtggtgactcagtctccactcctcccgtgcccgtntacttccgtggagacggcccggtccctccatcctccgtgacgtaagtctaagtcacgtacgcccttacctaactagttaaggtaatacggaaccaactaacgttagtttggaatttcggtacctgacgaagacgccgagggcacgtccaccacacgtccttaccgtagtcttacctttaggttttacgggttacctaacgggttcccggggtcccccggtttacccggggttccctaggaacgttcgggtttacgagggttcggcgtaggtcgggtactacggaacgggcctaactacgtttaacgtttaaccaacgttaagaaaacttaccgaaaggacggtacgggttagggacggtagtacgggtaagggtttagtttaggggttttagggtttaacttaacgggcgttactaggttaacgaccgtaacggtccttaaacccgttaaccgaacccttcccggttaacgtaacccggggtcggggtaacggacggttaacgaggggtacgaagtaccgtaaaccgtaacggtggtacgggtactcggttaaccnccggtacttacgttaccggtcgtttaccgtactccg

SEQ ID NO: 160302 - DNA, 635 bp, Homo sapiens
  misc_feature: GYAE6OF02GFA8N.19.83.H06.1.454.CMB.1.raw
  modified_base (391)..(391): a, c, t, g, unknown or other
  misc_feature (391)..(391): n is a, c, g, or t
  modified_base (431)..(431): a, c, t, g, unknown or other
  misc_feature (431)..(431): n is a, c, g, or t
  modified_base (488)..(488): a, c, t, g, unknown or other
  misc_feature (488)..(488): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagaatggacacaactatttggattggtacctgcagaagccagggcagtctccacagcctccgtgactcttatttgggtttacctaacgttcccggggcccgttcccggggttcccctaggaccgtaggtttcgaggttgggacctaggtacgggtaatcgaacggnaaccgagttaattttaacgaactaagtaaaatcaaaccgngtaaggtggagggactaggagggtagttacggttttaggggtttactttacgtacgntagtagtacgaagtccgttaacctaacctaaacccttccctaacggtaaccggttaccgggacggtacgggaaccgtaaggtaggacgaatacgaaacggtccgtaggtagcgtagacctacctgtacttccgttcttacgtacccg

SEQ ID NO: 160303 - DNA, 696 bp, Homo sapiens
  misc_feature: GYAE6OF02FLAE4.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatcctctgcaagtctagtcagacgccctcctacatagtaatcggacacaacttattggattcggtacctgcagaacgccgagggcagtctccacagctcctgtattttagtttgggttactaacgtccgggccgttccgggtccctgacgtaggttcagtggcgaggtggatcgaggcacgtaatacttttaacactaagaaactacgaaacgaggtacggtgggagtcgtagggaaggtagtttagggtttaggggttttaacttacggtagtaccgtagttacgtacgtaacgtccttaacgtaaaccctaaacccgttccccgttaacggttaacccgggtttacggggtaacggggtaaccgggtaaaccggtaaggggtacgggtaaccgtaacgttaaaccgaaaacggtaacggttagggttaccgggaccgttacggaccctaacccggtacgtttaccgttacggtttacctttaccgtaccctttacccccgg

SEQ ID NO: 160304 - DNA, 767 bp, Homo sapiens
  misc_feature: GYAE6OF02G2FM7.19.83.H06.1.454.CMB.1.raw
  modified_base (442)..(442): a, c, t, g, unknown or other
  misc_feature (442)..(442): n is a, c, g, or t
  modified_base (572)..(572): a, c, t, g, unknown or other
  misc_feature (572)..(572): n is a, c, g, or t
  modified_base (577)..(577): a, c, t, g, unknown or other
  misc_feature (577)..(577): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctcgtgggtctcgtggatccgaggtggggatattggtggtgactcagtctccactcctccctcgcccgtctattccgtggaagcggcccggccctccactccgtcctagacaagtctagcaggacctccctacctaagtattaagtaagtacggaaccaactaaactttagtttggaacgtttcgggtaaccctggacgaacggaacgccgtaacggggctacggtcctacccaagcgtcctccgtagtacttcttaacggttttggggttaacttaaccggtccggggcccccggttcccggggtaccctagaaccgtggtttacaggtcggntagggttcgaatcgacggcaacgtaagtttactttaaaccgataaagaaaacctacgaaagtaggtaggtacgggacggtggtaccccggaaggttagttcgggtttagggtttaacttcggtataccgnggtanacggtaacgcttaaccgaaaccttacccgtacccgaacggtaccgggttcggggaaccgggaaacgggtaaaccgtaagggggtacgtaacgtaacgttaaacccggaaaaacggtccgttaggggaccgtccggtaacctacccggaacccttagttacccggtttacggttaccttaccctaacccgg

SEQ ID NO: 160305 - DNA, 593 bp, Homo sapiens
  misc_feature: GYAE6OF02GZYL9.19.83.H06.1.454.CMB.1.raw
  modified_base (572)..(572): a, c, t, g, unknown or other
  misc_feature (572)..(572): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggaacacaactatttggattggtacctgcagaagccagggcagtctccacagctcctgattctagttttgggttactaagtccggggccgtccggggtccctggactaggttcgagtggcaggtggatcgaggcacgagttatttacactaagaaatcgaacaggaagtgggagtcgtaggacggtatttagggttgggtttattacgtgctagtcgactagcttaacgtaacctaaccgttcccgttagaaccgggtttccgggaccgggtaacggaaccgttaggggtacgaacggtactaaccgaaaccgtaacggtggtcggactacgactaaccgngttccttagttctaccgtacc

SEQ ID NO: 160306 - DNA, 769 bp, Homo sapiens
  misc_feature: GYAE6OF02H7WCK.19.83.H06.1.454.CMB.1.raw
  modified_base (173)..(173): a, c, t, g, unknown or other
  misc_feature (173)..(173): n is a, c, g, or t
  modified_base (179)..(179): a, c, t, g, unknown or other
  misc_feature (179)..(179): n is a, c, g, or t
  modified_base (219)..(219): a, c, t, g, unknown or other
  misc_feature (219)..(219): n is a, c, g, or t
  modified_base (245)..(245): a, c, t, g, unknown or other
  misc_feature (245)..(245): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtgggatattgtggtgactcagtcctccactcctccctgcccgtnattccnggagacgccggcctccatctcctgcaagtctagtcagacncctctacatagtatggacacaacttnttaggtattcggtacctgacgaagaacgccgagggacacggtcctaccacagccttccgtagacttcttacgttttacgggttaccttaacggtccggggtcccggttacccggggtccctacggaccgtaggttcgacgggtcggacgaggtggactcgaacgggtcaactaaggttactttacgaacgttaacgtaaaagtaccaaacggtacgggtaagggttacgggaacgggtacggtagggtaacgggtaacggttttagggggtttttaacggggtttaacgttaccggttaggtacgtaaggttacggtacgtaaacggtacctttaaccgtaaacccgtaaacccttacccgttaaccggtaaccgggttaccgggaccggggtaaaggtaacccgggtaagggttaccgggaacgtaacggttaaaccgaaacgggtaaccgttacgggtacgggttactaccggtaccctaacggttcccgtttaacggtttccttacccgttaccgtacccg

SEQ ID NO: 160307 - DNA, 843 bp, Homo sapiens
  misc_feature: GYAE6OF02IFOKP.19.83.H06.1.454.CMB.1.raw
  modified_base (364)..(364): a, c, t, g, unknown or other
  misc_feature (364)..(364): n is a, c, g, or t
  modified_base (490)..(490): a, c, t, g, unknown or other
  misc_feature (490)..(490): n is a, c, g, or t
tcagtactctcgtgcacgaccggtgctcgatttagatcacgtgcgttcgcgggcgtagactttgtgtttctcgtagtctgctttgctcagcgtcagggtgctgctaatgctctgggtctctggatccagtggggatattgtggtgatcagtctccactctccctgcccgtcactttcccgtagggacgacggcccggtacctcctaatccgttccgtcgtcaaacgttctaacggtcaacgggactcccttacctaactataagtaacgtacggaactactaaacgttaagtttcggtaatttcgggttaacctcggacaacggaaccgtaccggaggggtacaggttaccctccaacggtacnccgttacctagtattacgtttacgttttcgggttactaaccggtccggggtccccgttccggggtccccgtaggacttacggggtaaccgtgggttaacggtcgtaacggtacggtacgttaaccncggggtaacaacttaacggtttaactttttaacccacgttaaaagtaaacctaacggtaaacctaagggtaaacgggtaacgggtcgtaccgttaaggggtagggttaaaccggttttggggtttttaaccggttttaaaggtaccttttacgacccgttaagtttacgaaccgtaacggttacctaaccgtaaaccgttaacccgttacccgtaaaccgttaaccggggtacgggtaacccgggtaaaccgggaacggtaacggtacgttaacgaccgtaaacggaacggttaccgtgggtaccgacggttaccacgtactaaccggttcttaccttaccgtccttaacccg

SEQ ID NO: 160308 - DNA, 796 bp, Homo sapiens
  misc_feature: GYAE6OF02HGETX.19.83.H06.1.454.CMB.1.raw
  modified_base (280)..(280): a, c, t, g, unknown or other
  misc_feature (280)..(280): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagacgcctacctacatagtaatggacactaacttatttggattcggtacctgagagaaccgcggacggntacgtcctaccacgacgtcctacgtagtacttacgttttaggtttcggttactaccgggtcccgggtcccgggttccccgggttcctacggtacggtacgttacggacgggtcgtacggtaggttaggacgtacggacggtaactaacgttacgttttaactttaaccgaacggttaaacgtaaactaccgaaacggtaagggttacggggaagggtaccggttggtaaacgggtaagggtttacgggttttagggggttttttaagggtttaaaccttacgggtacgttaacttacgggttaaacgtacccgtaacgtttaccccttaaaccggtaaaaccccctttccggttaaccccgtaacgggttacccggggtacggggtaaccggggtaaaccgaacgggttagggaaccgtacgttaaaccggtaacccggaacggttaaggtccggtacggaccgtacgtaaccccggtaattccgttaaccggtttcttaaccgtccgtttacccg

SEQ ID NO: 160309 - DNA, 797 bp, Homo sapiens
  misc_feature: GYAE6OF02HVWV5.19.83.H06.1.454.CMB.1.raw
  modified_base (244)..(244): a, c, t, g, unknown or other
  misc_feature (244)..(244): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactcctccctgcccgtcattcctggagagccggcctccatctcctgcaagttctagtcagacgcctctacatagtatggacacaactntttggattggtacctgcagaacgccgagggctagtcctccacacgctccgtgtacttcttagtttgggttactaacgttccggggtccttcccggggtaccctaggtacgacgggtttacaggtgggtaccaaggttcggaagtccgtagggacctaacgtacgttaacttttaaccgaacgtttaagaaaaacttcaaacggtaacggtacggtagggtaacgggtacggttagggtaacgggttaaggtttgggttttacgggggtttaaactttacggttacggtacgtaacggttacggtaaccgtaacgtacccgtttaaccgtaaacccgtaaaaccccgttacccccgttaaaccgtaacccgggggtttaacccggggtaaccgggggtaaccggggaaacccgttaaacgggggttaacgggaaccggtaacggtaaaccggtaaaacccgggtaaaccggttccgggttacgggaacccgttaccgggacccttaacccggtaccgtttaaccgttttaccggttccttttaaccccgtaccg

SEQ ID NO: 160310 - DNA, 625 bp, Homo sapiens
  misc_feature: GYAE6OF02FIWP0.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattcctggagacggcccggcctccatcctcctgacaagtctagtcagacgccctcctacattagtaatcggaacaacctaacttatttggtattggtacctgcagaacgccgagggcagtctccacgagctcctgatctagttttgggttactaagtcgggcccgtccggggtccctgacgtaggttcgaggtggctaggtggatcgaggcaacgtagtacttttacactagaaactacaacaggtaggtaggagggtctaggaggtagttgggtttaggggtttacttacgtgtacgtagtcgacaacgtccttaactaacctaaacccttcccgtacgtaaccggttaccggggaccggtaacgggtaaccgaaggggttacggagtaacgtaaccgaaacgtacgttcggtggtactcgaccaccgtattccgtcgttaccttcttaccg

SEQ ID NO: 160311 - DNA, 783 bp, Homo sapiens
  misc_feature: GYAE6OF02H1U4J.19.83.H06.1.454.CMB.1.raw
  modified_base (290)..(290): a, c, t, g, unknown or other
  misc_feature (290)..(290): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatagttgtggtgactcagtctccactctccctgcccgtcattcctggagacgccggcctccatctcctgcaagtctagtcagacgcctcctacatagtaatggaacactaacttagtttggattcggtacctgacagaacgccgagggcacgttccnccacacgccttccgtagtacttactttaggtttcgggtttactaacggttcccggggcccgttcccggggtccctaggtaccgttacggttacgtaggtcggtacgtaacggttggacgttacgacgggtacctaacgtaacgtttaactttttaaccgaacgtttaaacgtaaaaacttaccgaaacgtaagggtacgggtacgggtaacgggtacgttaggggaaacgggttacggttttacggggttttacggggttttaaactttaccggttacggtacgttaacgtacggtaaccgtaaacgttccgttaaaccctaaaccgtaaccccgtttacccgttaaccgggtaaccgggtttaccggggaaccgggtaaacggggaacccgttaaggggtacgacgttaacgtaacggtaaacggtaccggttagggtccgtacgtcggacctaccgtacgttaccgttacgtttaccgttaccgttacccg

SEQ ID NO: 160312 - DNA, 595 bp, Homo sapiens
  misc_feature: GYAE6OF02FTXVQ.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggttctaatcgggcctcgggtccctgacaggttcagtgcagtggatcgaggcacagtatttacactagaaatcaacagagtggaggctgaggtagtggttggggtttattacgtgctagtgacaagtctacctaacaaaccttccctacgtaaccggtttccgggacgggtaacgggtaacccgtaaagggtcgggtaacggaacgttaaccgaaaaccggttaaccgttagggtacgggtaccgttaggaccctaacccggtattacccgttacggtttacccttacgttaaccccgg

SEQ ID NO: 160313 - DNA, 686 bp, Homo sapiens
  misc_feature: GYAE6OF02IISU0.19.83.H06.1.454.CMB.1.raw
  modified_base (173)..(173): a, c, t, g, unknown or other
  misc_feature (173)..(173): n is a, c, g, or t
  modified_base (297)..(297): a, c, t, g, unknown or other
  misc_feature (297)..(297): n is a, c, g, or t
  modified_base (640)..(640): a, c, t, g, unknown or other
  misc_feature (640)..(640): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggactcaggtggggatattgtggtgactcagtctccactcctccctgcccgtntattccgtggagacgccggcctcactctcctgctaagtctagtcagctcctcctacatagtaactggacctaataactgtttcggattcggtacctgacaggtaacgccgaggcagtctaccancgtcctccgtgacttcgttagttttggtcttaacgtcccggggtccgttcccggggttcctagtacgtacggttacgtcggtagggctagggtgacgtcgaacgctaaacgcgtttaacttacgaagttaacaaactacctaacggaagtaggtacggacggtcgtacggtaaggttacggttgggtttacgggtttagttacgtacgcgtagtacgtacaaccgttcgtaaccctaacgtaaacccgttacccgtaacgtacccgggttaccgggaaccggtaacgggacggtaagggtacgggactaagtaccggaaaacggtccgttaggaccgggttanaccggtaccgtaacgttcttaccggttagttcccttagttaccccg

SEQ ID NO: 160314 - DNA, 620 bp, Homo sapiens
  misc_feature: GYAE6OF02I270P.19.83.H06.1.454.CMB.1.raw
  modified_base (294)..(294): a, c, t, g, unknown or other
  misc_feature (294)..(294): n is a, c, g, or t
  modified_base (376)..(376): a, c, t, g, unknown or other
  misc_feature (376)..(376): n is a, c, g, or t
  modified_base (560)..(560): a, c, t, g, unknown or other
  misc_feature (560)..(560): n is a, c, g, or t
  modified_base (589)..(589): a, c, t, g, unknown or other
  misc_feature (589)..(589): n is a, c, g, or t
  modified_base (604)..(604): a, c, t, g, unknown or other
  misc_feature (604)..(604): n is a, c, g, or t
  modified_base (614)..(614): a, c, t, g, unknown or other
  misc_feature (614)..(614): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtctattcctggagcgccggcctccatctcctgcaagtctagtcagacgcctcctacatagtaatggaacacaacttagtttggaattcggtacctgacaagaacgccgagggcaggtccaccacncgtcctccgtgtaactccttaggttttcggtacctaagtcccggggtcctccggggtccctgaacgtggttcaggtcggtanaggtggactcgacggacatagtactttacgacgtaagtaactacaacgtaggaacggtggcgtactaggtaggtacgttgggtttaggtttaacttacgtagtacgtaatacgggtacacggtacttaccgtaaaccgtaaccttccgtacgtacggttcgggacggtaggaccgaggttacgngtaacacgaaggtacctaggtcgtcgtanacccgatacgttacncgtttaccgnttaccg

SEQ ID NO: 160315 - DNA, 568 bp, Homo sapiens
  misc_feature: GYAE6OF02GADSI.19.83.H06.1.454.CMB.1.raw
  modified_base (382)..(382): a, c, t, g, unknown or other
  misc_feature (382)..(382): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggaccacaactatttggattggtacctgcagaagccagggcagtctccacagctcctgatctatttgggtctagtcgggcctccggggtcctgacaggttcagtggcaggtggatcgaggcacgagtattttaacactaagaaatacaaanagaggtggaggctgaggtagttgggttgggtttattacgtgtcgtagtgactaacgacttacctaactaaccctcccgtacgtaaccggttaccggacgggacggaaccgaggtggagacgtacgaaacggtaacgtggtacggacgtacggaccaccgtactcgttacgttaccttacgtacccg

SEQ ID NO: 160316 - DNA, 721 bp, Homo sapiens
  misc_feature: GYAE6OF02I7N65.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctcgtggatccagtgggatattgtggtgactcagtctccactcctccctgcccgtctattccgtggagacggcccggcctccatcctccgtgacaacgttctacgtcagacgtccctacctaacattacgtaacgtcggaacctaccgtaactttagttggtacgttacggtacctgaccgtaagaacgccgagggcacgttacctaccacgcgtcctccgtagacttacgtttacgttttcgggtacttaacggtcccggggtcccgttccggggtccctacggtacgtacggttcacgggtcggcgtacggtgaacgtcgagtaccatacggttacttaaccacgtaactaaacgtacgtaaagtacggaagtgggtaacgcggtaggaggttagtttagggtttacgggtttaatacggtgtacgtatcgtaccaagtaccttaacgtaacccaacccgttcccgttaacgggtaccggttaccggggtaacgtaaccgggaacgtaagggtaccgaagtaacccgtaacggtaaccggtaggttcgtacggtaccgtaccgacccgttacgtacgttaccggtttacgtccctagttcccg

SEQ ID NO: 160317 - DNA, 1012 bp, Homo sapiens
  misc_feature: GYAE6OF02GNUX2.19.83.H06.1.454.CMB.1.raw
tcagtactctcgtgcacgaccggtgctcgatttagatcacgtgcgtcgcgggcgtagactttgtgtttctcatagtctgctttgctcagcgtcagggtgctgctaatgctctgggtctctggatccagtggggatattgtggtgactcagtctccactcctccctgcccgtcattcctggagacgcccggccctccactcctcctggcctaacggtcctagtccagacgtccctcctacatagtaaactggaccaacaacttatttggactttcgggtacctggactaggaagtccgaggggccagtcctcccaacacgcctccgtgtacttcttaagttttcggggtttacctaaacggttcccggggacccgtttccccggggggttccccttacggtaaccgtacggtttaccggtaacggttcggggtaccctaacgggtttcggaacgtttaacccggaaccggggtacccgtaacccggtaaacggtttaaaccgtttttttaaacccgaaacgttaaacgggtaaaaaaccgtttaccgaaaaacccgtaagggaaacgggtttaacgggggtaacgggttccgtaacggggtaagggggttaacgttttacgggggttttaacgggggttttttaaactttaccggtttaccggtaccggttaaacgtttaccgggaaaccgtaaaccgggtttaccctttaaacccggttaaaaaccccttaaaacccccgttttaacccccggtttaacccgtttaaaaaccccgggggtttaccgggggtaaacccggggggtaaaccggggttaaaaccccgggggtttaaacgggggttaccggggttaaacccgggtaaacgggttttaaaaccccggaaaaacccggggtttaaacccggtttaccgggggttaacccgggttttacccggttaacccgggtaccccttaaaaccccgttacccggttttaacccgtttaccggttttaaccccgtttaacccccgg

SEQ ID NO: 160318 - DNA, 569 bp, Homo sapiens
  misc_feature: GYAE6OF02F37W7.19.83.H06.1.454.CMB.1.raw
  modified_base (336)..(336): a, c, t, g, unknown or other
  misc_feature (336)..(336): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatctcctgcaattctagtcagagccctcctacatagtaatggacacaactatttggattggtacctgcagaagccgagggcagtctccacagctcctgactcttagtttgggttctaagtccgggccttccggggtcctgacnggttcagtgcagtggatcaggcacagtatttacactagaaatcaacagagtggagcgtgaggtagttggtttggggtttattacgtgtactatgacaagtcttactaacctaaccttccctacgtaaccggttcgggacgggtaacggaccgaagggtaggagtaagtaaccgaaacgtaacgttaggtacggtcgtacggcctaccgtacgttacctcgttacttcctaccg

SEQ ID NO: 160319 - DNA, 703 bp, Homo sapiens
  misc_feature: GYAE6OF02HX9J2.19.83.H06.1.454.CMB.1.raw
  modified_base (394)..(394): a, c, t, g, unknown or other
  misc_feature (394)..(394): n is a, c, g, or t
tcagtactctcgtgcacgaccggtgctcgatttagatcacgtgcgtcggcgggcgtagactttgtgtttctcgtagtctgctttgctcagcgtcagggtgctgctaatgctctgggtctctggatccagtggggatattggtggtgactcagtctccactctccctgcccgtcattcctggacgagcccggcctccatcctcctgacaagtctagtcaggacgcctacctacaatacgtaatcggacactaacttattggattacgtacctggacagaagccgaggacagtcctaccacgagtcctcgtagtacttacgtttagtttcgggttacctaacgtccggggtcccgttcccggggtaccctaggtacgtacggtttcgaggtacggntagggtcgtaatcgacggacacgtaagttactttacgacgtaagaaatcgaaacgtaggacgtgggtacggtactgggaaggtaggtttagggttttagggtttaacttacggttacgtaactagtacggtactaacggttcctaactaacccgtaaaccgttcccgtaaccggttaaccggggttcgggtaaccgggtaaacggggtaaccgtaaggggtacggtaacgtacgtaaccggtaaacgtaccggttggacggttaccgtacgtaccgtacctacgttaccggtacgttcgtacctacccg

SEQ ID NO: 160320 - DNA, 634 bp, Homo sapiens
  misc_feature: GYAE6OF02HITLM.19.83.H06.1.454.CMB.1.raw
  modified_base (174)..(174): a, c, t, g, unknown or other
  misc_feature (174)..(174): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (604)..(604): a, c, t, g, unknown or other
  misc_feature (604)..(604): n is a, c, g, or t
tcagtactctcgtgcacgaccggtgctcgatttagatcacgtgcgtcgcggggcgtagactttgtgtttctccgtagtctgctttgctcagcgtcagggtgctgctaatgctctgggtctctggatccagtggggatattggtggtgactcagtctccactctccctgcccgtnattcctggagagcccggcctccatcctcctgcaagtctagtcagacgcctcctacatagtaatggacacaacttatttggattggtacctgacagaacgccagggcagtcctcacngcctccngactcttagtttggtctagtccggccgtccgggtcctgactaggtcaggtggctagtggatcgaggtcaagtagttatttaccaagtaagtaaactacgaacgaggtaggttaggagggtacgtagggaaggttacggtttagggttttaggggttttaacttaacggtcgtacttagttacgaacgtaacgttccgttaacctaaaccctaaccgttaccccgttaaccggttacgggttaccgggaacgggtaaccgggaacgtaagggtagagtacgtaacgaaacggtacgtcggtcggtacncgaccacctagttcgtcgttacttctaccg

SEQ ID NO: 160321 - DNA, 888 bp, Homo sapiens
  misc_feature: GYAE6OF02HE13V.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactcctccctcgcccgtctacttccgtggagacggcccggccctccatcctcctgacaagttctacgtcagacgtccctacctaactattaagtaagtcggaacaactaactttagtttaggtagtttacggtacctaggacaacggaacggaccgacggggtactacggtccctaccaacgacgtccttaccgtagtacgttacgtttacgttttacgggttacttaacggtcccgggggttcccggttaccccgggggttaccctacggtaaccggttacgggtttccgaggggttacgggacggtaacggtacgggtacgtacggacggactaacgttaaacgttaacttttaaccgaacgttaaacgtaaaactaccgtaaagtaacggtaagggtacgggtaacggtacgtagggtaagggtttaacggttttcggggttttaaacggggttttaacttaccggttacggttaaccgttaaggttaccggtaaccttaacgggtaaccctttaaccgttaaacccgttaacccgtaccccgttaaccggttaaccgggttacccgggggaacggggtaaaccggtaaacgggttaacggggtaggtaacggtaaacgtaaccggtaaaacccggttacggttaccgggtaacgggttacccgtaacccggtacccgtaaccgtaccggtttaaccggtttaccgtttaccgttaccctttaacccgg

SEQ ID NO: 160322 - DNA, 600 bp, Homo sapiens
  misc_feature: GYAE6OF02JF5BN.19.83.H06.1.454.CMB.1.raw
  modified_base (346)..(346): a, c, t, g, unknown or other
  misc_feature (346)..(346): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgccccgtcattcctggagagccggcctccatctcctgcaagtctagtcagagcctcctacatagtaatggacacaactatttggattggtacctgcagaagccagggcagtctccacagcctcctgtactctatttgggttctaagtccgggcctccggggtccctgactaggtcgagtgcngtggatcaggcacgagtacttttacactagaaaacgtcaacgacgtaagtgggtaacggtctaggaggtaagttggtttaggggtttaattacgtggtacgtagtcgacaagtctaccgttaaccaacccgttcccgtacctaacgggtttccggccgggtaacgggaaccgttaagggtggaggacgtaccgtaaaacgtaacgtcgtggtccgtagtaccgaccgtattaccgttagtcctttacgtaaccg

SEQ ID NO: 160323 - DNA, 791 bp, Homo sapiens
  misc_feature: GYAE6OF02GS9T0.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattccgtggagagcccggcctccattcctccgtcgctaagtcgtagtcaggacgcccctacctacagttaagtaaactcgggaacctaactaaactttagttttaggtactttcgggttaaccctggacaaggtaaccgcccggtaggggacctaggtccctaccgaacgacggtcctacctggtacttcgttaggttttcgggttcttaacgtccgggggtcccgttacccggggtccctaggacgttacggttcgacgggttcggactagggtacggacttacggaacggtccgtaagtaacgttacgttttaacaccgtttaaagtaaaacgttcgaaaacgtagggtaacggtggggacggtacggttgggtaaggtaggttttcggggttttaagggtttacttacgtacgtgttaacgtacgtacgtaacgttacccttaccgtaaacccttaaccgttacccgtaacgttacgggttacccggggaagggaccgggtaaaccgggtgggtaaggtacgtaaccgtaccgggaaaaccgttcggttacggttccggaaccgtacgggtaaccccgtaacgttaccgttacgttccggttacttaccgttacccg

SEQ ID NO: 160324 - DNA, 650 bp, Homo sapiens
  misc_feature: GYAE6OF02GNPMF.19.83.H06.1.454.CMB.1.raw
  modified_base (419)..(419): a, c, t, g, unknown or other
  misc_feature (419)..(419): n is a, c, g, or t
  modified_base (630)..(630): a, c, t, g, unknown or other
  misc_feature (630)..(630): n is a, c, g, or t
  modified_base (637)..(637): a, c, t, g, unknown or other
  misc_feature (637)..(637): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctcactctcctgcccgtcattcctggagcggccggccctccatcctcctgactaagtctagtcagacgcctacctacataagtaatggacacaacttattggattggtacctgacagacgccgagggtcacgtctaccacgaggtctccgtagtacttacttgtttcgggttactaacggttcccggggtccggtccccggggttaccctcgtacgtaggttcgaggtgcgtaggagtacgcgaggacaacgtagttaccgtttaanaacctaagtaaacctacaaagtacggtaaggtcgggaaggtcgtaaggacggttaggttacgggtttagggttttacttaacgtctagtacgtagctaacgtacgtaccgttaaacctacccgttaccgtaacggttaccggtacgggacgggtaacggacgggtacgagtacgaactacggaacggtatggtacggtcgacgtacacctnttaccgngttacctataccc

SEQ ID NO: 160325 - DNA, 697 bp, Homo sapiens
  misc_feature: GYAE6OF02IXR5C.19.83.H06.1.454.CMB.1.raw
  modified_base (562)..(562): a, c, t, g, unknown or other
  misc_feature (562)..(562): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattggtggtgacttcgagtcctccactcctccctgccccgtacacgttcccgtaggaagcggcccgcccttaccattcctaccgtcgactaagtctagtcagacgcctcctacgattagtaagcggaacacctaacttagttcggaacgttcggtacctaggacaagtaacggcccgagggcctaggtcctacccaagtcgcctccctagtagtttaccgtttaagtttcgggtacttaacggtcccgggtccgttccccggggtaccctagtccgtaacgttggaggcgggtactgggtacgtacgcgaacggctaacgtaacgttaacttacgaataacgaaacgtcgaaacggttagaacggttcgggacgtacgtaggaaggtacgtttggggtttagttacgtcgtgacttaagccgtaanaccgttcttacgtaaaccctaccgtccgtaaggttaacccggtgggaaagtacgggacgagggttacgactaacgtaccgaaaggtctgggtctacgacgtacctaccgtagttcccttaggtaccttcgacccg

SEQ ID NO: 160326 - DNA, 798 bp, Homo sapiens
  misc_feature: GYAE6OF02G3DLC.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggactccattctcctgactaagtctagtcagacgccctcctacataagtaatcggacacaacttagtttaggattggtacctgcaagaacgccgagggcagtctaccacacgtcctcctgacttcgtttagttttcgggttactaaacggttcccggggtacccgttccccgggggtacccctaggtaacgtacgggtttcgtaagggttcggggaccgtaggtagggtaacttaccggaagggacctaacgtaacggtttaacgtttttaacccgaaacgtttaaacggtaaaaacgttaaccaaaaccggtaagggtaaacgggtacggggtaaacgggttaccgttaaggggtaacggtttaagggttttagggggttttaacggggtttttaaacgtttaaccgttaggtaaccttaaggttacggtaaccgtaaacgggtacccttaacccgttaaaaccgttaaacccgttaacccgttaaccggttaaaccggggttcccggggtaacgggtaaaccgggtaacgtaacggtaggtaacttacgtaacgtaggtaaccgtacgtaggtcgtacgtacgacctaacgtcgtacttgttacttaccg

SEQ ID NO: 160327 - DNA, 601 bp, Homo sapiens
  misc_feature: GYAE6OF02IZG08.19.83.H06.1.454.CMB.1.raw
  modified_base (144)..(144): a, c, t, g, unknown or other
  misc_feature (144)..(144): n is a, c, g, or t
  modified_base (148)..(148): a, c, t, g, unknown or other
  misc_feature (148)..(148): n is a, c, g, or t
  modified_base (171)..(171): a, c, t, g, unknown or other
  misc_feature (171)..(171): n is a, c, g, or t
  modified_base (247)..(247): a, c, t, g, unknown or other
  misc_feature (247)..(247): n is a, c, g, or t
  modified_base (272)..(272): a, c, t, g, unknown or other
  misc_feature (272)..(272): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtgggatattgtggtnactnagtctccactctccctgcccgtnattcctggagcgccggcctcatctcctagcaagtctagtcaagcgtcctcctaacattagaatggaccacaacttntttggattcggtaacctgacagaanccagggcagtctccacacgtcctcgtagtacttcgtaagtttgggtacttaacgtccgggaccgttccgggtccctggactggttacagaggtcaggtacgatcgagcaagtacgtatttaaccataagaaagtacaacgtaggaggtacggaagcgtaggtaacgtgttagggtttaggttattacgtgtacatacgatacggactacgtaacaacctcctacgtaacgttccgggacggacggaccgaagggtagacgactaaccggtaaacgtacgtagtggaccgtttacggactaccgtacgtacgttacctcgttacctaccg

SEQ ID NO: 160328 - DNA, 733 bp, Homo sapiens
  misc_feature: GYAE6OF02HAIVN.19.83.H06.1.454.CMB.1.raw
  modified_base (258)..(258): a, c, t, g, unknown or other
  misc_feature (258)..(258): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactcctccctcgcccgtcacttccgtggacgagccggccttaccactctcctgccaagtctagtcagacgcctacctacatagtaagtggaacaacaacttntttaggtattcggtacctggacaaggtaacgccgaagggcacgtcctaccactacggcttcctgacttctttacggtttcgggttactaacggttcccggggccgttccccggggtcctaggtaacgtaggttccgagtggacgtaggtcggactgacggacgaataacgttactttacacgtaagaaaatacgaacgaaggtaggttacggaggtcgttaggtaacgggtagtttaggggttttacggttaagtttacgcggtaaagtgtaacggactaaaggtacccttaacgtaaacccttaacccgttaccccgtaacggttaacccgggttcggggaaaccgggtaccgggaaacgttaacggggtaaggtaccggtaacgttaaaccggaaaacggttacgtggggttaaccggacgttaccgacctaaacccgttcgttaccgtttacggtccttacccgttaaccgg

SEQ ID NO: 160329 - DNA, 629 bp, Homo sapiens
  misc_feature: GYAE6OF02HOY2K.19.83.H06.1.454.CMB.1.raw
  modified_base (555)..(555): a, c, t, g, unknown or other
  misc_feature (555)..(555): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactcctccctgccccgtctattcctggagacgcccggccctccatcctcctgcaagtctagtcagacgcctcctacataagtaatggacaactaacttatttggattggtacctgacagaacgccgagggcagtcctaccacacgccttctgacttcgttagtttgggttacctaacggtccgggtcccgttcccggggtcccttacggacgtacggttcgtaggtcggacgaggtggagtcgaggacacgtaagtactttacgaactaagaaactacgaacaggaagtggaggcgtaggaggtgttagggtttaggtttattacgtagacgtagtgacgagtcctaactaactaacctccgtacgtaacggttacgggcggtaaacgggacgtaagggngtacgtacgtaacggtaaacgaagtcggtcgtacgtacgacctactacgttccgttacgttacctagttacccg

SEQ ID NO: 160330 - DNA, 787 bp, Homo sapiens
  misc_feature: GYAE6OF02G5PW3.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagacgccggcctccatctcctgcaagtctagtcagcgcctctacatagtaatggacaacaacttatttggattaggtacctgcaagaacgcccgagggcagtcctaccactacgccttcctagtacttccgttagtttagggttaccttaaacgtcccggggtcccgttcccggggtacccctaggaaccgtacgggttaccaggttacgggacgtaggtacggaacttccggaacggtcaacgtagttaaaccttttacacgtaacgtaaaactacgaaacggtagtagggtagggtaacggtaccgtaaggtacgggtaagtttaggggttttacggggttttaaacgttacgtaggtacgtaaacgttacgtaaccgaacggttaccgttaaccttaaacccgttaaacccgtttaccccgttaacggttaacccggggtttaccggggtaaaccgggggtaaacccggtaaaccggtaaaggggtacgggtaagtaaccggttaaaccggtaaaaccggttaacggttacggggttaccggtacgtacgggtaaccctaaccggttactttacccgggttactttaccgttaccgttaccccgg

SEQ ID NO: 160331 - DNA, 771 bp, Homo sapiens
  misc_feature: GYAE6OF02F2AFU.19.83.H06.1.454.CMB.1.raw
  modified_base (173)..(173): a, c, t, g, unknown or other
  misc_feature (173)..(173): n is a, c, g, or t
  modified_base (223)..(223): a, c, t, g, unknown or other
  misc_feature (223)..(223): n is a, c, g, or t
tcagtactctcgtgcacgaccggtgctcgatttagatcacgtgcgtcgcgggcgtagactttgtgtttctcgtagtctgctttgctcagcgtcagggtgctgactaatgctctgggtctctggatccaggtggggatattgtggtgactcagtctccactctccctgcccgtnattcctggagacgcccggcctaccatcctcctagcaagtctagtcagacncctcctacataagtactggacactaacttagttggattggtaccctgacgtaagacgccgagggcagtcctaccacgacgcctccgtgtacttcgttagttttccgggttactaacgggtcccggggtcccgttcccggggtcccttacggaccgttagggtttaccgtagggtcgggtaccggtagggtacgggtaagtcaacggtaaccaaccgttaaggtttaacttttaaccgaacttaacgtaaaactaccggtaaacgtaagggtaacgggtagggtacgggtacggttagggtaaggggtttacggtttaggggtttaggggtttttaacgtttacggtcggtacgtaccggtgtaaccggtaacgtacccgttaaacccttaacctaaacccctttaccccgttaaaccgggttaaccgggtttcccggggaagggtaaccggaacgggttagggacggtacggtaaactaacggaaacggttaccggttaggtacgtccgtacgtaccgaactaccgtcgttacgttcttactccccgg

SEQ ID NO: 160332 - DNA, 825 bp, Homo sapiens
  misc_feature: GYAE6OF02I4ZY6.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactcctccctgcccgtcattcctggagagccggccctccatctcctgcaagtctagtcagacgccctcctaacataagtaatggaacaacaacttatttggattcggtacctgactaagaacgccgagggcacgtcctacccacgtacggtcctaccgtggaacttccgttaaggttttcggggtttaaccttaaacggtccccgggggtacccggttccccgggggttcccctaggtaaccgttacggggtttacccgtaaggggttcgggtaccgtaacgggttacggggtacttacggtaacgggcctaaacgttaacggttaactttttaaccgaacgtttaaacggaaatttaacccgaaaacgtaagggtaacgggttacggggaacggtcggttaacgggtagggttaacggtttaggggttttacggggttttaacgtttacgttacggtaccgttaaggttacgtaccgtaaacgttacccgttaacgttaaaccccttaaaccgtaccccgttaacgttaacccgggtttaccgggaccggggtaacgggtaacccgtaagggtacggacgtaacgtaaccggtaaaccggtacgttacgggtacggtaccgtacggacgtacccgtagttacccggttacggttaccttaccgtacccg

SEQ ID NO: 160333 - DNA, 812 bp, Homo sapiens
  misc_feature: GYAE6OF02IQ509.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagcccggcctccatcctcctgcaagtctagtcagacgcctcctacatagtaatggaacacaactattgattggtacctgcagagccgagggcagtctccacacggctcctagtacttacgttagttttcgggttacttaacgttcccgggtaacccggttccccgggggttcccctaggtaaccgtacgggttcgaaggttcgggacgtaagggtacggtaacgtaccgtacggacctaacgtaaacggttaactttttaaaccgaaccgtttaaacgtaaaaacctaccgtaaaaccggtaacggtaagggtacggggtaaccgggtacgttaagggaacgggttaggtttaggggtttttaggggggtttttaacctttaacggttacgtaccgttaacgttacggtaaccgtaacggttaccttaacccgttaaacccgttaaacccgtttacccccgttaacggttaaccgggtttacgggggttaaccggggaaacgggtaaacccgggttaaggggtaaccgggtagtaaccggtaaaccggtaaacggtaaccggttaggtaccgggaccgttacggtaaccctaccgtacgttaccgtcggttttacccttaccgttaccccg

SEQ ID NO: 160334 - DNA, 812 bp, Homo sapiens
  misc_feature: GYAE6OF02JEDPG.19.83.H06.1.454.CMB.1.raw
tcagtactctcgtgcacgaccggtgctcgatttagatcacgtgcgtcgcggggcgtagactttgtgttctcgtagtctgctttgctcagcgtcagggtgctgctaatgctctgggtctctggatccaggtgggatagttgtggtgactcagtctccactccgtccctcgtcccgtcacttccgtgggagacgcccggccctccattcctcctgctaacgttcttaggtaccaggtacctcccggttaccaacctaattaacggtaagttacgggaacctaacctaaacgttaacggttttacggtaacgtttacgggtaccctggaacggaaacggaaacggtccccggaaggggtcctaaccggttacctacccgtaacgtacgtcccttaccgtagggtaacttaccgtttaaggttttcgggttaactaaccgttacccgggtacccggtcccggggttacccctggaacggttacggttacgtaaggtccggtacgtggtacggtactacggacggtacaaccgttataaactttaccaacgtaggtaaaacctcgaaacgtaggtaacggtagggtacggtacttagggaagttaggtttaccgggtttaacgggttttaacttacgtcgtactaggttcggaactaggtacctaacgtaacccttaaaccgtccgttaacgttaaccgggtttcgggaacgggaacggtaaaccgggtaggtacggagtaacggtaccgaaaggtaccgttggtaaccggtactccggaaccctgttacctcgggtttacctccgttacgtacccg

SEQ ID NO: 160335 - DNA, 796 bp, Homo sapiens
  misc_feature: GYAE6OF02FNIRB.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcacttcctggacgagcccggcctccatctcctgcaagtctagtcagacgcctcctacatagtataggacacaactatttggattggtacctgctagaacgtccgagggtccaggttcctccacgacgtcctaccgtgtacgttcgttagttttggggttacctaaacgtcccgggggtacccgttccccggggggttcccctaggaaccgttacgggtttacctagggttaccgggacgtagggttcggtaattccggaacggtaccgtaacgttaacgtttaaccgttttaaaccgtaccgtttaaacgtaaaaacgttaccggaaaacgtaacgggtaacgggtacggggtaaacgggttccgtaaaggggtacgggttaaaggtttcgggggttttaaggggtttttaaacgttaccggttacggtacgttaccggttacggacggttaaaccgtaccgtttaccgtaaaccgtaacccgttaccccttacggttaaccggttaccgtacgtaaacgggaaccgggtaaccggtaaggtcggtaacgaacggttaaccgaaacggttacgtcggtacggtcgttacgacctaaccgaccgtttccttcgttaacgttaccccg

SEQ ID NO: 160336 - DNA, 601 bp, Homo sapiens
  misc_feature: GYAE6OF02IM1SO.19.83.H06.1.454.CMB.1.raw
  modified_base (121)..(121): a, c, t, g, unknown or other
  misc_feature (121)..(121): n is a, c, g, or t
  modified_base (171)..(171): a, c, t, g, unknown or other
  misc_feature (171)..(171): n is a, c, g, or t
  modified_base (365)..(365): a, c, t, g, unknown or other
  misc_feature (365)..(365): n is a, c, g, or t
tcagtactctcgtgcacgaccggtgctcgatttagatcacgtgcgtcgcgggcgtagactttgtgtttctcgtagtctgcctttgctcagcgtcagggtgctgctaatgctctgggtctcnggatccagtgggatattgtggtgactcagtctccactctccctgcccgtnattcctggagagccggcctccatctcctgcaagtctagtcagagcctcctacattagtaatggacacaactagtttggattggtacctgtcagaacgccagggcagtcctccacagctaccgtgagtctagtttgggttactaacgtccgggccttccggggtccctgaccgtaggttcgagtggctagtggancaggcacagtatttacactagaaactcaactagaaggtggaggcgtagacgtagttaggttgggtttacttagtgctatggacagactactaaccaacttaccctacgtaacggttccggacggacggaacgtaagggtacggtagagttaaccggaaacgtaaccggtacgggtaccgttaccgtcggtaccgtaacgtaccggttacttaccgggttacctttacctaacccgg

SEQ ID NO: 160337 - DNA, 827 bp, Homo sapiens
  misc_feature: GYAE6OF02HBRZP.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtcctccactctccctgcccgtcattcctaggagacgcccggccctccactctcctgccaagtctagtcagacgccctactaacataagtaatcggaacaactaactagtttggattcggtacctgacaagaacgccgagggtcacgtcctaccacgacgtctccgtagtacttacgtttagtttcgggttaacttaacggtcccggggtcccggttccccgggggtacccctacgtacggtacggttacgtagggtcgggacgtacgggtacggtaactaccggaaagggtaccgtaaccgtaaacgggtttaactttttaaacccgaaaccgttaaacggttaaaaaacctaccgtaaaaacgtaaacgggtaagggttacgggtaacgggtacggtacggggtaaagggtaacggtttaggggttttaacggggttttaacgtttaacgtaacggtaacttaacgttaccgtaacgtaaacgtacccgttaacttaaacccgtaacccttacccgtaacggttaccggttaacgggtaaccggggaaacggtaaaccggtaaacgggtaggtaacgtaacggtaaacccgtaaaacgggttaaccgtcgggtaacggacccgttataccccggtaacgtaacgtccgtttacgggttacccttaaccgttacccg

SEQ ID NO: 160338 - DNA, 948 bp, Homo sapiens
  misc_feature: GYAE6OF02G7Y4Y.19.83.H06.1.454.CMB.1.raw
  modified_base (189)..(189): a, c, t, g, unknown or other
  misc_feature (189)..(189): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccgaggtgggatattggtggtgactcacgtcctaccacttcctccctcgcccgtctactttccgnggaagcggtccggccctccacttcctccgtgacctaagttccgtaagcacgacgtccctacctaacgtattaaggtaaacgtcgaacctaacctaagtttacgttttggaagtttcggtaacctgaaccgaaggaaaccgccggaacgggtccaagttccctacccgaactacggtccttcccgtagtactttcgttttagttttacgggttacctaagggtccccggggtccggttcccccggggtacctacggtacgttacgggttacccgaggttacgggaccgtaacgggtttacggaacgtaacccgggtacggtacctaaaccggttaaacgttttaaccttaaacccggaaacctttaaacgaaaacccggtaactaaaacgggacgggttaacgggggttacgggtaaccggttacggttaaggggtaacggggtttaagggttttaccgggggtttttaaacgggttttaaccgtttaaccggtaggttacccggttaaaggttaccgtaacgttaccggttaaccttaaacccctaaacggttaaaccccctttcccgggtaaaccgggttaccgggttacggggaaaccggggtttaaacccggggaaacgttaaccggggaacgggtaaaaccgtcccggtttaaaaccgggaaaacccggttttaggttaacccgggtccggtacccgttaaacgcccgttaaaccgtcccgttttacgttacccggttacctttaccctacccgg

SEQ ID NO: 160339 - DNA, 752 bp, Homo sapiens
  misc_feature: GYAE6OF02IQZAT.19.83.H06.1.454.CMB.1.raw
  modified_base (174)..(174): a, c, t, g, unknown or other
  misc_feature (174)..(174): n is a, c, g, or t
  modified_base (185)..(185): a, c, t, g, unknown or other
  misc_feature (185)..(185): n is a, c, g, or t
tcagtactctcgtgcacgaccggtgctcgatttagatcacgtgcgtcgcgggcgtagactttgtgtttctcgtagtctgctttgctcagcgtcagggtgctgctaatgcctctgggtctctggatccaggtgggatattgtggtgactcagtctccactcctccctgccccgtnattcctggagngcccggcctccatcctcctgcaagttctagtcagagtccctacctatatagtaagtcggaacactaacttagtttggattcggtacctgactaagaacgcccgagggcacgtcctccacacggtctccgtggtacttcgttacggttttcgggtttacttaaccggttcccgggggtacccgtttccccgggggttccccgtacggtaccgtacgggtttaccgtaggttcggtaccgtaggttacggtacgtaccgacgggtacaaccgtagttaacgttttaccgaacgtaacgtaaaacgtacgaaaccgtaggtaacgggtgggtacgtacggtagggtaggttaacggttacgggttttagggttttacttaacgtaggttacgtaagtcgtacgtaacgggtcccttaaccgtaacgttaacccgttaacccgtaccggttaaccgggtaccgggttaacgggacggtaaaccggtacgggtacggtagacgttaacgaacggtaaccgtggttacgtacggtcgactacgttaccgtcgttacgttccgttaccgtaccg

SEQ ID NO: 160340 - DNA, 746 bp, Homo sapiens
  misc_feature: GYAE6OF02F4KRD.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatcctcctgcaagtcctagtcagacgtcctcctacatagtaatggaacacaactattggattggtactgcaagaagccagggcagtctaccacgacgcctcctagacttctagtttgggttacctaagtccgggtccgtccgggtccctagacgtaggtcgtaggtggacaggtggtactcgaggactacgtaacgtacttttacgacttaagtaaactaacgaaacgtacgggaaggtacgggtacggtacgtagggtaacgggttacgtttaggggtttacggggtttttaaagtttaaccggtacggtaccgttaagttaacggacgtaaaccggttaccgttaaccgttaaaacccgtaaacccgtttaacccccgttaaacggttaacccggggttttaccgggtaaccgggggaaaacggggtaaacccgggtaaaaggggtaccggaacggttaacgtaaaccggtaaaaccgtaacggttacgggtacggtaccgttacggaaccgtaccctaacgttccgttacgttaccgttaccttaacccgg

SEQ ID NO: 160341 - DNA, 732 bp, Homo sapiens
  misc_feature: GYAE6OF02G6BWC.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaaatgctctgggtctctggatccaggtgggatattgtggtgactcagtctcccactcctccctgcccgtcattcctggagagccgcctccatctcctgcaagtctagcagacgtccctactacatagtaactcggaacaactaactagtttgattaggaaactgacaagaacgtaccagggaccatccgtaccacgacgtccaccgtagatccgttagttttacgggtacttaacgtccgggtaccggttcccgggtccctagaccgtaggttaccggagtacggacgtagttacgggacttacgaacgggtaactacgtaaacgttaaacgttttaaccaagttaacgtaaaaacgttaccgaaaaccgtaggtaacgggagggtaacggtaccgtaggtaagggttaacgggtttagggttttacgggggtttaacctttacgtacgtaaccgttagtacgtacaacggttctaaaccgtaacctaaacccgttacccgtaacgtaccggttaccgggaaccggtaaacggaaccgtaaggtaaggacgaacgtaaccgtaaaaccggtaacgttaggtggtacctacgaccgtaacgttacgttacgtacgttcttacccgtacc

SEQ ID NO: 160342 - DNA, 672 bp, Homo sapiens
  misc_feature: GYAE6OF02GA88A.19.83.H06.1.454.CMB.1.raw
  modified_base (178)..(178): a, c, t, g, unknown or other
  misc_feature (178)..(178): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattccnggagagccggcctccatctcctgcaagtctagtcagacgccctcctaacataagtaatggacacaattattggattggtacctgcaagaagccagggctagtcctacccagacgtctcctagtactcttagttttgggttactaacggtccgggccgttcccggggtcctagtacgtaggttcaggtggcaggtggactacgacggcaacgtaagttactttaacaactaagaaaactacaaacgtagaggttacggaggtcgtaggtaaggtagttaggtttaggggtttaattacgtgtacctagtagtactaagtctaccttaaacctaacccgtaccctaccggttaaccgggttaccgggacggggtaaacggaaccggtaagggtacgggtaacgtaacgtaaaccggtaaaaccggtaacggttacgggtacggtaccgtaccgaccgtaacgttaccgttacgtaccgttaccgttacgtaacccg

SEQ ID NO: 160343 - DNA, 549 bp, Homo sapiens
  misc_feature: GYAE6OF02GBE4D.19.83.H06.1.454.CMB.1.raw
  modified_base (386)..(386): a, c, t, g, unknown or other
  misc_feature (386)..(386): n is a, c, g, or t
  modified_base (519)..(519): a, c, t, g, unknown or other
  misc_feature (519)..(519): n is a, c, g, or t
  modified_base (538)..(538): a, c, t, g, unknown or other
  misc_feature (538)..(538): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctctgatctatttggtctaagtcgggcctccggggtccctgacgaggttcagtggcagtggatcgaggcactagtatttacactagaaatcaaacagagtggagntaggaggtattgggtttagggttattacgtgactagtgacaagtctacctaactaaaccttccctacgtaacggttacgggcggtaacgggacctaagggtcgagtactacgaaaacgtactaggtcggtacncgacctacctattaccgtnttacttctacg

SEQ ID NO: 160344 - DNA, 673 bp, Homo sapiens
  misc_feature: GYAE6OF02HG45E.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtcctccactctccctgcccgtcattcctaggagacgcccggtcctccatcctcctgcaagtctagtcagacgcctcctacatagtatggacacaacttattggattcggtacctgacaagaacgccgagggcagtcctcacacgcctcgtgtacttcgttagttttcgggtactacggtccgggtcccgttcccgggggtacctgaacgtaggttcaggtggacaggtggatcggacgctaacgtagttactttacacgttaagaaactcgaacgtagtagggtacggtacggtcgtaggtaacgtaggtttacggggttttagggtttacttaaccggtgtacccgtagttacggactacgtaccgttaacctaacccgtaaccgttacccctaaggttaaccgggttccgggaaccgggtacggaaccggtaacggggtacggaacgtaacgtaaccggtaaaacggtcggttacggtacgtcctaggacctacgtacgtccgttatccgttactacccg

SEQ ID NO: 160345 - DNA, 568 bp, Homo sapiens
  misc_feature: GYAE6OF02F1Z7Y.19.83.H06.1.454.CMB.1.raw
  modified_base (334)..(334): a, c, t, g, unknown or other
  misc_feature (334)..(334): n is a, c, g, or t
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
  modified_base (429)..(429): a, c, t, g, unknown or other
  misc_feature (429)..(429): n is a, c, g, or t
  modified_base (447)..(447): a, c, t, g, unknown or other
  misc_feature (447)..(447): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctcatctcctgcaagtctagtcagagcctcctacatagtaatcggacactaactagtttggattcggtacctgacaagaagccgagggtcagtcctaccacacgctctgactcttagtttggtactaagtcggccgtccgggtccngtacgtgtcagtcgctaggtgatcggagcaactagtatttacactagaaactcaanagngtggacgcgtagaggtagttggttagggttacttgngtactatgactagcgtanaactacctacctacgtacgtccgggagacggtaacgtaaggtcgagtaactagtaaaccggtactagggtacggccttcgaaccgtaccgtacgttacgttacggttacctaccgttaccg

SEQ ID NO: 160346 - DNA, 874 bp, Homo sapiens
  misc_feature: GYAE6OF02IQPQJ.19.83.H06.1.454.CMB.1.raw
  modified_base (182)..(182): a, c, t, g, unknown or other
  misc_feature (182)..(182): n is a, c, g, or t
  modified_base (669)..(669): a, c, t, g, unknown or other
  misc_feature (669)..(669): n is a, c, g, or t
tcagtactctcgtgcacgaccggtgctcgatttagatcacgtgcgtcgcgggcgtagactttgtgtttctcgtagtctgctttgctcagcgtcagggtgctgctaatgcctcgtgggtctcgtggatccaggtgggattagttggtcggtgactcagtctccactcctcccgtcgccccgtntacttccgtggagacgcccggtcccttaccactccttcctacgactaagttctagtcgaacggtacctaccctacctactaacgttaagtaaagtacggaacctaacctaaactttaaggttttacggtaacgttttacggttaacccgttagaaccgtaacggaaaacggaccccggtaaggggacctaaccgttacccgtaacccaacggtacgtaccccgttacctacgggtactttacggtttaacggtttttaccgggtttaacgttaaaccgggttcccggggtaccccggtttccccggggtacccgtacggtaacgtacggttaccggtaaggtccgggtaacggtacggttaggtaaccgtacggaaggacctaactaagttaacgttttaaaccacgttaaagtaaactacgaaacgtaaggtacgtagggacgtacgtaggtaagggtagtttaggtttacgggttaattacgtanctaagtacgtaacgacgtacttaaccgtaaacctaacccgttcccgtaacggtaaccgggttcgggtaaacccggggacgggtaaacccgtaaggggttaactaacgggtaactaaaccgggtaaaacgttaacggtaacggttaacggacccgttaagaccccgtaactacgttacgtttaaccggtttccttaccgttaaccg

SEQ ID NO: 160347 - DNA, 553 bp, Homo sapiens
  misc_feature: GYAE6OF02FQ8SH.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacaacaactatttggattggtacctgacagaagccaggcagtctccacagctcctgatctagtttgggttctaagtccgggtccgtccggggtccctgacgtaggttcagtggcagtggatcgaggcacagtattttacgactagaaactcaaacgagagtggagctgaggtattggttagggtttattacgtgctatgactaacgctacgtaccaacctcccgtacgtaacgttcgggacggaacggacgtaaggtaggagtactacgaaacgaacgtcggtacgcgtacgctaccgtattcctgttaccttcgtaccg

SEQ ID NO: 160348 - DNA, 1039 bp, Homo sapiens
  misc_feature: GYAE6OF02H7WWX.19.83.H06.1.454.CMB.1.raw
tcagtactctcgtgcacgaccggtgctcgatttagatcacgtgcgtcgcgggcgtagactttgtgtttctcgtagtctgctttgctcagcgtcgagggtgctgctaatgctctgggtctctggatccaggtgggatattgtggtgactcagtcctccactcctccctcgccccgtctattcccgtagggagacgcccggccctccatcctcctgctaaagtctagtacagacgtccctacctaacattaagtaatcggaaccaactaacttagttttaggtaatttcggtaaccctggaccaaggaacgcccgaggggtacctacgttcctacccgaaccgacgtaccgttacctggtaacttcgttttaacggtttcggggtttaaccttaaaccggttcccgggggtacccccgggtttccccgggggttacccctacgggtaaccggttacgggtttacccgtaaggggttcgggacggtacgggtacgggtaaccgttaccgacggggtaccctaacggttaacggtttaacgtttttaacccgaaacgtttaaacggtaaaaacgtacccgtaaaaacgggtaacgggttaacgggggttaccggggtaaacggggttaccggttaagggggtaaacggggttttaaagggttttacggggggggttttttttaaaacgggggttttttaaacctttaacgtttaacgggtaaccggttaacgggttaccgtaaaccggtaaacccgtttacccgttaaaacccggtttaaaaacccccgttaaccccgtttaaccccccttaaacgggtttaaccccgggggtttacccggggaaaccgggggtaaaaccgggggtaaaccccggttaaaggggggtaccgggtaaacggtaacccggttaaaaccgggttaaaaccgggtttaaacccggtttacggggtaccgggttaaccggttaaccccgtacccgttaaaccccggttagtttttacccccgggtacgttttacccgtttacccgtttaaccccccgg

SEQ ID NO: 160349 - DNA, 689 bp, Homo sapiens
  misc_feature: GYAE6OF02GFJNQ.19.83.H06.1.454.CMB.1.raw
  modified_base (171)..(171): a, c, t, g, unknown or other
  misc_feature (171)..(171): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtnattcctggagagcccggtcctcccagtcctcctgcaagttcctaagtcagacgtccctacctacatagtaatcggaactactaacttatttaggtattcggtaccttgactagaacgccagggcacggtcctaccacagctcctgacttctagtttggttacttaagtccgggccgttcccgggtaccctgtaccgtacggttacgtacgtgggtacaggtaggacgtactagggacctaacgtaaggtaacttttacaaccgttaagaaactacgaaacctaggtacggtaggaacgggtctaggtacggtagtttacgggtttaggggtttaacttaccggtagaccgttaagtacgacgtaacggtcctaacgtaaccgtaacctcccgttaacggtacccggtttacgggacgggtaaccggtaacgtaacgtacgggatacggtaacgtaacggtaactacgggttacgacgttacgacctaacctaacgttcgtacgttaccgtagtacccg

SEQ ID NO: 160350 - DNA, 788 bp, Homo sapiens
  misc_feature: GYAE6OF02HDP2I.19.83.H06.1.454.CMB.1.raw
  modified_base (758)..(758): a, c, t, g, unknown or other
  misc_feature (758)..(758): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactcctccctcgcccgtctacttcctggagacggccggtcctccatcctccgtcgacaacgtctacgtcagacgtccctacctacctaatagtatacggacaacctaacttagtttggtattggtacctgacaggaacgccgacggctacgtcctaccacgacgtccgttcctgtacttcgtttaggttttacgggttaaccttaacggtacccggggtaccccggttccggggttaccccgtcggtaccgtacgggttccgtacggtcgggtacgtaacggttcggacgtcggacgaccgtaacgtaacgttacgtttaaccgtaacgttaacgaaacgttaccgaaacggtacgggtagggttacggaacgggtcgtaagggtaaccggttggtttaggggttttacgggttttaattacgtacgtacgtaacgtttcgaaactacgggtttactaaccggttaaaccctaccggttacccgtaacggtttaacccggggtcggggtaacgggtaaacccgggtacgaacggttaggtacgtaaccggtaaccggtaacggtaacgtggttaaccggaccggttaactaccgtacccggtntttacccgggtcttaccgtcctttacccgg

SEQ ID NO: 160351 - DNA, 778 bp, Homo sapiens
  misc_feature: GYAE6OF02HEBBZ.19.83.H06.1.454.CMB.1.raw
  modified_base (460)..(460): a, c, t, g, unknown or other
  misc_feature (460)..(460): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtgggatagttgtggtgactcagtcctccactcctccctcgcccgtctattccgtggacgacgcccggtccctccagttcctccgtacgactaacgttctacggtcacgtaccgtaccctacctaactaagttaaggttaacgtacggaacctaactaaacttagtttacggtattacggtaccgtagactaacggaacgcccggtagggacctacggtccctaccgaacgtcgtccttaccgtagtacttacgtttaggttttacggttactacggtcccggggtcccggtcccgggtcctagtacgtacggttcgagggtcgacgtaggnggtactcggaagtaccagttaacttaacgtttaaccgaaacgttaaacgtaaactaccgaaaggtaggtacgggtagggaacggtcgtaaaggtaggttacggtttaggggttttaggtttaacttacggtatacgtacgtacgaacgtacgtaccgtaacctaacccgtaaccgtacccgaggttaaccggtacgggaacgggaaccgttaaggaccgggttaagaccgtaacgtaaccgtaaacggtggtaacggttccggaacttacccggtactaaccgttcggtaccctttacggtaccccttaggttccccg

SEQ ID NO: 160352 - DNA, 642 bp, Homo sapiens
  misc_feature: GYAE6OF02GB470.19.83.H06.1.454.CMB.1.raw
  modified_base (296)..(296): a, c, t, g, unknown or other
  misc_feature (296)..(296): n is a, c, g, or t
  modified_base (385)..(385): a, c, t, g, unknown or other
  misc_feature (385)..(385): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagccctcctacatagtaatcggaacactaacttatttggtattggtacctgacagaagccgagggcagtctccacagctctgntctagtttggttctaagtccgggccgtccgggtcctagactaggttcgagtggcgagtggatcgaggcacgagtatttaccatagaaancgaaacagtaggtggaggcgtaggaagggtagttaggttacgggtttattacgtgtacgtagtacgacgtaacgtcgtacctaaccgtaaaccgttacccgttacgtaaaccgggttttcgggtaacgggtaacggggtaaaccgtaaggggtaccgtaaggtacgtaaccggtaaacgggttaacgtacgggttaccggtacgttacggtacgtacccgtacgtttaccgttacgtttacctaccgtttaaccccg

SEQ ID NO: 160353 - DNA, 661 bp, Homo sapiens
  misc_feature: GYAE6OF02HOYJB.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtctattcctgggagacgcccggcctccatcctcctgcaagtctagtcgagacgcctacctaacatagtaatcggaaccaacaacttagtttggtattcggtacctgacagaacgccgagggcagtcctaccacacgctcctagacttcttagtttgggtactaacgttccggggcccgttccggggtcccctaggtaccgtacggttcgaggttcggacgtaggtggacgtcgaacggactaacgtaagttactttaacacgttaacgtaaaactacgaaacaggtaaggtacgggacgtacgtaggtaaggttacggtttagggttttagggtttacttaacggtgtactagtcgactacgacttactaaccttaaccctccgtacgtacggttcggacgggtaacggtacgaaggtaggacgtagaaccggtaacgtacgtacggtacggtactacggaccacgtacgttcgtacgttacgtcgttaccg

SEQ ID NO: 160354 - DNA, 724 bp, Homo sapiens
  misc_feature: GYAE6OF02JFOXN.19.83.H06.1.454.CMB.1.raw
  modified_base (175)..(175): a, c, t, g, unknown or other
  misc_feature (175)..(175): n is a, c, g, or t
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatcaggtggggatagttgtggtgactcagtcctccactcctccctcgcccgtntacttccgtggagcgcccggcctccnctcctcctgactaacgtctaagtcacgactcctaccanataacgtatacggacaactaacgttgttacggtattcggtacctgaacgaaggaacgcccggaagggtcctacgttaccctaccgaactacgtcctccgtaagtcttaccgtttaggtttacggttacctaacgggtcgggtcccggtccggtcctacggccggtagttccgagggtcgtaatcgggtacgtaagtacggacggtactaacgttaacgtttaacggtttacaaaggtaaacgtaaactacgtaaagtagggtaacggttgggacgttagtacggtaaggtgggttttaaacgggttttcggttaaacttcgtacggtacggtactacgttacggtaaacgttccttaaccgttaaccgttaaaccgttcccgtaacggttccggtaacgaggtacggtaacgacgggttagacgtaacgtaacgaacgtagcggtacgacgtacgtacgacgttctagtcgttactacgtacccg

SEQ ID NO: 160355 - DNA, 650 bp, Homo sapiens
  misc_feature: GYAE6OF02JIXTS.19.83.H06.1.454.CMB.1.raw
  modified_base (99)..(99): a, c, t, g, unknown or other
  misc_feature (99)..(99): n is a, c, g, or t
  modified_base (153)..(153): a, c, t, g, unknown or other
  misc_feature (153)..(153): n is a, c, g, or t
  modified_base (173)..(173): a, c, t, g, unknown or other
  misc_feature (173)..(173): n is a, c, g, or t
  modified_base (180)..(180): a, c, t, g, unknown or other
  misc_feature (180)..(180): n is a, c, g, or t
  modified_base (201)..(201): a, c, t, g, unknown or other
  misc_feature (201)..(201): n is a, c, g, or t
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
tcagtactctcgtgcacgaccggtgctcgatttagatcacgtgcgtcgcgggcgtagactttgtgtttctcgtagtctgctttgctcagcgtcagggtnctgctaatgctctgggtctctggatccaggtgggatattgtggtgactcagtcnccacctcctccctgcccgtnattccgnggagcgccgcctcatctcctnaagtctagcagcgcctacanatagtangaacatacttnttaggnttcggacctgacaagaacgccgtagggctacgtcctacccgacgacgtcctaccgtagactttacgtttaaggttttcggtacctaagggtccccgggacccgttaccggggtccctaggaccgttaggttcgaggtcggctagggttcgatcgaacggctaagtaagtttactactacgaataaacgtcacgagtaggtggaacgtcgtagacggtagttaggttacggtttactgtcgtataacgtcgaacgtactacgtacctaaccgtaccttccgtaacgtacggtacgggacgggaaacggacgtaacggtagaaccgtagtaaccgaaacgggtcgtaacggtcggtaagtaccgtacctacgtaaccgttcgttacttccgttactaccttccccgg

SEQ ID NO: 160356 - DNA, 886 bp, Homo sapiens
  misc_feature: GYAE6OF02FONTF.19.83.H06.1.454.CMB.1.raw
  modified_base (180)..(180): a, c, t, g, unknown or other
  misc_feature (180)..(180): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccgagtggggatattgtggtgactcagtctccactcctccctgcccgtcattccgnggagacggcccggtcctccatcctcctgacgtaagtctagtcagacgtccctacctaacagttaagtaagtacggaacctaacctaaacgtttagtttaggagtttacgggtaaccctgaccgtaaggaacgcccgaggggtactacggttaccctacccgaaccgtaggtccccttaccgtacggtaacctttacggtttacggttttttacgggttaaccgtttaaaccgggttcccccggggggttcccccgtttccccccgggggggttacccttacggtccgggttaaacggttccgtacgggtcgggtacgtacggttacgggtaactcggtaacggacctaacgttaaggtttaccttttaaaccgaaccggttaaagtaaacctacgtaaacggtagggtaacgggtagggtaacgtacggttagggtaaggttaggtttcggggtttaacgggttttattaaccggtaggtacgtaacgtcgtaccgtaacggtcctaacccgtaaacctaaccccggttacccgttaaccggtaacccggggtttccgggaaaccggggtaaacccggtaacgggttaacgggtaggtaacccgtaacggtaacccgtaaacgggtaaccgttcgggttaccggtacgtaccggtaacctaccgttacgttaccggtttaccgttaccgttccgtttaacccccgg

SEQ ID NO: 160357 - DNA, 678 bp, Homo sapiens
  misc_feature: GYAE6OF02G4K4Z.19.83.H06.1.454.CMB.1.raw
  modified_base (164)..(164): a, c, t, g, unknown or other
  misc_feature (164)..(164): n is a, c, g, or t
  modified_base (199)..(199): a, c, t, g, unknown or other
  misc_feature (199)..(199): n is a, c, g, or t
  modified_base (654)..(654): a, c, t, g, unknown or other
  misc_feature (654)..(654): n is a, c, g, or t
  modified_base (663)..(663): a, c, t, g, unknown or other
  misc_feature (663)..(663): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtgggatattgtggtgactcagtctccactctcccngcccgtctattcctggacgagcccggcctccatcnctgcaagtctagtcagacgcctactacagtaagtaatacggaactaactaaacttagtttaggagtttacggtaacctgtaccaaggaacgacccgaggggtaccacggttccctaccgaaccgtaacggtccgttaccctagtaacctttacgtttagttttacgggtttacctaaaggttcccccggggtccgttacccggggtacccttaggacgttaacggttacagggtcgacgaggttacgatacgaggacacgtaacgttaattaaccagttaacgaaactacgtaaacgtaggaaggttcgggaacggcgtaaggtaggttagttacggggttttaggtttaatacgttgactagtagactacgtaccttaacgtaacctaaacctccgtacgtaaccggtcgagggtaacgacgaagtcgaagctaacgaaagtacgagtccgtangacaccgtntccgtattcgactcg

SEQ ID NO: 160358 - DNA, 744 bp, Homo sapiens
  misc_feature: GYAE6OF02F92ZN.19.83.H06.1.454.CMB.1.raw
  modified_base (517)..(517): a, c, t, g, unknown or other
  misc_feature (517)..(517): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtggggattattggtggtgactcagtctaccactcctcccctgcccgtcactttcctggaacgcgcccggtcctacccattcctaccctgacctaacggttccttacggtccgaaggtccgtcccctaccctaacagttaaggtaacgtcgggaacctaacctaaccgtttagttttacgggtaagtttccgggtaacccttggaccgaagggaaccggacccggtacggggactaacggttacctacccgaactcggtccttccgtagtacttacgttagttttcgggtactacggtcccgggtcccggttcccggttcctaggacttcggttcacggtcgagtagtcggtatcgaacggctaacgtagttaactttcgaaccgtaanaaacctcgaaacgaggtacggtacgggacgtgtcggtaaggttcgttagggttacggtttacggttactacgtacgtagtagtcgtaacgtcgttaacctaaccgtacctacccgtacgttaaccgggtcgggaccggaaggtacgaacgggtagacgaagtaacccgtaaaggccttaggtacgacgtcgaccttactaccgttgtacggttacctcgttaacccg

SEQ ID NO: 160359 - DNA, 718 bp, Homo sapiens
  misc_feature: GYAE6OF02J0N47.19.83.H06.1.454.CMB.1.raw
  modified_base (245)..(245): a, c, t, g, unknown or other
  misc_feature (245)..(245): n is a, c, g, or t
  modified_base (535)..(535): a, c, t, g, unknown or other
  misc_feature (535)..(535): n is a, c, g, or t
  modified_base (569)..(569): a, c, t, g, unknown or other
  misc_feature (569)..(569): n is a, c, g, or t
tcagtactctcgtgcacgaccggtgctcgatttagatcacgtgcgtcgcgggcgtagactttgtgtttctcgtagtctgctttgctcagcgtcaggtgctgctaatgctctgggtctctggactccaggtgggtatattggtgtagactcagtctccactctcctgcccgtcatttccgaggacgacgcccggcctaccactctactcggacaacgtcgtacgtcgacgtacgcccttacctaanagttaaggtaaacgtcggaacctaacctaaacgttgtttaggacgtttcggtaaccctagtaccgaacggtaacgcccggagggtacctacggttacccgtaccaacgtcggtcccttaacctgtacttacggtttacgtttacgggtacctaacgggttcccggacccggttcccggggtacctagtaaccggtacggttcgaaaggtcggacgtaaggttcgaagtcgtaaacgcgtaactaagttactaaccgatagaactacgaagtaggagcggtagctaacggnggtacggttaggttaggttaacttcggtaacgtntacgtcgaactcgtacttaactacccgtactaccgtacggtaccgtacggacggtacgtcgtaacggtacgagtacgtaacccggtaaagtcgttcgaacgggtcccaggtaccccttagtaccgttattccggttaacttccggtacc

SEQ ID NO: 160360 - DNA, 881 bp, Homo sapiens
  misc_feature: GYAE6OF02IO6XW.19.83.H06.1.454.CMB.1.raw
  modified_base (120)..(120): a, c, t, g, unknown or other
  misc_feature (120)..(120): n is a, c, g, or t
tcagtactctcgtgcacgaccggtgctcgatttagatcacgtgcgtcgcggggcgtagactttgtgtttctcgtagtctgctttgctcagcgtcagggtgctgctaatgctctgggtctntggatccaggtggggatattggtggtgactcagtctccactcctcccgtgccccgtactacttcctggagacggcccggcctccatctccgtgacgtaacgttcgtagtcgagaccgtccctaccgtaacaagttaagtaactacggacctaactaaaccgttagtttgggtaattcggtaacctgtacaaggtaacgacgacgggcacgtccctaccacgtacgccgtccgtagtactacttttacggtttggtttaccgtaacggttccggggtccccgggttccccgggggttacccctacggtaaccggttacgggtttaccggtacgggtccggccggtaaggggtagtacgttacggacggttacccgaacgttaagttaaacgttttaccgaaccgttaaacgtaaaacgtaacgtaaacggtaaagggtagggtaacgggtacgggtaacggttaaggggtaaggttaggtttacggggttttaagggttttaacgtttaacgtcgtacgttagttacggacgtaaaaccgtttcccgtaaccgtaaacccttaaaccgtaccccgttaacgggttaaccggttacccgggggaaccgggttaaaccgggaacccggttaagggtaacccgggtaggttaaaccgtaacccggtaaaacggttaaccgggtacgggtacggtacccgttcggaacccgttaacccggttaacgtttacccggttacgtttacccttaaccggtttacccccgg

SEQ ID NO: 160361 - DNA, 829 bp, Homo sapiens
  misc_feature: GYAE6OF02HBK32.19.83.H06.1.454.CMB.1.raw
  modified_base (118)..(118): a, c, t, g, unknown or other
  misc_feature (118)..(118): n is a, c, g, or t
  modified_base (165)..(165): a, c, t, g, unknown or other
  misc_feature (165)..(165): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtcnctggactcaggtgggatattgtggtgactcagtcctccactctcccngcccgtctattccgtggacgacgccggcctccatcctcctggacaagtctagtcaagacgtccctaccgtaacataagtaagtcggaacaactaaccttaaggtttgaagtttcggtaacccttggaccaaaggtaacgacccgaacggggactaacggtacccttaccgaacgacgtcccgtaccgtaggtaacctttaccgtagtttttacgggggttaaccttaacggtccccggggttaccccggtacccccgggggtttaccctagggtaaccgtacggttaccgaacgggttaggcccgtaagggttcgggaacttaaccggacggtcccgtaaaaccgtaagttttaaaccgttttaaccaaccgttaaacggtaaaaacttcgaaaccgtaagggtacggtagggacggtacgtagggtaaacgggtagtttacgggttaaagggttttacgttacgtcggtaactagttacccgaaacgtacgtacgttaaccgttaacccctaaaccgtcccgttaaccggtaaaccggttcgggtaaaccggggaacggtaaacccgggtaacggttagggaacgtaagtaaaccggtaaaccggacgttaggacggtaccgtacgaccgtaccgtataccgttattccgttacgttaccccg

SEQ ID NO: 160362 - DNA, 766 bp, Homo sapiens
  misc_feature: GYAE6OF02I3647.19.83.H06.1.454.CMB.1.raw
  modified_base (542)..(542): a, c, t, g, unknown or other
  misc_feature (542)..(542): n is a, c, g, or t
tcagtactctcgtgcacgaccggtgctcgatttagatcacgtgcgtcgcgggcgtagactttgtgtttctcgtagtctgctttgctcagcgtcagggtgctgctaaatgctctgggtctctggatccaggtggggatattggtggtgactcagtctccactcctccctgcccgtcattcctggagagccggccctccatcctccgtcgactaacggttctagtacaagacgcccttacctaacaattagtaaagtaggaaccaactaacttagttacgtagttacgtacctagacgaagaacgccgagggactacggtacctaccgaacgacgtccttaccgtagtactttacgtttacgttttaggggttaccgttaaacgggtcccggggtacccccggtttcccgggggttacccgttacggaaccggttacgggtttaccgtaaggtcggaccgtaggtacgggtactacggacggacaacgtaagtttactttaacaacgtaataaaacaccgaaagtaggtacggtaggaccggtntaagggtagtacgtttagggtttaggttttaacttcggacgtagtacgtacgacgttaagtacccttaaccgtaaacgtaacccttccgaaaccgttacgggtaccgggtaacgggaaacggtaaccgtaagggtccgaagtaaccgtaacggaaaaggtaccgttgggaaccgttcgacgtaccgtaccgttagtcccgtttagtttaccctacgttaacccg

SEQ ID NO: 160363 - DNA, 722 bp, Homo sapiens
  misc_feature: GYAE6OF02HE1HY.19.83.H06.1.454.CMB.1.raw
  modified_base (172)..(172): a, c, t, g, unknown or other
  misc_feature (172)..(172): n is a, c, g, or t
  modified_base (241)..(241): a, c, t, g, unknown or other
  misc_feature (241)..(241): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccgagtggggatattgtggtgactcagtctccactctccctgcccgtntattcctagggagacggcccggcctccattctcctgccaagtcttagtcagcgcctcctacatagtaancggacactaacttattggattcggtacctggactagacgcgagggcagtcctccgacacggccttccgtacgtattactttaggttttcgggtaaccttaagggtcccgggtcccggttaccccgggggttacccttacggaaccggtttaggggttacgacggggtacggtaccgttaaggggttcggtacgttaccgtacgggtacctaaagtaccgtttaattttaacccggaactttaaggtaaaactaccgtaaacgtaacggtagggttaggacggtgtacggagttacggttagggtttaggttttacttaacgtggtacgtagtcgtaccgtagtacctacgttaacctaacttcccgtaacgtacgggttacgggacggtaacggaaccgtaggtacgacggtactaacggaacgtaaggtcggtacggtacgtacgtacctacggtaccgttgtacggttcctacgttacc

SEQ ID NO: 160364 - DNA, 757 bp, Homo sapiens
  misc_feature: GYAE6OF02G0DLF.19.83.H06.1.454.CMB.1.raw
  modified_base (181)..(181): a, c, t, g, unknown or other
  misc_feature (181)..(181): n is a, c, g, or t
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (225)..(225): a, c, t, g, unknown or other
  misc_feature (225)..(225): n is a, c, g, or t
  modified_base (266)..(266): a, c, t, g, unknown or other
  misc_feature (266)..(266): n is a, c, g, or t
tcagtactctcgtgcacgaccggtgctcgatttagatcacgtgcgtcgcggcgtagactttgtcgtttctcgtagtctgtctttgctcagcgtcagggtgctgctaatgctctgggtctctggaatcctaggtggggatattgtgggttgacttcagttcttacgactctccctgcccgtnattccnggngagccggcctccagtctctgcagtctaggtcagancctcctacatagaatggacacctaatattgattggtacctnacagacgccagggctacggtcgtacccacgacgtccttccgtaggtacgttacgttaagttttcggggtttactaaggttcccgggtcccgggttacccggggttaccccttaggtaaaccgtacggttaccgtaacgggtacggtaccgtaagggttaggtacgtaccgagggtacctaaacgttacgttaacttttaccgaaccgttaagtaaaaacttccgaaaacgtaggtaaggttcggaaacggtacggtagtaaaggtacggtttaagggtttacgggtttaacttacgttagttaccgttaagtacgtaacgtacgtaacccgttaccgttaaacccggtaacccttcccgttaaccggttaacgggttaccgggtaccggggaaccggtaacgtaagggttacggaggtactaacggaaacggtacggtaggtacgggtctaagacctacggtacgttcgtacgtttaccgtacgttacccg

SEQ ID NO: 160365 - DNA, 827 bp, Homo sapiens
  misc_feature: GYAE6OF02HUD3X.19.83.H06.1.454.CMB.1.raw
  modified_base (176)..(176): a, c, t, g, unknown or other
  misc_feature (176)..(176): n is a, c, g, or t
  modified_base (242)..(242): a, c, t, g, unknown or other
  misc_feature (242)..(242): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctggtctctggatccaggtggggattagttggtggtgacttcagtctccactcctccctgcccgtnattcctggagacgcccggcctcgtatctcctgactaagtctagtcacgtacgtccctacccgtaanacgttaggtaaactcggaacctaactaaacgtttagtttacgggtaactttacgggttaacccgtggtacctaaaggaaaccggtcccgaagggggtactaacggtcccttacccgaaccgtaacggtcccgtttaccgtagtacgtttaccgttttaacggttttacggggtttaaccttaaaccgggtcccggggtacccggtttccccgggggttacccctacggtacgtacggggtttacgagggttacgacgtaagggtcgtactacgacggactaacgtattaacgttaccaacgtaacggtaaactcgaaccgtaaggtaggtaggacggtgtaggtacggtagtttgggtttacgggttacttacgtgtacgtagtacgtacgtaacgtacgtacgtaaaccctaccgttcccgtaaggtaccggttcgggtaaccgggtaaacgggtaccgttaaaggggtaccgggtaacgtaaccggtaaccgtaaaccgggttaaccgttacgggtaccgttaccggtaccgaaccgttaccgttccggttacccttacgggttacccttaccgttaccccgg

SEQ ID NO: 160366 - DNA, 785 bp, Homo sapiens
  misc_feature: GYAE6OF02HUN45.19.83.H06.1.454.CMB.1.raw
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
tcagtactctcgtgcacgaccggtgctcgatttagatcacgtgcgtcgcgggcgtagacttttgtgtttctcgtagtctgctttgctcagcgtcagggtgctgctaatgctctgggtctcgtggatccgaggtgggatattggtggtgactcagtcctccactcctcccgtcgcccgtctacgttccgtggagcggcccggccttccatcctcctgactaacgttctaggtcaagtaccgcccttcctaacaagttaagtaacgtcggaactaaaccgttaaaatttagtttcggtaacgtttaccggttacctggtacgaaagaacggtccggagggctaaggtccctacccacaccggtccttcctaggttacttccggtttagttttcgggttaaccttacggtcccggggtcccggttcccggggtccctggtaaccgtagggtttacagggttgacgtaggtggtaacnggaacgnaacgtagttaacttaccgtaactaagtaaactaccaagtacggtacgggtaggacgggtacgtaggtagggtaggttttacgggtttaggtttaacttacggtgtacttagtacgtacgtaaactacgttaacctaaacgtaaaccccgttacccgtaacgttaccggggttacgggtaaccgggggtaaacgtaaccgggtaagggtacgggtaacgttaacggtaaaccgtaaacggttaccggttacgtacgggtacctaccggtacctacgtccgttacgttaccgttccttacgtcccg

SEQ ID NO: 160367 - DNA, 699 bp, Homo sapiens
  misc_feature: GYAE6OF02IQBAS.19.83.H06.1.454.CMB.1.raw
  modified_base (180)..(180): a, c, t, g, unknown or other
  misc_feature (180)..(180): n is a, c, g, or t
  modified_base (189)..(189): a, c, t, g, unknown or other
  misc_feature (189)..(189): n is a, c, g, or t
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
  modified_base (247)..(247): a, c, t, g, unknown or other
  misc_feature (247)..(247): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (540)..(540): a, c, t, g, unknown or other
  misc_feature (540)..(540): n is a, c, g, or t
  modified_base (549)..(549): a, c, t, g, unknown or other
  misc_feature (549)..(549): n is a, c, g, or t
tcagtactctcgtgcacgaccggtgctcgatttagatcacgtgcgtcgcgggcgtagactttgtgtttctcgtagtctgctttgctcagcgtgagggtgctgctaatgctcgtgggtctctaggatccagggtgggattagttgtggtgactcagtcctccactcctcccgtcgcccgtntacttccgnggagccggcccnccctacnctcctccgagaccgtaagtctagcacgctccctacctanagtaagtaacgacgaacctactaacgttagttaggacttaccgtccgtgacgaggaaccgcggacgtacgtcgtaccnccgacncgccttcgtagtaacttcgttagtttccggtacctacggccggttaccgtcggtaaccggtcacgtacggtcgttaagcggtctacggagggtctcgacgatccggaaatacttacttaacacgttaacgtaaacacgaaacggaaggtagggacggtacgacggtaaggttacgggtaggttttaagggtttacggttaataccggtnaggttaccnggtaaaccctcgaccttaacctacccgttaaccctcggtaaccgtaaccgggttcgggaacggtaacggtacggtaccgagaaccgtaacgtacgaaccggtacgtggtaaccgacgtacgtaccgaacttcgtccgttatcccgttacc

SEQ ID NO: 160368 - DNA, 726 bp, Homo sapiens
  misc_feature: GYAE6OF02GMIUZ.19.83.H06.1.454.CMB.1.raw
  modified_base (148)..(148): a, c, t, g, unknown or other
  misc_feature (148)..(148): n is a, c, g, or t
  modified_base (171)..(171): a, c, t, g, unknown or other
  misc_feature (171)..(171): n is a, c, g, or t
  modified_base (222)..(222): a, c, t, g, unknown or other
  misc_feature (222)..(222): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactnagtctccactctccctgcccgtnattccgtggagcgcccggcctccatctcctgacaattctagtcaaggtacnccctccatatagtaatggacaactacttagtttgagttggtacctgacaggaacgccgagggcagtcctaccactacgcttccgtgtactacgtttagttttggtactaacggtccgggtccgtccgggtcctgacgttacggttcgacggtcggacgtacggtcgacgtacgaacgggtacaacgtaacgtttaactttaaccgaacgttaagaaaacctccgaaacgacgggtaagggtacgggaaggtacggtagggtaacggttaggttacgggttttaacgggtttaacttaccggtagtcgttagtacgaaccttacggacctttacgtaaacccttaacccgtcccttaacggtaaccgggttaccgggacggggtaaacgtaaccgggtaacgggttacgacggttaactaaccggaaaccggtacggtttacgggaccgacgttaccggacccgttaacgtacgttacccgttcggttaccgttaccttacccgg

SEQ ID NO: 160369 - DNA, 844 bp, Homo sapiens
  misc_feature: GYAE6OF02IO582.19.83.H06.1.454.CMB.1.raw
  modified_base (491)..(491): a, c, t, g, unknown or other
  misc_feature (491)..(491): n is a, c, g, or t
  modified_base (605)..(605): a, c, t, g, unknown or other
  misc_feature (605)..(605): n is a, c, g, or t
tcagtactctcgtgcacgaccggtgctcgatttagatcacgtgcgtcgcggcgtagactttgtgtttctcgtagtctgctttgctcagcgtcagggtgctgctaatgctcgtgggtctcgtggatccaggtgggatagttgtggtgactcgagtcctaccacttcctcccgtcgcccgtctacttccgtaggacgacgtcccgtccctcctactcctaccgtcgactaacgttcgtagtacgacggaccgttccctacctaacgtaagtaacgttaacgtcggtaaccaacttaacgtttaaggtttcggaacggtttccggtaccgtacgaacggtaagaaccggtccggacgggtactacggttaccctaccgaacgccgttaccgtccgtacgttacgtttacgtttacgggttttacggtaccttaaccggggttcccggtcccggggtttccggtaccctagggtaaccggtacggtttaaccggnggtacggtaccgggtaggtaaccggttacgacggtaacggtaccgttaagtaacggtttaacttaaaccggtacgtaaaccgtaaagtaaccgtaacgggtaaggttaacgggngggttaaaccgcggtttaaaggtacgggttacggtttacgggttttaaacggttcgttaacggtacgtacgttaaaccggcgtaactaaaccggtttctaaaccgttaaccctaccgttaccgaccgggtacggtcgggaaggtaacccgtaggaaacgtggtacaaccgaacgtaaggtacgtcggttaacgtcgtactacccgtataccgttaccgtccgttacctcgttaacccgg

SEQ ID NO: 160370 - DNA, 687 bp, Homo sapiens
  misc_feature: GYAE6OF02GJ0YH.19.83.H06.1.454.CMB.1.raw
  modified_base (536)..(536): a, c, t, g, unknown or other
  misc_feature (536)..(536): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtcctccactctccctgcccgtcattcctggagagcccgtcctcatctcctgcaagtctagtcagacgcctacctacagttaagtaatggaaccaacctaaacttagttttacgggtaatttcgggtaaccttagacgaagaaacgacccgagggtactacggtcctacccgacgacgtccgtccgtagtactacttaggttttaggttactaagtcccggggtacccgttcccggggtaccgtacgacgtaggtcgtagtcggactaggtcgagttcgaacggacacgtaagttacgttttaaccaagtaacgaaactacgaaaccgtagaagggtcggaggtcgagtaagggtagttagggttacgggttttaaagtcgtaacgntaacgtagtaccgtaagtccgtaacgtaacctaactcccgtaacggttacggtacgggacggaaccggtaaggaagttacggtaacgacgtaacggtaaaccggtatacgggtgacgtagacctacgacttcgtagttacctcggttaacc

SEQ ID NO: 160371 - DNA, 768 bp, Homo sapiens
  misc_feature: GYAE6OF02JVK34.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctcgtgggtctctggactccgaggtggggtattattggtggttgaccttcagttcctacccacttcccttcccctcggtccccgttctactttcccgtggggaacgcggccccggcccttccacttcctccgtgactaacgttcttaggtacaggacgtcccctacctaactaattaagttaacgtacggaacctaaacctaactttagttttgggtaacgtttaccggttacctggacctaacggaacgacccggaggggtacctacggtacctaccccagacgtccttccgtagttaccttcgtttaggttttcggtttaccgtaacggttcccggggtcccggttcccgggtcctaggacgtcggttacagggtaccggtacgtggtacggtacgtccgtagggaccaacggttaacggtttaactttaaaccgtacgttaaacgaaacctaccgtaaacggtacggtagggtacggtacgggttacgtagggtaacggttaggttcgggttaggtttaactacgtcagtcgacctgaccgtacttaactacctaaccgtacccgacgttacggcggaacgggacgacgtagggtcgtagactaacggaacgtcgtcggtacctacgtcacgtcgtacgtactcgttacctaccgtc

SEQ ID NO: 160372 - DNA, 782 bp, Homo sapiens
  misc_feature: GYAE6OF02HHCAT.19.83.H06.1.454.CMB.1.raw
tcagtactctcgtgcacgaccggtgctcgatttagatcacgtgcgtcgggcgggcgtagactttgtgtttctcgtagtctgctttgctcagcgtcgacgggtgctgctaatggctctgggtctctggatccaggtggggtactagttgtggtgtactcagtcctcactcctccctgccctcacttccgtggagtcgccggtcccttccgattcctccgtagactaacgtctagtcagaccgtccctactacgataagtagtcggactaactaacttgtttaggtaactttcggtacctgaccaaggaccgaccgagggcctacggtctactacgcggtcctccgtagtcttacgttagttttcggtacttaacggtcccgggttacccgtcccggggttacctagtaaccggtcggtttacgacgggttacgggaccgtagggttacggtaacgtccggtaacgggtaccgtaaagttaacggtttacccgtttttaaccgaaccgtttaaacggtaaacctttaaccgaaacgggtacggtaacggggtttaacgggaacggttcgttagggtacgggttagttttacggggttttacgggtttaacttacgtcgtacttagtaccgtagtccgtaactaaccgtaccctaaccgtttccgtaacgtacccgggtttaacggcgggtaaaccggaacgtacggggtacgtaggtaaccttaacggaacccgttaaggttcgacgtccgtacgcctacgtcgttctacgtttctcccttacg

SEQ ID NO: 160373 - DNA, 712 bp, Homo sapiens
  misc_feature: GYAE6OF02I377H.19.83.H06.1.454.CMB.1.raw
  modified_base (246)..(246): a, c, t, g, unknown or other
  misc_feature (246)..(246): n is a, c, g, or t
tcagtactctcgtgcacgaccggtgctcgatttagatcacgtgcgtcgcgggcgtagactttgtgtttctcgtagtctgctttgctcagcgtcagggtgctgctaaatgctctgggtctctggactccaggtggggattattgtggtgactcagtcctccactcctccctgtccccgtctattacctggagacgcccggtcctccattcctcctgactaagtcttagtcaagactccctacctaanatagaactggaaccactaacttagtttggattcggtacctgacaaggaacgccgagggctacgtccctccaacgtgtcctccgtagtactttacgttaggttttcgggtaccttaacgggttcccggggtaccccgttcccggggttcctaggtaaccgtcggtttcgaacgggtgacgtaggtcgacgtagacgtacactaagttacttacacgtaagaaactaacgaagaggtagtaggtacgtacgtaggagggttagtttagggtttaggtttaacgttacgtgtacgtagtcgtactacgtacctacctaaaccgtacctacccgttaaccgtacccggttaccgggaacgggtaacggtaacggtaaggtaacgtaacgaacgtaaccgaaacgtacggtaccggtacgtccgtacgtacctaacgttacgttcccgttaacgttaccgtacttaacccg

SEQ ID NO: 160374 - DNA, 820 bp, Homo sapiens
  misc_feature: GYAE6OF02FI95G.19.83.H06.1.454.CMB.1.raw
  modified_base (272)..(272): a, c, t, g, unknown or other
  misc_feature (272)..(272): n is a, c, g, or t
  modified_base (511)..(511): a, c, t, g, unknown or other
  misc_feature (511)..(511): n is a, c, g, or t
  modified_base (625)..(625): a, c, t, g, unknown or other
  misc_feature (625)..(625): n is a, c, g, or t
tcagtactctcgtgcacgaccggtgctcgatttagatcacgtgcgtcggcgggcgtagactttgtgtttctcgtagtctgctttgctcagcgtcagggtgctgctaatcgctcgtgggtctctggactccaggtgggatattgtggtgactcgacgtcctcctactcttccctgccccgtactacttccgtgggaacgacggcccgggtcccttaccgatttccctacccgttaggcctaaacgttccgttacggttaccaacgggttaccncccctttaccgaactagttaaacggtttacgtaccggttaaccaaccgttaaaccgttttaagtttacggggacgttttaccggggttaccccctaggaccctaaggaaaccggtcccgaaggggtaccctacggttcctacccaacgtacgtaccctacgttagtaccttactttaacggttttcgggtacctaacgtccggggtcccgttcccggggttcctagaacgtcggttacncggttcggctagggtcgaacttcgcggactgtaacttaactttcaactacgtaatacaacgtaggacgtggacggacgtagtacgtaagttcggtttacggttacgttaacgtntacgacgtacggtaccgtaacgtaccgttaactaaccgtaaaccctcccggttaaacggttaacgttccggggaacgtaaccgggtaacgtaacggtacggtaccggaaccgtaacggtaaaccggtaacgttacggtaccggtaccgttcgaaccggtttaccgagtttccgtaccgttacgtccgttaacccg

SEQ ID NO: 160375 - DNA, 1041 bp, Homo sapiens
  misc_feature: GYAE6OF02FJ4YA.19.83.H06.1.454.CMB.1.raw
  modified_base (155)..(155): a, c, t, g, unknown or other
  misc_feature (155)..(155): n is a, c, g, or t
tcagtactctcgtgcacgaccggtgctcgatttagatcacgtgcgtcggcgggcgtagactttgtgtttctcgtagtctgctttgctcagcgtcagggtgctgactaatgctctgggtctctggatccaggtggggatattgtggtgactcatcnccacctctccctcgcccgtctacttccgtggacgacgccccggcccttccattcctcctcgtacaagtcgttagtcagtacgtccctcctacaagttaagtaagtcggaccaactaacttagtttaggagttcgtaccgtgacaacggaacgccggaagggtcctacgtaccctacccaacgtcgtccctccgtgtaactttaccgtttaaggtttttccgggtttaccttaacccggggttccccgggggttccccggttaccccgggggtttacccccgtacggtaaccggttacgggtttacccggaagggggtttccgggtaaccggttaacgggttcgggtaaacgttccgggaacggtaccgtaaacccgttaaaggttttaaccttttaaacccggaaaacgtttaaacgggaaacctaacccgggaaacggtacggggttaacgggtacgggggtaaccgggttacggttaagggtaaacgggggttttaaagggtttttccgggggttttaacgggggtttttaccctttaaaccgggtacgttaacccggttaacggttacccgtaaacgggtttaaccttaacccgttaaaacccgttttaaaacccccgttttaaaccccgggtttaaccccgggttttaaaccccggggtttaaccccgggggggtaacggggggttaaaacccggggttaaacgggttaaacggggtacccgggttaaacggggtaaaccgttaaaacccgggtaaacccggggttaaccggttaacggggttacccgggttaacccgtcccgggtaaacccgttacccttaccgggttttacctttaccccgggtttaacgttttaaccccttaccccgtttacccccggg

SEQ ID NO: 160376 - DNA, 800 bp, Homo sapiens
  misc_feature: GYAE6OF02GYPJS.19.83.H06.1.454.CMB.1.raw
  modified_base (150)..(150): a, c, t, g, unknown or other
  misc_feature (150)..(150): n is a, c, g, or t
  modified_base (173)..(173): a, c, t, g, unknown or other
  misc_feature (173)..(173): n is a, c, g, or t
tcagtactctcgtgcacgaccggtgctcgatttagatcacgtgcgtcggcgggcgtagactttgtgtttctcgtagtctgctttgctcagcgtcagggtgctgctaatgctctgggtctctggatccgagtggggatattgtggtgactnagtctccactctccctgcccgtnattccgtggagacgcccggcctccatcctcctagctaagtctagtcagacgccctcctacatagtaagtcggactaactaacttagtttggattacggttacctaggctaaggacgaccgaggggtctaggtcctaccacaacgtccctacgtgtaacttcgttacggttttagggttcctaacggtcccggggtacccggttcccgggggttacccctggtaccgttaggttcctagggtcgggcgtaggtacggtacgtacggaaccggtacgtaacgtaggttaactttaaacgaccgtaaagtaaacttaccgaaacgtagggtagggtacgggacgggttacgtaggtaagggtcggtttacgggtttagggtttaagttactagtacgtacgtacgaaccggttagtacgttaacctaaccgttaacccgttacccgtaccggtaaccggggtttccggggaaaccggggtaaccgggtaacccggggtaagggtagggtaacccggtaaacgttaaccggtaaaccggttaaccggttacggggttacgacccggttaaacggccccgttaacggtttacccttaccggttacgtttaccccgtaccgttttaaccccgg

SEQ ID NO: 160377 - DNA, 619 bp, Homo sapiens
  misc_feature: GYAE6OF02FXUFG.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctctgatctatttggttctaacgtcgggcctccgggtccctgacgtacggttcgagtcggcgaggtggactcgaggcacgtagtacttttacactagaaactacaacgagaggtaggaggcgtagaggtagttgggtttagggtttattacgtgtcgagttacgacgtaacgtaccttaccgtaactaaacccgttcccttaaccgttaaccgggttaccggggacggtaaacggggaccgtaaaggggtggtaacgaacgtaccggaaaacgtacggttacggtacggaccgttaggacccgaccgttacgtccgttacgttaccgtttctaacccg

SEQ ID NO: 160378 - DNA, 610 bp, Homo sapiens
  misc_feature: GYAE6OF02GVN1J.19.83.H06.1.454.CMB.1.raw
  modified_base (229)..(229): a, c, t, g, unknown or other
  misc_feature (229)..(229): n is a, c, g, or t
  modified_base (582)..(582): a, c, t, g, unknown or other
  misc_feature (582)..(582): n is a, c, g, or t
  modified_base (599)..(599): a, c, t, g, unknown or other
  misc_feature (599)..(599): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactcctccctgcccgtcattcctggagacgccggcctccatcctcctgctaacgtctagtcagacgcctcctanatagtatggacacactattggattggtacctgcaagaacgccgaggctacgtctccacacgtctcctagtattcgtattttcggggttactaacggtcgggtcccgttcccggggttccctcggacgtaggttccaggttggctaggtggtactcgaggtccaagtacttactttaaccgactacgtaaaacttcaaacgaggtacggtagggaggcttaggagttacggttgggttttagggtttacttacgtgtacgtagtcgtacgtactcttacctaaacgtaccctacctacggtaaccggtcgggacggaacggacgtaggaggtacgactacggaaactcgttggngtcagaccagtctcgtntcctcttaccg

SEQ ID NO: 160379 - DNA, 819 bp, Homo sapiens
  misc_feature: GYAE6OF02JZAZ5.19.83.H06.1.454.CMB.1.raw
  modified_base (152)..(152): a, c, t, g, unknown or other
  misc_feature (152)..(152): n is a, c, g, or t
  modified_base (245)..(245): a, c, t, g, unknown or other
  misc_feature (245)..(245): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggactccgaggtggggatattggtggtgactnagtctccacttcctccctcgcccgtctacttccgtaggacgacgtcccggcctccatcctccgtcgctaagtctagtcaggacgcctacctanataacgtagtcggaacactaacttagttaggtcgttacgtacctaggactaaggacggtaccgaggggtactacggtacctcccaaccggtacgtcccttaccggtatacgtttacctttaggttttacgggttaccttaaccgggtcccgggtacccggttaccccggggttccacggtaaccgttacggtttacggacggttcgggaccgtaggggtttacgaccgacggtaacggtaacctacggttaagttttaaacccgttttaacgaaaccgggtttaataaaaccgtaacgaaacggtaagggtaccgggtaacggtacggtaccgtaagggtaacgggtttagtttaggggtttaccggtttaagtttaaccggtagtacgttacggtactaccgtacggttacctaaccgtttaaccaacccgttaccgttaaccgtacgggtaccgggtaccggaacggttaaccgagggtaggacgtaacggtaaccgtaacgggttaacgttcggtacggtcgtaacgtacccgtaacgtggtttacccggtagtttccccgtaattccccg

SEQ ID NO: 160380 - DNA, 851 bp, Homo sapiens
  misc_feature: GYAE6OF02JMPEZ.19.83.H06.1.454.CMB.1.raw
  modified_base (182)..(182): a, c, t, g, unknown or other
  misc_feature (182)..(182): n is a, c, g, or t
  modified_base (190)..(190): a, c, t, g, unknown or other
  misc_feature (190)..(190): n is a, c, g, or t
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
  modified_base (485)..(485): a, c, t, g, unknown or other
  misc_feature (485)..(485): n is a, c, g, or t
tcagtactctcgtgcacgaccggtgctcgatttagatcacgtgcgtcggcgggcgtagactttgtgtttctcgtagtctgctttgctcagcgtcaggtgctgctaatgctcgtgggtctcgtacggatccgtaggtgggatagttgtggtagacctcgagtctccacgtcctccgtgccctnacttccgnggancgcgcctctanctcgtnacctaagtntaaggcacgacgtcctaccaggtataagttaacncggaactacgaacgttnttaggacttacgggtaaccctggaactaagtaacgacccgagggtactaacggtttaccaccgtaacgccggttcttacccgttaagtaccgttaccggtttaaggttttaccgggtaacctttaacgggtcccggggaaccccggtttcccgggggtaaccctaaggtacgtttaaccgggttaagacccggttcggggaattaaaccggggnggttaaaccgacggtaaacggacctaaaacggtttaacgtttaaccgtaaaccggtaaagtaaaacggtaaacgtaaccggtaaaggtacggtaacgggtaacgggtaaccgtagggtaaacggtttaggttaacgggttttacggtttaacggttaacgttacgtaccgttaacgtacgtaacggtaaacgtacgtaaccgttaaccgtaaacccgtaccgtaccggtacggtaacggtaccggaacggtaaacggtaacggtaaggtaccgtaacgaacgtaaaccggttaagtaaccgttcggtaacggtaccgttaacgtaccgttaacgtacggttaccgtacgttacctaccgttaaccg

SEQ ID NO: 160381 - DNA, 805 bp, Homo sapiens
  misc_feature: GYAE6OF02JCL6J.19.83.H06.1.454.CMB.1.raw
  modified_base (201)..(201): a, c, t, g, unknown or other
  misc_feature (201)..(201): n is a, c, g, or t
  modified_base (315)..(315): a, c, t, g, unknown or other
  misc_feature (315)..(315): n is a, c, g, or t
  modified_base (535)..(535): a, c, t, g, unknown or other
  misc_feature (535)..(535): n is a, c, g, or t
tcagtactctcgtgcacgaccggtgctcgatttagatcacgtgcgtcgcgggcgtagactttgtgtttctcgtagtctgctttggctcagcgtcagggtgctgctaatgctcgtgggtctcgtggactccgaggtggggatagttgtggtgtactcgacgttctccacctcctcccgtcgcccgtcattccgtaggacggngcccggcccttaccacgttctccgtcgaccgtagttactaacggtcaacggtacgtcccttacttacacgttaacgtaagtacggacaactagttagttacgagttacggtccngtacgtacgacgaccggtacgggctaggtcccttacgaccgtacggccttaccgtacgtacgtaccgttttaacggtttcgggttacccgtaacgggttcccgggtccccgttccccggggtaccgttcgacggttacccggtgtaacgggttccgaggttacggcggttaacgcgttaacggactacgtaacgttaacgtttaaccgagtaaccgtaanaaccggtaacgtagggacggtacgggtgacgtaagtccggtaaggtcgggttttaggtacttccgtagtgtacggttccgtaggtacctaacgttaccggaacctaccccggtttacgttaccggtaaccgggttgggtaaaccgggtccggtaacggttaacgggacgggtaaccgaaccgtaaacgggtaacccggttagtccgggttaacgcgttaaccggacgtaacccgttgtaccggtttacggtacccttaccggttaacccg

SEQ ID NO: 160382 - DNA, 714 bp, Homo sapiens
  misc_feature: GYAE6OF02GK5NM.19.83.H06.1.454.CMB.1.raw
  modified_base (525)..(525): a, c, t, g, unknown or other
  misc_feature (525)..(525): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccaggtgggatattgtggttactcagtctccactcctccctgcccgtcattccgtggagacgcccgcctccatcctactgactaagtctagtcaggactcctaccacataagtactaggaactaacaacttagtttaggtagttcgtaccgtgtacgaagaacgaccgagggcctagtcctaccacagtcctactgtatcgttagtttcggttactaacgtccgggtcccgtcccgggtcctaggaccgtggttacgtaggcgtatacggcgtacgtacgacgctaacgtagttactttaacgaactaagtaaacgtacaaacgtaggtacgggtaggtacggtcggtaaggtaggttaacgggtttacggtttaggggttttaacttacgttacgacgtnttaacgaacgaccgttaccgttaacaacccgtaaacccgttacccggtaaccggtaacggttaccgggaacgggaacggtaaaccggtagggtaacggaacgtactaaaccggtaacggtaacgtacgggtacgtcgtaaccgtcctaacgttacgttccgttacgttccgttacttacccttacccgg

SEQ ID NO: 160383 - DNA, 800 bp, Homo sapiens
  misc_feature: GYAE6OF02GEVPV.19.83.H06.1.454.CMB.1.raw
  modified_base (107)..(107): a, c, t, g, unknown or other
  misc_feature (107)..(107): n is a, c, g, or t
tcagtactctcgtgcacgaccggtgctcgatttagatcacgtgcgtcgcgggcgtagactttgtgtttctcgtagtctgctttgctcagcgtcagggtgctgctaangctctgggtctctggatccaggtggggatattgtggtgactcagtctccactctccctgcccgtcattccgtggagacgcccggcctccattcctcctgacaagttcctagtcaggtacgccctacctacattagtaacgtcggaaccaacctaacttagttttaggacgtttgggtaacctggactaaggaacgccgagggcaacgtcctccacgacgtccttcctagtacttccgtttaggttttcggggttacctaacggtcccgggggtcccggttccccgggggttcccctagggtaaccgtacggggtttacgacgggttcgggtacctagggttagggaactacgacgggactaacgtaacggttttaacttttaaccgtaacgttaaacggtaaaaacgttaccgaaaaccggtaagggtacgggtagggtacggtacggttaaggggaagggtttacggttttagggggttttaaggggttttaacctttacggtcgtacgtagtcggtaacgtaacgtacttaaccgtaaacctaacccgttccctaacggttaaccgggtttcggggaagggtaaccgggaaccggttaagggtaccgaacgtacgtaaccggtaaaccggtagttccgggtacggtacgtaccgaactaccgtcgttacgttaccgttcccttacgtcccg

SEQ ID NO: 160384 - DNA, 534 bp, Homo sapiens
  misc_feature: GYAE6OF01BXGWM.49.79.H02.1.454.CMB.1.raw
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (446)..(446): a, c, t, g, unknown or other
  misc_feature (446)..(446): n is a, c, g, or t
  modified_base (460)..(460): a, c, t, g, unknown or other
  misc_feature (460)..(460): n is a, c, g, or t
  modified_base (463)..(463): a, c, t, g, unknown or other
  misc_feature (463)..(463): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagcgtggtttcgcgtagctctttaagaggtgtccagtgtcaggtgcagctggtggagtctgggggagcgtggccagcctgggaggtccctgagactctcttgtgctgcctctggattcaccttnagggtctatgacatgcactgggtcccncgagctccgaggcgaagggctgggaggtgggtgatagtttatactnatatgataggaanacgaaagtataagtactagtagtacgtacgtacggtaggaacgggtctattacatcactctacagacacaacgtacgaacacacgntagtactctacganaanacgaacgagacgtagagagacgtagaagacgacgtacgttacttacttacgtagtacgtagtaacgtaacg

SEQ ID NO: 160385 - DNA, 541 bp, Homo sapiens
  misc_feature: GYAE6OF01DFXM0.49.79.H02.1.454.CMB.1.raw
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
  modified_base (438)..(438): a, c, t, g, unknown or other
  misc_feature (438)..(438): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgcttcttttaagaggtgtccagtgtcaggtgcagctggtggagtcgtgggggagcgtggtccagccgtgggacgtccctgagactctcttgtgctgcctctggattcaccttcgaggtctatgacatgcacgtgggtcccgcaggtctccgaggcaaggggcngggaggtgggtgctatttananctatatgatgggaancgaaagatatactagtgtagacgtccgtagaacgggtctattcatcatctcagagaacacaccgagaacncgctagtattcagacaagtgaacgaggcagagacgtcgtaagaacggtacgtaacggttactttaagttacttaacgtaggtacgtaacgtaacgttaaacgg

SEQ ID NO: 160386 - DNA, 798 bp, Homo sapiens
  misc_feature: GYAE6OF01EHDXL.49.79.H02.1.454.CMB.1.raw
  modified_base (198)..(198): a, c, t, g, unknown or other
  misc_feature (198)..(198): n is a, c, g, or t
  modified_base (690)..(690): a, c, t, g, unknown or other
  misc_feature (690)..(690): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcacatggaatttggctgagcttgggttttcctcgttgcttcttttaagaggtgtccagtgtcaggtncagcgtgggtggagtcggtgggggaggtcggtcggtccaggccgtggggacgtcccctggacgtacttccgtcgttgtcgccgttgcccttcgtggtactttccaccgtttcgagggttcctatcgactatgccacggtcgggtcccgccgacggtcctaccggaacgggacggaaacggggggtccgttagggggtaaggggttcggggttacggacctttaaagtttttaacgttaacgtacgtaaatttaaggtaaggtaagttaacggggaaaaggtacgtaaaaaggtatttaaacgttaacgttagtttacggtaacggtacccgttaccgggtaagggtaaaccgggtccgttaactttaccgaaattcccgtaaactttcccgtaacccgaaggtaaccgtaaacccttaaccgaaccccggaaataaaccggtacgtaccgtttaggtaacctccgttaagaacctaaaagtacggaaaccgngggtcctaaaggaggtaacggcgttaaaggaaccggtaacccgttacggtttacgttttaaactacgttttaaccgtggtttaccgaaaccggttaaacgttaaccgg

SEQ ID NO: 160387 - DNA, 559 bp, Homo sapiens
  misc_feature: GYAE6OF01CO93V.49.79.H02.1.454.CMB.1.raw
  modified_base (369)..(369): a, c, t, g, unknown or other
  misc_feature (369)..(369): n is a, c, g, or t
  modified_base (488)..(488): a, c, t, g, unknown or other
  misc_feature (488)..(488): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtcgtgggggggcgtggtccagccgtgggaggtccctgagactctcttgtgctgcctctggattcaccttcaggtctatgacatgcacgtgggtccgccgaggcctccgaggcgaaggggctgggaggtgggtgctatttatagtcatatgagtaggaancaagatatactagtgtagactcggtagaacgggtccgattcgatcgactctaccgagacgaccaaccgtccgaagaacacgtctagtatcgtagacaaagtcgaacaggctaggaacgngacgtagaacgtaccgtcggttactttaagttacttacgtagttagtaaccgttaaacgttacgtaaccgg

SEQ ID NO: 160388 - DNA, 546 bp, Homo sapiens
  misc_feature: GYAE6OF01BGYWF.49.79.H02.1.454.CMB.1.raw
  modified_base (278)..(278): a, c, t, g, unknown or other
  misc_feature (278)..(278): n is a, c, g, or t
  modified_base (305)..(305): a, c, t, g, unknown or other
  misc_feature (305)..(305): n is a, c, g, or t
  modified_base (352)..(352): a, c, t, g, unknown or other
  misc_feature (352)..(352): n is a, c, g, or t
  modified_base (368)..(368): a, c, t, g, unknown or other
  misc_feature (368)..(368): n is a, c, g, or t
  modified_base (416)..(416): a, c, t, g, unknown or other
  misc_feature (416)..(416): n is a, c, g, or t
  modified_base (486)..(486): a, c, t, g, unknown or other
  misc_feature (486)..(486): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctgggtggagtcgtgggggagcgtggtccagcctgggagtccctgagctctcttgtgctgcctctggattcaccttnagggtctatgacatgcagtcgggtccnccaggcctccagggccaagggggtctgggagtcgggtggctatttanatcatatgagtggaancaaggtatatatatagtagtactcgtgaagggcctagttcatcactcncagacgaactaactcgaagaaccacgacttagtactactgaacaatacgaaacgtggcctagaaggacgntaggaacgacgtaccggttactttaagttacttagtagtcgtaacgttaaacgttaaacg

SEQ ID NO: 160389 - DNA, 584 bp, Homo sapiens
  misc_feature: GYAE6OF01B0VCF.49.79.H02.1.454.CMB.1.raw
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtcgtgggggagcgtggtccagccgtgggacggtccctgagactctcttgtgctgcctctggattccacctttcgagggttctatgactatcgcacgtcgggtcccgccgaggcctccgaggcgaagggctggaggtgggtgctatttatatcatagtagtagtggaagcaagtatatactatagtagtacgtccgtaggaacgggtccgtattcatcattcctaccgagacgacaacctccgaagacacgactgtatctagactaagtacgaacgaggcctaggaggacgtaccgtagggaaacgtcggtaaccggttacttttaagttaacgtttaccgtaggttacgttaaacggttaaaccgttaaaccgg

SEQ ID NO: 160390 - DNA, 549 bp, Homo sapiens
  misc_feature: GYAE6OF01AS6XI.49.79.H02.1.454.CMB.1.raw
  modified_base (312)..(312): a, c, t, g, unknown or other
  misc_feature (312)..(312): n is a, c, g, or t
  modified_base (352)..(352): a, c, t, g, unknown or other
  misc_feature (352)..(352): n is a, c, g, or t
  modified_base (388)..(388): a, c, t, g, unknown or other
  misc_feature (388)..(388): n is a, c, g, or t
  modified_base (433)..(433): a, c, t, g, unknown or other
  misc_feature (433)..(433): n is a, c, g, or t
  modified_base (482)..(482): a, c, t, g, unknown or other
  misc_feature (482)..(482): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagcttgggttttcctcgttgcttcttttaagaggtgtccagtgtcaggtgcagctggtggagtcgtgggggagcgtggtccagccgtggggacggtccctgagactctcttgtcgctgcctctggattcaccttcagggtctatgacatgcacgtgggtccncaggctccgaggcgaaggggctggagtgggtgctatttanagtcatagtgatggaagcaagtatagtactatgtanacgtcgtagacggcatcatcatcacagacacaacgtcgaagaacncgtactgtactctagactaagtacgtaagacggtcgtaggaacgtacgngttaggaacgtaccgtacgggttactttaagttacttacgttaggtacgtaaccgtaaattaaccgg

SEQ ID NO: 160391 - DNA, 551 bp, Homo sapiens
  misc_feature: GYAE6OF01A4PJV.49.79.H02.1.454.CMB.1.raw
  modified_base (289)..(289): a, c, t, g, unknown or other
  misc_feature (289)..(289): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (404)..(404): a, c, t, g, unknown or other
  misc_feature (404)..(404): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (453)..(453): a, c, t, g, unknown or other
  misc_feature (453)..(453): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtcgtgggggagcgtggtccagcctgggagtccctgagactctcttgtgctgcctctggattcaccttcgagggtcctangacagtgcgacgtgggtcccgccgaggcctccgaggcgaagggggcttgggaggttggggtggctagtttanattcgaattangtaagtggaaagcaaaggtatatacgatgtanactcggtagacgggctatnatnatctccagacgacaactccgaagaacncgtactgtatcagaacaagtacgaagacgcgtagacggagctaaggaacgtacgacggttactttagtacttactaggtacgtaacgtaaacttaacg

SEQ ID NO: 160392 - DNA, 562 bp, Homo sapiens
  misc_feature: GYAE6OF01D9VOI.49.79.H02.1.454.CMB.1.raw
  modified_base (307)..(307): a, c, t, g, unknown or other
  misc_feature (307)..(307): n is a, c, g, or t
  modified_base (323)..(323): a, c, t, g, unknown or other
  misc_feature (323)..(323): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
  modified_base (485)..(485): a, c, t, g, unknown or other
  misc_feature (485)..(485): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctgggtggagtcgtgggggaggcgtggtccaggcccgtggggacggtcccctgacggactctcttgtgctgcccttctggatttccaccttcgagggtctatgacntcgcacgtcgggtccnccaggcctccgaggcaaggggctgggagtgggtgctagtttanatcatntgatggaancaagattatatatagtacgactccggtagacgggctatcatctactctccgaagacgaaccaacgtccgaagaacacgctagtatccgagtacaatacgaacgngctagaggacgtctaaggaacgaccgtacggttactttaagtacgttaacgttggtacgtaccgtaaattaaccggg

SEQ ID NO: 160393 - DNA, 783 bp, Homo sapiens
  misc_feature: GYAE6OF01A5WVN.49.79.H02.1.454.CMB.1.raw
  modified_base (203)..(203): a, c, t, g, unknown or other
  misc_feature (203)..(203): n is a, c, g, or t
  modified_base (266)..(266): a, c, t, g, unknown or other
  misc_feature (266)..(266): n is a, c, g, or t
  modified_base (545)..(545): a, c, t, g, unknown or other
  misc_feature (545)..(545): n is a, c, g, or t
tcagagtcgagagacacgaccggtgctcgatttagtgtcacacgaagggaaaggggagctctgggagaggagccctagcactagaagtacgggagggtgcttccattcggtgtatcacgccactgaacacagaggactcaccagtggtaagtttgggctggagtcgttgggttttcctcgttgcttacgttttaaggaggttntccagtgtcgaggtgcagcgtggtggagtcggtggggagcgtggtccagccgtgggacgtccngacgtactctgttgtcgctcgtccttgtacggtactttccgtaacccgtttgacgggttccttaagtcggtaactagtcgggtacctaaccgggtttcccggggccccggtaaccgaccggggtccccttacccgggaacgggacgggtaaaacgggggggtccttaaggggggtagggttcgggggtagtaaccttaagtttttaaacggacttacgtaaagttagtaggaagttagggaaacctagaaagtattaaactacgttaagtacggttaanacccgggtttacggaacggtaaccggggttctaacgttaccgaattaccactttacccgaacggaacgtaaacggaacctaacgtaccggaaagtaccgtaacgtcgtttaagtcttaacggtactaaataacgtacgaaacgtcggaacgtaggagaacggtaaccgaggtaacggaaccgttacgttaattttaacgtacgtttacggtagtaccgttaaacgttagtaacccggg

SEQ ID NO: 160394 - DNA, 818 bp, Homo sapiens
  misc_feature: GYAE6OF01D45BF.49.79.H02.1.454.CMB.1.raw
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagtcgttgggttttcctcgttgcttcttttaaggaggtgtccaggtgtcgaggtgcagcgtgggtggagtcggtggggggaggcggccggtaccaggcccgtggggacggtccctggacgtaccttcgtcgttggtcgcttcgcccttcgtgggtactttccaccgtttcggaacggggttcttaagtcggtaactagttcgccgtacggttcgggggtccccaccgacgggtcccttaccggaagggtaccggaaaggggggtcccttaggggggacgggttggggggtacggtacctttaaaggtttttaactattaccgtaagtttaacgtaaggtaacggttaggggaaacgaccgtaaaaggtaattaaagtttaacctagttaggttaacggaccgtttaccgggtagggaaaccggggtcccgtaattacgacttaccgtacttaccgtaacccgaagtaacgaacccaaaccgtccggaaacgaaccgtaccggtacttacggttaacgttcgtaacgtaaccgaaagttacggaaaacgtacgggtaacctaggaaacggtacggtaacggttaacggaacggtacccggtaaccggtttacttttaaagtacgtttaacgtacgggttaacggtaaaccgtttaaacgttaaaccggg

SEQ ID NO: 160395 - DNA, 665 bp, Homo sapiens
  misc_feature: GYAE6OF01AV1J1.49.79.H02.1.454.CMB.1.raw
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagcttgggttttcctcgttgcttcttttaagaggtgtccagtgtcaggtgcagcgtggtggagtcgtgggggaggcgtggtccagccgtggggacggtccctgacgactctcttgtgctgcctctggtattccaccttcgagggtctatgacatgcacgtgggtcccgccaggtcctaccgagggtcgaagggggtctaggggacggttggggtggacttattttaagtatactaatacgttagagttaggggaaacacgtaaagattacttaactagttacgtaacgtaccgtccggtagggtaaacggggcccgtaattacgagttacctacgtccctaccgaagtaaccgtaacctaacccgtacccggaacgtaaccgacgtaccgttagtactccgtagtaacctaaagtacggaacgtaggcgtaggaagacgtacgtaaggaagtacccggtaacgttacttttaacttaacgttacgttaggtacgtaaccgttaaacgttaaccgg

SEQ ID NO: 160396 - DNA, 782 bp, Homo sapiens
  misc_feature: GYAE6OF01EHE0B.49.79.H02.1.454.CMB.1.raw
tcagagtcgagagacacgaccggtgctcgatttagtgtcacacgaagggaaagggagctctgggagaggagcccagcactagaagtcggcggtgcttccattcggtgatcagcactgaacacagaggactcaccatggaatttgggctgagcttgggttttcctcgttgcttcttttaagaggtgtccagtgtcaggtgcagctggtggagtcgtgggggagcgtggtccagccgtgggacgtcctggacgactctcttgtgctgcctcgtggtacttcgacctttcgagggttctagtgactatcgccgtacgttcggggtacccgccgacggtcctaccggacgggacgaaagggggtcgttagggacggttggggtacggtacgtaattttaacgtacgtacgtaacgtaagtaggtaagtaggggaacgtacgtaaagtaagttaacttaactagttagttaagtaccgttaccggtagggaacgggtacccgtaacttacgtaaacgtactacctacccgtaaccgtaaacggaaccgtaacccgtaaaaccggttacccggaaacgtaaaccgtacccggtacttacggttaaccttaccgttacggaaaccgtaaacgtaaacggaaaccggtaacggggtaacgtacggaaaacgggtacgtaaccgggttaaacggaaacggttacccggttaaaccggtttaacttttaaacgttttaacgtttaaccgggttaagtttaacgggtaaaccgttaaacgtttaaaacccggg

SEQ ID NO: 160397 - DNA, 684 bp, Homo sapiens
  misc_feature: GYAE6OF01CVOJB.49.79.H02.1.454.CMB.1.raw
  modified_base (198)..(198): a, c, t, g, unknown or other
  misc_feature (198)..(198): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagagactcaccatgaatttgggctgagtcgtgggttttcctgttgcttcttttaagaggtgtccagtgtcaggtncagctggtggagtcgtgggggagcgtggtccagccgtgggacgtcctagagactctcttgtcgtctgtcctgtagtattccacttgaggtactatgactagtgactacgcgggtccgccaggctaccgaagggcgtaaaggggctagggtaggtcgggtatacgttaaatttaacgtaactacgtaattaaggtcgaagttacggggaaactaaacgtaaagtaaattagttaactagtaggtaacgaccgttaccgaaggtaacggtacctaagttacaacgtccaacgtacctaaccgaagaaccgtaacctaaaccgtaccgaaacgtaacctaccgtacgttaacgtaacgttactacgtaaactaaaacggtggaaacctaggtaccagggtaacgcgtaacgtaaggaaacgaaaccgttaggttaccttttaaaagtccgtttaaacgtgttaaacggtaaaccgtaaaagttaaacgg

SEQ ID NO: 160398 - DNA, 772 bp, Homo sapiens
  misc_feature: GYAE6OF01A35YA.49.79.H02.1.454.CMB.1.raw
  modified_base (197)..(197): a, c, t, g, unknown or other
  misc_feature (197)..(197): n is a, c, g, or t
tcagagtcgagagacacgaccggtgctcgatttagtgtcacacgaagggaaagggggagctcgtgggagaggagcccagcgactagaacgtcggcggtgcttccgattcggtgatcagcacctgaacacagaggactcaccgtagtggaatttgggctgacgtcgttcgggttttcctcgttgccttcgttttaagnggtgtccagtgtcaggtgcagctggtggagtcggtgggggacgtcggtcggtaccagtccgtggggtacgttcccgtaggtacgtacttcgttcgttgtcgtctcgtcctcgtaggtacttccaccgttcgacggtcctaagtgactagtcgtacgtacggtcgggtcccgaccgacggtcccgtaccggacgggtacgggtaaacggggtcgttacgggtgggtacgggttcgtacttaagtttactacgtctaagtacgtacggtaaggtacggaaacgacgaaactactaattaaccgttagtacgttacgtaccggttacggtacgggtaacggtcctaacgtactagtacgtactcgtactaagtaaccgtacgaccgtacgaacgacgtacgtacgtacgtactcgacgtaacctaaggtacccgtaaaggtacggtacgaacgggtaaccgtacggtaacgtaaccgggtaaacccggtacggtttaaacccggttacgttttaaaacgttaacccggttaacccggttaacgttaaccggtaaaaccggtttaaccggtaaaccggg

SEQ ID NO: 160399 - DNA, 812 bp, Homo sapiens
  misc_feature: GYAE6OF01A2YST.49.79.H02.1.454.CMB.1.raw
tcagagtcgagagacacgaccggtgctcgatttagtgtcacacgaaagggaaaggggagctctgggagaggagcccagcactagaagtcggcggtgtcttccattcggtgatcagcactgaacacagaggactcaccatggaattgggctgagtcgttgggttttcctcgttgcttacttttaagaggtgtccagtgtcgaggtgcagtcgtgggtgggtacggtcggtagggggaggtcggtcggtccgaggtcccggtggggtacggtcccgtggtacgtacttcgttcgttgtgtccgtcgtcctcgttaggtacctttacctaccgtttacggtacgggttacctagttacgactaggttcgtacccgtaccggtccggggtaccccgtcccgtaccgggtccgtacccggaacgggtaaccgggtaacgggggtccggttaggggtacgggttcggggtacggtactttaagttttaactaacgtaccgttaaaggttaagttaggtaaacggttaaggggaaacgtaaacgtaaaacggtaactttaaacgttaacgtttaagttacgggttaaacccgtaaccggttaccgggttaaggtaaaccgggttcgtaaccgttaacttacgtaaccgttaccgtacttaacccgccgaaacgacgtaaccctaccggtaacgaacgacctaggtcttacgtactgactaataacgaacgtcgaagtccaagggtaacgtcgtaggaaggtaaccgtacggtaacctttattaaacgtcgtttaaacggtttaaaccgaacttaaacgg

SEQ ID NO: 160400 - DNA, 734 bp, Homo sapiens
  misc_feature: GYAE6OF01BIGBM.49.79.H02.1.454.CMB.1.raw
  modified_base (394)..(394): a, c, t, g, unknown or other
  misc_feature (394)..(394): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagcttgggttttcctcgttgcttcttttaagaggtgtccagtgtcaggtgcagctagtggagtcgtgggggagcgttggccaggtccgtggggaggttcccctaggacgtacttcgtcttgtcgctggccttcgtggtactttccgaacctttcgagggttcctatgactagtgcctacgtcgggcccaccgaggctccgaggccaagggggtcctgggaggtcggggtgactaagttttaagntcgtaagtacgtagtacgtaggggaaactaccgaaaggtaacttagttacttaagtacgggttaacgaccgtttaccggtaagggaaccggggtacgtacgttacgtaacttacaagtttccctaaccggaacgtaacggtaacctaaacccggtccggaaaagtaacccgtaaccgtctttaacgtaagttcccgtaaggtaaccgaaacttacgggaaacgttacgggtacgtagggtaaccgaaccgtaggtaaacgggaacgaacccggttacggttaactttttaaacgttaccttaaggtttaggaccttaacgggttaaaaccctttaacggg

SEQ ID NO: 160401 - DNA, 755 bp, Homo sapiens
  misc_feature: GYAE6OF01D2CRH.49.79.H02.1.454.CMB.1.raw
  modified_base (123)..(123): a, c, t, g, unknown or other
  misc_feature (123)..(123): n is a, c, g, or t
tcagagtcgagagacacgaccggtgctcgatttagtgtcacacgaagggaaaggggagctctgggagaggacgccagcactagagtcggcggtgcttccattcggtgatcagcactgaacacngagctcaccagtggatttgggctgagtcgttggggttttccctgttgtactttacgttttaaggaggttcgtcctaggtgtcgtaggtgcaggtcgttgggtagggacggtcgggtggggggacggtcggtcggtaccgcggtccggtggggaccgtcccgtaggacgttcttcgtcttgtcgctcgtccttcgtagtacctttcgtccgttacgtaggtctagtcgtacgtagtcgccgtaaccgggttcgggcccgtaccgtacgtccgtaccgacgggaacgggtaagggtccggtagggtagggttcgggtaggtactaagttttagactactaattaggtagacggtaagtcgtaagaagtaacttagtaacttagttacgtacgtaccgtacggtagggtaaccggtaccgtatacgtactactactacctacgtaacgaaccgactaccgtaacccgaaacgtccgaacgtcgttaacgtacgtaacgtacgaacgttaacgacgtaaacggtagtaccggtacggtacggtaacggtacggtaagaacggtaccgttaaacgggttacttttaaacggttacggttaaccgttaggttaaacctacggttaaacgttaaccggg

SEQ ID NO: 160402 - DNA, 653 bp, Homo sapiens
  misc_feature: GYAE6OF01B7211.49.79.H02.1.454.CMB.1.raw
  modified_base (246)..(246): a, c, t, g, unknown or other
  misc_feature (246)..(246): n is a, c, g, or t
  modified_base (263)..(263): a, c, t, g, unknown or other
  misc_feature (263)..(263): n is a, c, g, or t
  modified_base (580)..(580): a, c, t, g, unknown or other
  misc_feature (580)..(580): n is a, c, g, or t
  modified_base (587)..(587): a, c, t, g, unknown or other
  misc_feature (587)..(587): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagagactcacatggaatttgggctgagtcgttcgggttttcctcggttgtctttcgttttaaggaggttcgtccgagttgcaggtgcagtcgtggtggaggttcgtgggggagcgtggtaccnggccgtgggacgttccngagcttctcgttgcgcttcgcttcgtaggtacttccaccgtttgaggttctagtagaactagtgtaccgtcgttcggccggaccgaaggtcccgaccggtaagggaccgaaggggtcgtagggtacgggtgggtgtacttagttagtattagaattagagtacttaaggactagaaacgataacgttacagtggtaacgccgtgtaaggacgggtactatctagtacacgttaccacgtaacgaccgaaacgttaaccgacgtaacgaacgtacgtattacgtagtacctaggaaccttaagaacgaacgtacggtnaaacggnaacggtgaacgaacggtactagtttaacttacgttaacttacgtggaaccttagtaaaattacggg

SEQ ID NO: 160403 - DNA, 732 bp, Homo sapiens
  misc_feature: GYAE6OF01AVC70.49.79.H02.1.454.CMB.1.raw
  modified_base (659)..(659): a, c, t, g, unknown or other
  misc_feature (659)..(659): n is a, c, g, or t
tcagagtcgagagacacgaccggtgctcgatttagtgtcacacgaagggaaaggggagctctggggagaggacgcccagcactagaagtcggcggtgcttccattcggtgatcagcactgaacacagaggactcacatggatttgggctgagtcgttgggttttcctcgttagtctttcgtttaaggtaggtcgtcctagtgtccgtaggtgctacggtcgtgggtacgggtaggtcgggtaggggggacgtcgggtggtacccaagggtccggtgggggtaaccggtccttggaacggtccttcgttcggttcgtcgtccgtcggtccttcggtcggttacttccggtaccttacggtcgggtacttcgacgacgtagttcgaccgtcggtccgggtaccgtccgacggtcgtaccgagggacccggtaaggggtccgtagggtcgggtgggtacgtacgttaactttaaggttaacctacgttagtacggttaggaacggtagaacgtaagtaacgtagttaactacgttaagtggttacgtaacgtcggtaaggactacgtacgtatacgtatacctacgtacaaggacaaccgtaacgagttacactcgtatcgtaactgtaacgataaccgttacgaaacgttgtacacggtanacggtacgtacgaacgtacgaacgtttacgtaacgttaacgttattacggaacttaaacgttaacgtaaacgg

SEQ ID NO: 160404 - DNA, 503 bp, Homo sapiens
  misc_feature: GYAE6OF02H0GUI.49.79.H02.1.454.CMB.1.raw
  modified_base (361)..(361): a, c, t, g, unknown or other
  misc_feature (361)..(361): n is a, c, g, or t
  modified_base (472)..(472): a, c, t, g, unknown or other
  misc_feature (472)..(472): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtcgtgggggagcgtggtccagcctgggaggtccctgagactctcttgtgctgcctctggattcaccttcagggtctatgacatgcactgggtccgccaggctccaggcaaggggctgggagtgggtggctatttatatcatatgatggaancaagatatactatgtagactccgtgaagggcgattcatcatctccagacgacaactcgagaacacgctgtatctgacaaatgaacagctagagagctagaagacgacggtntttatacttacttagtagtacgtaattaacg

SEQ ID NO: 160405 - DNA, 658 bp, Homo sapiens
  misc_feature: GYAE6OF02G39AN.49.79.H02.1.454.CMB.1.raw
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagcgtggtttccgtcgttaggctctttaagaggtgtccagtgtcaggtgcagctggtggagtcgtgggggaggcgtgggtccaggccctggggaggtccctgagactctcttgtgctgcctctggattcgaccttcagggtctatgacatgcacgtgggtcccgccaggcctccgagggccaaggggtctggggacgtggggtcggctatttatactctaatatgagtggaaagacaaagtattaactaactagttagtaagtcctaccggttggaaacgggtccgtaacttcgaatccaacgttcctacccgaagacgtaactaacctacccggaaacgaaccgaccgtaccgttagttaacgtccgttacgacgtaaaagttacggaaaccgaagggtaccgttagggaaggtaaccggacgttaagggaaacggtaccgtaaccgggtttacttttaacgttaacgtttaccgttacggtacggttaccgttaaactttaaccgg

SEQ ID NO: 160406 - DNA, 531 bp, Homo sapiens
  misc_feature: GYAE6OF02GUJZY.49.79.H02.1.454.CMB.1.raw
  modified_base (352)..(352): a, c, t, g, unknown or other
  misc_feature (352)..(352): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtctgggggaggcgtggtccagcctggggaggtccctgagactctcttgtgctgcctctggattcaccttcagggtctatgacatgcacgtggggtccgccaggcctccgaggcaagggggctgggagtgggtggctatttanatcatatgatggaagcaagatatactatgtagactcgtaggaacgggccattcatcatcctcagacgacaacgtccgagaacacgctagtatctagaccaaagtcgaaacgaggctagagagtcgtagaacggacctacggtactttaatacgtttacgtgtacgtacgtaattaacgg

SEQ ID NO: 160407 - DNA, 632 bp, Homo sapiens
  misc_feature: GYAE6OF02HPH34.49.79.H02.1.454.CMB.1.raw
  modified_base (299)..(299): a, c, t, g, unknown or other
  misc_feature (299)..(299): n is a, c, g, or t
  modified_base (395)..(395): a, c, t, g, unknown or other
  misc_feature (395)..(395): n is a, c, g, or t
tcagagtcgagagacacgaccggtgctcgatttagtgtcacacgaagggaaaggggagctctgggagaggagcccagcactagaagtcggcgttgcttccattcggtgatcagcactgaacacagaggactcaccatggaatttgggctgagcggtggtttcgcgtaggcgtctttaagaggtgtccagtgtcaggtgcagctggtggagtcgtgggggaggcgtggtccaggcctggggaggtccctgagactctcgttgtgctgcctctggattcacctttcagggtctagtgactntgctacggtcgggtcccgccgacggcctaccgagggcggaaggggtcgtggggtaggtgggtggacttagtttatatactatagtagagtagaganaagtatatactagtagtacgtacgtacggtaggacgggcgtatacgtatactacgtacctacgacgacgaaccgtaaccgtaccggaacgaaaccgtacgtaccgttacgtacttaccgtagtaaaccgtaaagtaacggaaccgtaaggtacgtaggaagacggtaacgtaaggaacgaacgtacggttactttaacgttacgtttacgttaggtacggtaacgttaacgttaacg

SEQ ID NO: 160408 - DNA, 518 bp, Homo sapiens
  misc_feature: GYAE6OF02FS86S.49.79.H02.1.454.CMB.1.raw
  modified_base (306)..(306): a, c, t, g, unknown or other
  misc_feature (306)..(306): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtctgggggagcgtggtccagcctgggaggtccctgagactctcttgtgctgcctctggattcaccttcagggtctatgacatgcacgtgggtcccnccgaggcctccgaggcaaggggctgggagtgggtgctatttanatcatatgatggaancaagtatatactatgtagactcgagagggcatcatcatctcagacgacactaccgagaacacgctagtatcgtgacaaatcgaacgagctagagagctaggaacgacgtacggtacttttaatacgtttacgtggtacggtacgtaacttaacg

SEQ ID NO: 160409 - DNA, 601 bp, Homo sapiens
  misc_feature: GYAE6OF02IOQC2.49.79.H02.1.454.CMB.1.raw
  modified_base (176)..(176): a, c, t, g, unknown or other
  misc_feature (176)..(176): n is a, c, g, or t
  modified_base (217)..(217): a, c, t, g, unknown or other
  misc_feature (217)..(217): n is a, c, g, or t
  modified_base (268)..(268): a, c, t, g, unknown or other
  misc_feature (268)..(268): n is a, c, g, or t
  modified_base (364)..(364): a, c, t, g, unknown or other
  misc_feature (364)..(364): n is a, c, g, or t
  modified_base (509)..(509): a, c, t, g, unknown or other
  misc_feature (509)..(509): n is a, c, g, or t
  modified_base (516)..(516): a, c, t, g, unknown or other
  misc_feature (516)..(516): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaattggctgagctgggtttcctcgttgctctttaagnggtgtcagtgtcagtgcagctggtggagtcgtgggggaggnggtgggtccagccgtggggacggtccctgagactcgtcttgtgctgccctntggactttcaccttcaggggtctatgacatgcactcgggtccgccaggcctccgaggcgtaaggggctgggagtgggtgactagttatagtcatangatgggaaagtcaagtatatactagtacgtagaccgtcggtaggaacgggtccgtatttacacgtactacgtcctaccagaacgtaccaacgtacgaacgtaaaccacgtcgtacgtaagtccgtaagacaaaactcgaaaaccncgggtanacggtaaggacgactaacgtaaacggaacctaacggtacttttaacgtactttaacggtcggttaacgtacccgtaaatttaacg

SEQ ID NO: 160410 - DNA, 529 bp, Homo sapiens
  misc_feature: GYAE6OF02JAPCS.49.79.H02.1.454.CMB.1.raw
  modified_base (306)..(306): a, c, t, g, unknown or other
  misc_feature (306)..(306): n is a, c, g, or t
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
  modified_base (494)..(494): a, c, t, g, unknown or other
  misc_feature (494)..(494): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtcgtgggggagcgtgggtccagcctggggagtccctgagactctcttgtgctgcctctggattcaccttcagggtctatgacatgcactgggtccnccaggcctcgaggcaagggctggagtgggtgctattatatcatatgatggaagcaagatatactagtgtacgtactcgtaggaacgggcattcatcatcncganagacaactccgagaacacgctagtactacgtgaacaaagtcgaacgaggtctaggagacgtcgtaaggaacgtacgaacggttntttactacgttacttgtacgtaccttaagttaacg

SEQ ID NO: 160411 - DNA, 642 bp, Homo sapiens
  misc_feature: GYAE6OF02FY07E.49.79.H02.1.454.CMB.1.raw
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtcgtgggggaggcgtggtccagccgtgggacggtccctgagactctcttgtgctgcctctggacttcacttcagggttctatgacatgcacgtcgggtcccgccaggcctcccgagggccgaagggggcctggggaggttgggggtcgtctaattttatatctaatatggatgggaagacaaggattataacttatagtaagtaccgttaccggtaggaacgggccgtaattcgactccacttcctacccgaagaacggtaacctaaacccgtacccggaaacgtaaaccgaaccgcgttacggtaacttcgtacgaactaaaagtacgaaacggaagtcgtaggaggaagtccgtaaggaaacggaccgtaacggttacgttttaacttacgtttaaccgttggtaccggttacgtaaactttaaaccggg

SEQ ID NO: 160412 - DNA, 653 bp, Homo sapiens
  misc_feature: GYAE6OF02HWIHG.49.79.H02.1.454.CMB.1.raw
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgcttactttaagaggtgtccagtgtcaggtgcagctgggtggagtcgtgggggagcgtcggtccagccgtggggacggtccctggacgctctcttgtgtctcggccttcgtggtacttccaccttcgagggttctagtcgacatgccacgtcggggtcccgcgaggcctccgaggccgaaggggctagggaggtgggtcgtacgtagtttatatacaattagtagaagtaggaagtacgaaagtataagtaacttagtaggtacgtacccgtacgggtaaggaacgggtcctagtttaccgacgttacctattccgacgaagtaacgaaccttaacccgaaccggaacaaaccgaccgtcgttacgtacgtctaacgaaacgttaaacgacgaacgaggtcttaggaggacggtctaacggaaacgtacggtaacgtttacgtttaatacgtttaccgttggtaacgtaaccgtaagttaaccgg

SEQ ID NO: 160413 - DNA, 584 bp, Homo sapiens
  misc_feature: GYAE6OF02F7O3W.49.79.H02.1.454.CMB.1.raw
  modified_base (361)..(361): a, c, t, g, unknown or other
  misc_feature (361)..(361): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtcgtgggggaggcgtggtccagccgtgggacggtccctgagacctctcttgtgctgcctctggtattctaccttcgagggtctatgacatgctacgtcgggtcccgccagggcctccgaggcgaagggggctgggagtgggtgctatttanatcatatgataggaagacaaggtactaagtactaagtgtaacgacgttccggtaggaacgggtctatcgtatctatcctcgagacgaccaacctccgaagaacgaccgtctagtacgtctagtaactaaatcgaacgagggactaggaagaggtcgtaagtaacgaaccgtacggttaatttagttaacgttaccgtaggttacggtaccgttaacttaacgg

SEQ ID NO: 160414 - DNA, 682 bp, Homo sapiens
  misc_feature: GYAE6OF02IV92Z.49.79.H02.1.454.CMB.1.raw
  modified_base (181)..(181): a, c, t, g, unknown or other
  misc_feature (181)..(181): n is a, c, g, or t
  modified_base (256)..(256): a, c, t, g, unknown or other
  misc_feature (256)..(256): n is a, c, g, or t
  modified_base (340)..(340): a, c, t, g, unknown or other
  misc_feature (340)..(340): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagcttgggttttcctcgttgctcttttaagnggtgtccagtgtcaggtgcagctggtggagtcgtgggggagcgtggtccaggccgtgggagtccctgagactctnttgcgtcgtcgtacctgtcggtacttcctaccgttggacgggttctagtaccgtacgtagtacgtccgtacggttccggacccnccggaacgccgttacggagggaccggtaacggggctagggaccggggttgggtccgtatttacgttaagtactagtatagtaggtagtaaggaacgactaaggtaatacgttattagtagtacgtaccgttacggtaggtaaccgggccgttatacgatccgtactacgtacgagacaaaccgtacaacgaaccgtaaccgcgttacgtgtaaccgttacgaacttaagaaacggtacgtaaacgacggttacaccgtaggaccgtaacggtaacgaaacggtaccgtaacggttattaagttacgttaccgttacgggttaactacgttaacggttaaccg

SEQ ID NO: 160415 - DNA, 709 bp, Homo sapiens
  misc_feature: GYAE6OF02IQXOJ.49.79.H02.1.454.CMB.1.raw
  modified_base (179)..(179): a, c, t, g, unknown or other
  misc_feature (179)..(179): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (444)..(444): a, c, t, g, unknown or other
  misc_feature (444)..(444): n is a, c, g, or t
tcagagtcgagagacacgaccggtgctcgatttagtgtcacacgaagggaaaggggagctctgggagaggagcccagcactagagtcggcggtgcttccattcggtgatcagcactgacacagaggactcaccatggaatttgggctggagctgggtttcctcgttgctacttttaagnggttgttccaggttgtccagggttcgacagtctagggttggacgtcgtgggggagtcgtggtccagtccgttagggacggttccctaggacgtactcgtcttggtcgctcgccgtacgtggacttccgcctttacgaggggttcctagtacggactagtcgacgtacgtcggggtaccnccgaggtccnccgtaggacgaagggtctaggaggtcgggtggaacttagtttacgactctacggtagtcgaagttcgggaaacttnaaaggttcttaacgtacttacgagttacggaacgttccggtaaggtaaccggtacggttactacgacgttacgacgttccgtacgtaacgaaccgttaagaaccctaccggagtaacctacccgtagttaacgtaacgttcggtaaccgaacgttaaacgtcggtaaacgtacggacgttacggaagttcggaaccttaggaccggtaacgtaacggttaccgtttacgtacgtacgttaacggtcgtaacccgtaggtttaacg

SEQ ID NO: 160416 - DNA, 785 bp, Homo sapiens
  misc_feature: GYAE6OF02IB7GX.49.79.H02.1.454.CMB.1.raw
  modified_base (182)..(182): a, c, t, g, unknown or other
  misc_feature (182)..(182): n is a, c, g, or t
tcagagtcgagagacacgaccggtgctcgatttagtgtcacacgaaagggaaaggggagctctgggagaggagcccagcactagaagtcggcggtgcttccattcggtgatcagcactgaacacagaggactcaccatggaatttgggctgagctgggttttcctcgttgcttcttttaagnggtgtccagtgtcaggtgcagcgtgggtggagtcgtgggggaggcgtggtccagccgtgggacggtccctgacgctctcttgtgctgccctgtgtacttcctaccgttacggaggttctagtacgactgtcgtaccgtaccgggtccggtcccgaccgcggtccgtaccgggacgggacgggaacggggtcggtaggggtacggggttcggggtacgtactttaagttttataaccgtagtaagttagtaacggtaaggtaggggtaaaactacggtaaaagttaacttaacgttaaccgttaaggttaacggtaaccggttacccggtacggggtaagggaaacccgggttacttaacttaccgactaccgttaactacccgtaaacgaacgaaccgtaaacctaacccgggtaacgaaaaccgaacgttccgtactttacgtaacgttcgaacgtaaaacgttaacgaacggtaaaccgtacgggttacgaaggaccgtaaccggtacggtaaaccggtaaccgtaaccggtttacctttaagtttaacgttaacggttacggttacggtaacccggtttaaaccgtaactttaaccgggg

SEQ ID NO: 160417 - DNA, 673 bp, Homo sapiens
  misc_feature: GYAE6OF02G8T72.49.79.H02.1.454.CMB.1.raw
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtcgtgggggagcgtggtccagccgtggggaggtccctggagtactctcttgtgctcgcctctgacttccaccttcgagggttctatcgactagtcgctacggtcgggtcccgccgagggcctccggaggccgaaggggctggggaggtgggtggacttagtttatactactaagtagtgtaagtagggaacacgtaaagtacttaatacgttagtagttaacgtacgttaccggtaggtaaacggggtaccgtaacgttactaacgttacctaacgttcccttaccgaacggaacgtaaccgaaacccgtaccggaaacggaacccaaccggtaccgttacgttaacttcctagtaacctaaagtacgaaacgcggacgtaggaaggacgtacgtagaacggtaacgtaccggtttatttagtttaacgttacgttacggtacgtaccgttaacgttaaccgg

SEQ ID NO: 160418 - DNA, 583 bp, Homo sapiens
  misc_feature: GYAE6OF02GSE37.49.79.H02.1.454.CMB.1.raw
  modified_base (350)..(350): a, c, t, g, unknown or other
  misc_feature (350)..(350): n is a, c, g, or t
  modified_base (488)..(488): a, c, t, g, unknown or other
  misc_feature (488)..(488): n is a, c, g, or t
tcagagtcgagagacacgaccggtgctcgatttagtgtcacacgaagggaaagggggagctctgggagaggagcccagcactagaagtcggcggtgcttccattcggtgatcagcactgaacacagaggactcaccatggaatttgggctgagctgggtttcctgttgctcttttaagaggtgtccagtgtcaggtgcagctgggtggagtcgtgggggaggcgtggtccagccgtggggagtccctgacgactctcttgtgctgcctctggacttcaccttcgaggtctatgacatgcacgtcgggtccgcaggctcagggcaaggggctgggagtgggtcgctattanatctatatggatggaagcaagtataatactagtcgtagtacgtccggtaggaacgggtccgtattcaatcactcctacgagacgaccaacgtccgaagaaccgacgtctagtactcgacgtactaaagtacgaaacgnggaccgtagtaacggacgtcgtaacggaaacggtaaccgtaacggttactttaagttaacgtttaccgtagggttccgtacggttaaccttaacg

SEQ ID NO: 160419 - DNA, 837 bp, Homo sapiens
  misc_feature: GYAE6OF02IOQOE.49.79.H02.1.454.CMB.1.raw
  modified_base (181)..(181): a, c, t, g, unknown or other
  misc_feature (181)..(181): n is a, c, g, or t
  modified_base (342)..(342): a, c, t, g, unknown or other
  misc_feature (342)..(342): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgcttcttttaagnggtgtccagtgtcaggtgcagcgtggtcggagtcgtgggggagtcggtggtccaggtccgtggggacgtcccgtgacgacttctcgttggtcgctgtccgtctggtattccaccgtttcgagggttctatcggaactgtcgaccgtacggttcgggtcccnccgtaacggtccgttacccgaagggtacggtaacgggggccttacgggggtaaggttcgggggttaccggacctttaagtttttaaagacgtttaccgtaaaggtttacggtacggtaacgttaaaccggggaaaaaccctttaaaggtaaccgtttaaaccgttaaaacgtttacggtttaacggtttaaccgggtaacccgtttaccggggtttaaacgggaaacccgggggttaaccccttagtttaaacccggaacgtttaccttaaccggttcccgttaacggaaacggtaaccgttaaaacccgtaacccgtaccgggaaactaaaccggacgtccgttaagttacctacgtacgtaaacgtaaacgtacggtaaaccgtagggtaccgttaggacgtacggaacgttaacgggaaacgacccgttaccgggttaactttaagtaaccgtttacgcggttaaccggtaacttaacgttaacgaaccggg

SEQ ID NO: 160420 - DNA, 871 bp, Homo sapiens
  misc_feature: GYAE6OF02FLHZ4.49.79.H02.1.454.CMB.1.raw
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgcttcttttaagaggtgtccagtgtcaggtgcagctgggtggagtcgtgggggaggcgtggtccagccgtggggaggtccctgagacctctcgttgtgctcgccttctgggtatttccaaccttcgacggggtcctatagacctagtcgactccggtcggggtacccgtcccgaagggtccctacccgaaggggtacccggtaaaagggggggtcccgttagggggtaacggggttcggggggttacggggtacccgttaaagtttttaactaacggtttacccgtaagtttacggttacggttaaaggttacggggtaaaacgggtacgtaaaaagggtaaattttaaaccgtaaaccgttaagttttaacgggtaaacgtaacccgggtttcccgggtaaagggggtaaaacccgggggttccccggtaaacgttttacccggtaaacttaccgaaaccgtttcccttaaacccggaggtaaaccggtaaccgaaacccgttaccccggaaacggtaacccgtaaccgaccgttacggttaacctcgttaacgaaacttaaagtaccggtaaacgtagggtaccgtacgggaacggtaggtacccgtaacggaaacggaacccggttaaccgggttaccttttaacgtttaacgttttaaccggtacggttaaccggttaccgttaaacgtttaacccggg

SEQ ID NO: 160421 - DNA, 645 bp, Homo sapiens
  misc_feature: GYAE6OF02GPUBE.49.79.H02.1.454.CMB.1.raw
  modified_base (309)..(309): a, c, t, g, unknown or other
  misc_feature (309)..(309): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagcgtggtttctcgtagctctttaagaggtgtccagtgtcgggtgcagctggtggagtcgtggggggagcgtggtccaggcctggggaggtccctgagactctcttgtgctgcctcgtgattccaccttgagggtctatcgacatgcacgtgggtcccncaggctccgaggcgaaggggcctgggaggtcgggcgacgtatttatacttcgattagtagtagtacggaagtacaaagaattaagtaacttagttagtaacgtaccgtacggtaggaacgggtccgtattacatctaactcctaccgaagacgtaaccgaaccgtaccggtaaacgaaccctacgacttacgttactcgtaacgtacctaaagtaacgaaacctaagggacctaaggacgaaggtacgtaacggaacggaaaccgtagggtttaaccttttaacgttacgtttacgttacggttacggtaacgttaaaccgttaggtaaacccggg

SEQ ID NO: 160422 - DNA, 808 bp, Homo sapiens
  misc_feature: GYAE6OF02G7JMO.49.79.H02.1.454.CMB.1.raw
tcagagtcgagagacacgaccggtgctcgatttagtgtcacacgaagggaaaggggagctcgtgggagaggagcccagcactagaagtcggcggtgcttccattcggtgatcagcactgaacacagaggactcaccatggaatttgggctgagtcgttggggttttccttcgttgtcttacgtttttaaggaggttgtcctaggtgtcgaggtgacgaggtcgtgggtgggaggtcggtgggggaggtcggtcgggtccgaggtccgtgggggtacggtccccgtaggacgtaccgttccgttcgtttcggtcggtccgttcgtcccgttcggttggtactttcccgtaacccgtttcggaacggggtttccttaagttacggtaaacctgttacggaccgtaaccggtccggggtcccggaacccgtagggcccgtaccggacggacgggaacggggtcgtaggggtacggtcggggtagtacgttaagtttaatacgtactaacgttataggtagtaagggaaacgtaacgtaaaggtattaacgttaacgttagtaggtaaccgtaccggttacggtacggaacgggtaccgtaattacgtactaccgtacgttaccgacgtaagaaccgaacctaaaccgtaccggaactaacgtaccgtacgttacgtactccgtaagtaacctaaagtacggaaccgaggtactaggaaccggtataaccggaaggtaaacccgtacgttacgggttaaactttacgttaacggttcctaacgggttacgttaacggttaaccgttaaacgg

SEQ ID NO: 160423 - DNA, 735 bp, Homo sapiens
  misc_feature: GYAE6OF02FQBTH.49.79.H02.1.454.CMB.1.raw
  modified_base (180)..(180): a, c, t, g, unknown or other
  misc_feature (180)..(180): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgctcttttaagnggtgtccagtgtcaggtgcagctggtggagtcgtgggggagcgtggtccagccgtggggacgtccctaggagactctcttgtgctcgcctcgtggtactttccaccttcgacgggttctagtcggacagtcgccgtacgttcggggtcccgccgaacggtcctaccggacgggtaccgaacggggggtcctacgggggtaggttcgggggtacggtaccttaagttttactagtaccgtaattacgtaggtaacgtacggggaaagtaccgtaaaaggtattaacgtttaacgttagttaggtaaaccgtacgttaccggtaagggtaaccggggtccgtaacgttacgtaacgtaccgtacttccgtaaccgaacggtaacaaaccgtaaccgtacccggaacgaaaccgtacccggtacttacggtacttaccgtacgaacgtaaagtacggaaacgacggtactaggacggtaacggtcgtaacggtaaacggtaccgtaacggttactttaacgttacgttaacgtgttaccgtaccgttaacttaaccgg

SEQ ID NO: 160424 - DNA, 666 bp, Homo sapiens
  misc_feature: GYAE6OF02HFNX9.49.79.H02.1.454.CMB.1.raw
  modified_base (264)..(264): a, c, t, g, unknown or other
  misc_feature (264)..(264): n is a, c, g, or t
tcagagtcgagagacacgaccggtgctcgatttagtgtcacacgaagggaaagggagctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggatcgtgggggagcgtggtccagcctgggacgtccctgagactctcttgtgctgcctntggattcaccttcagggtctagtgacatgctacgtcgggtccgccgaggcctccgaggccaaggggctggggagtgggtggactagtttacgtatctataagtggaagtgggaaagtcaaaggtataattaacgtagttagtacgtaccgttccggtaaggaacgggtacccgtaagtttaccgaagttaccaacgttcccgtaaccgtaaacgggaacgtaaccgtaaaacccgttacccggaaacgtaaacccgaacccgtacgttacgttaaccgttcgtacgaacccgtaaaagttacgaaaaccgagggtacgtaggaaggacggtactaacggaaacgaccgtaacggttaccttttaagtaaccgtttacgtacggtcgtaaccgtaacttaacg

SEQ ID NO: 160425 - DNA, 805 bp, Homo sapiens
  misc_feature: GYAE6OF02HEOQN.49.79.H02.1.454.CMB.1.raw
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtcgtgggggaggcgtgggtccagccgtggggacggtcccgtgacgactcctcttgtgctgcctcgtggacttcaccttcgagggttctagtgacagtgccgtacgtcgggtcccgccgacggccttaccgagggacgaacgggggtccgtggggacggttggggtcggtacgttaagttttaacgtacgttaccgtaagttaacgttaggtaaagttaggggaaaacgtaccgaaaagggtaacttaaagtttaaccgtttaagttaacggttaacggttaaccgttacccgggttaacgggtaaaccggggtcccggttaaactttaccgaactttcccgtaacttcccgttaacccgtaacggaaccggtaaaccgtaaacccggttaccccggaaaggtaaaaccccggaaccggttaccgttaacggttttaactacccggttaacgtaaaccgtaaaacggttacggaaaaccggacggtaccggttaagaacgggtaacggtaacgtaacggaaacgtaaccggtaccggtttaactttaacgttacgtttaacgttcgggttaacgtaaccgttaaacgtttaaccgg

SEQ ID NO: 160426 - DNA, 842 bp, Homo sapiens
  misc_feature: GYAE6OF02ISF7A.49.79.H02.1.454.CMB.1.raw
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagcgttgggtttttcctcgttgtcttctttttaagaggtcgtccagtgtcaggtgcagctggtcggagttcggtgggggaggcgttggtcccagccgtggggtacggtcccgtaggacgtctcgttcttgtggtcctcggccctcgttggtacttccgtacctttcgagggttctacgtaggtactagtcgaccgtaccggttcggggtccccgaccggtaacggtccgtacccggtaacggggaccggggtaaaagggggtccggtagggggtaacggggttcggggttacggggtaccctttaaggtttttaaactacgttaacctaaaggtttattacgggtaagtagggaaacgtaaacgtaaagtaattaaacgtttaacgtaagttacggttaaacgtaaccgttacccgggtaagggtaaacccgggtccgttaacttacgtaacttaaccgtacttacccgtaaaccggaacgtaaaccggtaaacccgtaacccgttaaaccggaaaccggttaacccgtaacccggttactttaacgtaacctttaccgtaacggaaaccttaaacgggtaaacgaaccgggagttaccgtagggaacgacggtaccggttaaggaacggttaacccgtaaggtttacttttagtaacggtttctaccggtaagttacccgttaataaccgg

SEQ ID NO: 160427 - DNA, 781 bp, Homo sapiens
  misc_feature: GYAE6OF02I8NQ7.49.79.H02.1.454.CMB.1.raw
tcagagtcgagagacacgaccggtgctcgatttagtgtcacacgaagggaaaggggagctcgtgggagaggagcccagcactagaagtcggcggtgcttccattcggtgatcagcactgaacacagaggactccaccatggaatttgggctgagcgttgggttttcctcgttgcttcgttttaagaggttgtccagtgtcaggtgcagcgtggtggagttcggtgggggaggcggtggtccgaggtccgtaggggtaccgtcccgtgacgtcgttcgtcgttcgtgtcgtcgtacctcgtaggtacttccgtccttgtacggttctagtcgaacctgtcggtcgtccggtccggtacccgcccgcggtccctacccgggaggtacccgggtaaacggggtccggtagggtacgggttggggtacgtacgttagtttaacgtacttacgtaagttagtacggtaggtaaggacggtaaccgaagtataacgttaactagtagtaacgtccgtacgggtacggtaacggtccgtaagttacgactaccgtacgtaccgttaccgaacgtaccgtaaccgtaccgtaacccgaaacgtaacccgtcgtaaccctacgttacgttacccggtaacgtaaaccgtaagtaaaccggtaaccgtaaccggtacgtaggacggtacgtaccgggtaaacgttaaccggtaacccgttaccggtttaactttaaccggttaactttacccgggtaacgtttaccggtaaccggttaaccgttaaaccgg

SEQ ID NO: 160428 - DNA, 552 bp, Homo sapiens
  misc_feature: GYAE6OF02I93O3.49.79.H02.1.454.CMB.1.raw
  modified_base (354)..(354): a, c, t, g, unknown or other
  misc_feature (354)..(354): n is a, c, g, or t
  modified_base (388)..(388): a, c, t, g, unknown or other
  misc_feature (388)..(388): n is a, c, g, or t
  modified_base (443)..(443): a, c, t, g, unknown or other
  misc_feature (443)..(443): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtcgtgggggaggcgtggtccagccgtggggacggtccctgagactctcttgtgctgcctctggattcaccttcagggtctatgacatgcacgtgggtcccgccaggcctccgaggcaaggggctgggagtggggtgcagtttanatcatatgatggaagcaaagatattactatgtanacgtcgtagaggccattcatcatctacagacgacaactcgaagaaccagctgtancgtgactaagtacgaaacaggtacctaggaagacgtcgtaggaaacggaccgtaacggtacttttaagttaacgtttacgttggttacggtaaccgttaacttaaacgg

SEQ ID NO: 160429 - DNA, 744 bp, Homo sapiens
  misc_feature: GYAE6OF02H3Y70.49.79.H02.1.454.CMB.1.raw
  modified_base (199)..(199): a, c, t, g, unknown or other
  misc_feature (199)..(199): n is a, c, g, or t
tcagagtcgagagacacgaccggtgctcgatttagtgtcacacgaagggaaagggggagctctgggagaggagcccagcactagaagtcggcggtgcttccattcggtgatcagcactgaacacagaggactcaccatggaatttgggctgagctgggttttcctcgttgctcttttaagaggtgtccagtgtcaggtncagctggtggagtcgtgggggagcgtggtccaggccgtggggacgtccctggacgacttctcttgtgctgccctcgtggtacttccaccgtttcgaggggttcctatggaccaagttcgaccgtacggttcgggtccccggccgtacgggaccttacccggacgggaccggtaaacggggggtccgttagggggtaagggttgggggtcggtacgtttaagttttaacgtattaccgaagtttacgtagggtaagttaacggggaaacttacgaaaacgggtaattaaacggttaaccgttaagtacgtaaacggtaccgtttaccgggtaacgggaacgggtaacggttacttcgacttaccgtacttacctaccgtagggaacctaccgaaaccgtccgaaacggaactaccggcttacgacgttacgtacgtaacgaataacggaacgtacgtacgaggtagacgtagaacggtaacggaaccttacggtttacttaacgttaacgtttacggtagttacccgggttaactaacgttaaccg

SEQ ID NO: 160430 - DNA, 634 bp, Homo sapiens
  misc_feature: GYAE6OF02GOBFR.49.79.H02.1.454.CMB.1.raw
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (214)..(214): a, c, t, g, unknown or other
  misc_feature (214)..(214): n is a, c, g, or t
  modified_base (266)..(266): a, c, t, g, unknown or other
  misc_feature (266)..(266): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (286)..(286): a, c, t, g, unknown or other
  misc_feature (286)..(286): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (334)..(334): a, c, t, g, unknown or other
  misc_feature (334)..(334): n is a, c, g, or t
  modified_base (355)..(355): a, c, t, g, unknown or other
  misc_feature (355)..(355): n is a, c, g, or t
  modified_base (393)..(393): a, c, t, g, unknown or other
  misc_feature (393)..(393): n is a, c, g, or t
tcagagtcgagagacacgaccggtgctcgattttagtgtcacacgaaggggaaaggggagctctgggagaggagcccagcactagaagtcggcggtgcttccattcggtgatcagcactgaacacagagactcacatggaatttgggctgagcgtggtttcgcgtagctctttaagagggtntcagtgtcaggtncgagtctggtggagttggngggggagccggttggtaccagccggtggggacggttcccaggacgtcctctnttgtgcngccttnggcttcnccttgacgggtctagtgacagtnaccgngtcggtaccgcgacggttcnccggaggtcgaaggggttcgnggtacggttggggaccgattagttactatcaaggtttntaggagtaggaagtacgaatactaagttatagtacgtaacgtcggtacggagggtacggtaccgtaagttctaacgtctacgtaccgtacgtaacgagtaaccggaaccgtaacgaacggaccgtacggtcttacgttactacgtacgtaacctaaggtaacgaaacggtcgtagtacgagtacggtacggacgacgtacgttagttacttagttacgtagttcgtacgtacgtagtaccg

SEQ ID NO: 160431 - DNA, 788 bp, Homo sapiens
  misc_feature: GYAE6OF02JNU7M.49.79.H02.1.454.CMB.1.raw
  modified_base (179)..(179): a, c, t, g, unknown or other
  misc_feature (179)..(179): n is a, c, g, or t
  modified_base (199)..(199): a, c, t, g, unknown or other
  misc_feature (199)..(199): n is a, c, g, or t
  modified_base (411)..(411): a, c, t, g, unknown or other
  misc_feature (411)..(411): n is a, c, g, or t
  modified_base (721)..(721): a, c, t, g, unknown or other
  misc_feature (721)..(721): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagacggactcacagtggaattgggctgagcgttggtttcctgtgcttcgtttaagngtgtcctagtgtcgaggtancgagcgtggtggacgttcggtagggggagcggttcggtccacggtccgtacgggggtacggttccctaggacggtaccttcgtttccgttcggtcgtcgtacgtcccgtcgttggtaaccttccgtaccccgtttacggtacgggtttctacggttacgtaacctagtaccgaccggtaccgttccgggtccccgtaccgaccgggttcccnccgggtacggaccggggtaacgggtccgggttaaggggtacgggttacgggggtcgtaaccgtttaagtttaacgtttactaaccggttagttaaccggtgggtttaaagtacggtaaacgacgtaaagttaacgttacgtttaacgtaagtaggttaacgtaccgttacgggtaaggtaacccggtacgtactttacgaaccttacgaccgtacgtaccgtaagaaaccgtaccgtaacccgtaacgaaccgtaacgtccgtacgttagttacctaaacgtcaaacgttaacgagtaacgcgttaacgnggaacgtcgaacgtacaacggtacgttacgtattacgtaagttccgttaagctacgtaaagtaccgg

SEQ ID NO: 160432 - DNA, 690 bp, Homo sapiens
  misc_feature: GYAE6OF02GOEQO.49.79.H02.1.454.CMB.1.raw
  modified_base (322)..(322): a, c, t, g, unknown or other
  misc_feature (322)..(322): n is a, c, g, or t
  modified_base (342)..(342): a, c, t, g, unknown or other
  misc_feature (342)..(342): n is a, c, g, or t
  modified_base (658)..(658): a, c, t, g, unknown or other
  misc_feature (658)..(658): n is a, c, g, or t
tcagagtcgagagacacgaccggtgctcgatttagtgtcacacgaagggaaaggggagctctgggagaggagcccagcactagaagtcggcggtgcttccattcggtgatcagcactgaacacagaggactcaccatggaatttgggctgagcttgggttttcctcgttgcttcttttaagaggtcgtcctagtgtcaggtgcagtcgtggtaggagtcgtgggggacggtcggtggtccacggccgtggggacggtcccgtggacgtctctcgttgtgtctgcctcgtggtacttccacctttcgagggttctagtgaccntcggctacgtcggggtcccnccgacggcccgtcgaacggacggaaggggtccgtaggggtacgggtaggggtgggtcctaagttttacgttaactccgtaagtttacgtaggtaacgtaaggggtaaacgacgttaaaacggagtttaaactaccgttaagtacgtaacggtaacccgttccgggtaagggtaacgggtccctaacgtactacgttacctacttccgtaaacgaggtaacgtaaaccaccgtaccgtaaacgaccgagtaccgttaagtccgtacgtagtaactaagtacacgtacgacgtagacgagtcgagtaacgcgtaactnttaagtcttagtcgtacgtagttacgtaacgg

SEQ ID NO: 160433 - DNA, 694 bp, Homo sapiens
  misc_feature: GYAE6OF02GP6YY.49.79.H02.1.454.CMB.1.raw
tcagagtcgagagacacgaccggtgctcgatttagtgtcacacgaagggaaagggggagctctgggagaggagcccagcactagaagtcggcggtgcttccattcggtgatcagcactgaacacagaggactcaccatggaatttgggctgagcgtgggttttcctcgttgctcttttaagaggtgtcctagtgtcaggtgcagcgtggtggagtcgtgggggagcgtggtccagccgtgggacgtcctgacgctacgtcttgtacgctcgcctacgtggtattccaccgtttcgacggttcgttagtgactacgtggacctacgtgggtccccgcgacgggtcctaccgacgggtaccggaggggtaccgtggggaacggttggggcggtccgttaaggtttaactacttacgaattacgtaggtaggtacggaacgacgtaagtacgttaactacgtaagttacgtaagtaccctacggtaggtaacgggacttactacagtacctactccgtaactaacgaccgtaacaaccgtaccgaacgtaaccaacgtctagttagtccgtaagaacaaagttacaacggtggtacgacgggaacgtaacggtacgtaacggtaaccggtaataaccggtttcgtttaaacgttacgttaaccggttaggtaccggtaaccgttaagttaaaccggg

SEQ ID NO: 160434 - DNA, 766 bp, Homo sapiens
  misc_feature: GYAE6OF02IQVN4.49.79.H02.1.454.CMB.1.raw
  modified_base (441)..(441): a, c, t, g, unknown or other
  misc_feature (441)..(441): n is a, c, g, or t
  modified_base (728)..(728): a, c, t, g, unknown or other
  misc_feature (728)..(728): n is a, c, g, or t
tcagagtcgagagacacgaccggtgctcgatttagtgtcacacgaagggaaaggggagctctgggagaggagcccagcactagaagtcggcggtgcttccattcggtgatcagcactagaacacagagactcaaccatggtaatttgggctagagtcttgggttttcctcgttgcttcttttaaagcggttagtccgaagttgtcgaggtgcagcgtggtggagtcggtggggacggcgtcggtccgacggccgtggggaccgtccctaggacgtaccttcgttcgttagtcgtcgtacggtacctccgtagttacttaccgtaccgttacgtacgggttacctaggtaccgtatacgtacggcctaaccggttcgggtccccggacccgtacggtcccgtaccgtagggaccggtaagggtcggtagggagggttacggngttacttaagtttaactagtacctaagttagttagtacggtagaaaacgtaacgaaataagttaagtaaccgttagttaggtaaccgttaacgtcggtaacggggaacgggttacctagtttacgaccgtaacgtaccttccgaaacgacgaacgtacccgaaccgtaacggaaccgtacgaaccgttgtacgttactacgtaccaaagttaagaccgaaacgtgtaacgaggtaagtcggtaactaaacgggtacctaaaccggtaaccgttttagttaaaccgtnttttaaggccggtttaacgtaccggtttaagaacccgg

SEQ ID NO: 160435 - DNA, 523 bp, Homo sapiens
  misc_feature: GYAE6OF01D1LI3.9.67.G01.1.454.CMB.1.raw
  modified_base (511)..(511): a, c, t, g, unknown or other
  misc_feature (511)..(511): n is a, c, g, or t
  modified_base (517)..(517): a, c, t, g, unknown or other
  misc_feature (517)..(517): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctggggacagagttcgtctcaccatcagcagcctgcagtctgaagtatttgctagtttattactgtcagctacttataatagttcggaccgtctcgtacgtttcgggcggtagggaccaagggtggagcgtacgaaacgacgtgtcggctgacacctatctntcttcnttcccg

SEQ ID NO: 160436 - DNA, 499 bp, Homo sapiens
  misc_feature: GYAE6OF01ED9MY.9.67.G01.1.454.CMB.1.raw
  modified_base (495)..(495): a, c, t, g, unknown or other
  misc_feature (495)..(495): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctgggacagagttcgtctcaccatcagcagcctgcagtctgaagatttgcagtttattactgtcagcactataatagttggccgctcactttcggcggtagggaccaaggtggagctcaaacgactgtggctgcaccatctgtcttnatcc

SEQ ID NO: 160437 - DNA, 376 bp, Homo sapiens
  misc_feature: GYAE6OF01CDV8D.9.67.G01.1.454.CMB.1.raw
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (372)..(376): a, c, t, g, unknown or other
  misc_feature (372)..(376): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggactgtggctgcaccatctgtcttcatcttccgcatctgaagcgtatcactgagcgggntggcaaggcncatagnnnnn

SEQ ID NO: 160438 - DNA, 513 bp, Homo sapiens
  misc_feature: GYAE6OF01C6H2F.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggcaggttcagtggtagtgggtctgggacagagttcgttctcaccatcagcagcctgcagtctgaagtattttgctagtttattactgtcagcactataatagttggccgctctactttcggcggtagggaccgaagggtggagcgtacaaacggactgtggctgcacctatctgtcttcattcccg

SEQ ID NO: 160439 - DNA, 642 bp, Homo sapiens
  misc_feature: GYAE6OF01BHCFQ.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagaccgtggcttggcctcccgagggtcctcatcgtacggtgccgtccagccgagggcccacgtcggtacctcccggaccgtaggttcaggttggtaggtggggtcgtgggacaggtacgtttcgtctccactatcgacgcacgcctgctagtctagtaagttatttgtattagtttacttacgtgtactacgtacttaactaagttaacgttggttcggtcccgtacttccgttaccggtttacggggaccgggtaacgggaaccggtaacgggtcggtaacgtaccgtaaaccggtaaaacggtaccgttagggtacggtcgtacgaccgtacccgtacgttaccgttacgtttcccttccgtaccgtttacccccg

SEQ ID NO: 160440 - DNA, 504 bp, Homo sapiens
  misc_feature: GYAE6OF01CLQRQ.9.67.G01.1.454.CMB.1.raw
  modified_base (499)..(500): a, c, t, g, unknown or other
  misc_feature (499)..(500): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccacttagcctggtaccagcagagacctggcttggctcccagggtcctcatctacggtgcgtccagcagggccactggtatcccggcaggttcagtggtagtgggtctgggacagagttcgttctcaccatcagcagcctgcagtctgaagtatttgctagtttattactgtcagcactataatagttgccgctctacgtttcggcggagggaccaaggtggagctacaaacggactgtggctgcaccatctgtcttnnttcc

SEQ ID NO: 160441 - DNA, 508 bp, Homo sapiens
  misc_feature: GYAE6OF01AWWGZ.9.67.G01.1.454.CMB.1.raw
  modified_base (503)..(504): a, c, t, g, unknown or other
  misc_feature (503)..(504): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctccagggtcctcatctacggtgcgtccagcagggccactggtatcccggcaggttcagtggtagtgggtctgggacagagttcgtctcaccatcagcagcctgcagtctgaagtattttgctagtttattactgtcagcactataatagttggccgtctcgtacgtttcggcggagggaccaagggtggagcgtacgaaacgactgtggctgcacatctgtcttnntccg

SEQ ID NO: 160442 - DNA, 506 bp, Homo sapiens
  misc_feature: GYAE6OF01B7GU5.9.67.G01.1.454.CMB.1.raw
  modified_base (503)..(503): a, c, t, g, unknown or other
  misc_feature (503)..(503): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtactcccggcaggttcaggtggtagtgggtctgggacagagttcgtctcaccatcagcagctgcagtctgaagtattttgctagtttatactgtcagcactataatagttggaccgtctctacgtttcggcggtagggaccaaggtggagctacgagacgaatggtgctgcaccatctgtctntac

SEQ ID NO: 160443 - DNA, 508 bp, Homo sapiens
  misc_feature: GYAE6OF01BQWYZ.9.67.G01.1.454.CMB.1.raw
  modified_base (395)..(395): a, c, t, g, unknown or other
  misc_feature (395)..(395): n is a, c, g, or t
  modified_base (492)..(492): a, c, t, g, unknown or other
  misc_feature (492)..(492): n is a, c, g, or t
  modified_base (501)..(501): a, c, t, g, unknown or other
  misc_feature (501)..(501): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtactcccggcaggttcagtggtagtgggtctgggacagagttcgtctcaccatcagcagcctgcagtctgaagtntttgctagtttattactgtcagctatataatagttgccgtctctacgtttcggcggagggaccaaggtgacgctacgaacgacgtgcggctgcactntctgtcttncttcccg

SEQ ID NO: 160444 - DNA, 498 bp, Homo sapiens
  misc_feature: GYAE6OF01BS40Z.9.67.G01.1.454.CMB.1.raw
  modified_base (290)..(290): a, c, t, g, unknown or other
  misc_feature (290)..(290): n is a, c, g, or t
  modified_base (433)..(433): a, c, t, g, unknown or other
  misc_feature (433)..(433): n is a, c, g, or t
  modified_base (475)..(475): a, c, t, g, unknown or other
  misc_feature (475)..(475): n is a, c, g, or t
  modified_base (487)..(487): a, c, t, g, unknown or other
  misc_feature (487)..(487): n is a, c, g, or t
  modified_base (492)..(493): a, c, t, g, unknown or other
  misc_feature (492)..(493): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctnatctacggtgcgtccagcagggccactggtatcccggccaggttcagtcggtagtgggtctgggacagagttcgtctcgacatcagcagcctgcagtctgagatttgctagtttattactgtcagcactataatagtggccgntcactttcggcggaggaccaggtgacgctacgaacgacgtgnggctgcacatcngtctnntcccg

SEQ ID NO: 160445 - DNA, 503 bp, Homo sapiens
  misc_feature: GYAE6OF01A4ZE9.9.67.G01.1.454.CMB.1.raw
  modified_base (499)..(499): a, c, t, g, unknown or other
  misc_feature (499)..(499): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcaagggccagtcagagtcttggcaccaacttagcctggtaccagcagagacctggcttggctcccagggtcctcatctacggtgcgtccagcagggccactggtatcccggccaggttcagtggtagtgggtctgggacagagttcgtctcaccatcagcagcctgcagtctgagtatttgctagtttattactgtcagcactatatagttgccgtctcactttcggcggtaggaccgaaggtggagctacgaaacgactgtggctgcaccatctgtcttcntccg

SEQ ID NO: 160446 - DNA, 510 bp, Homo sapiens
  misc_feature: GYAE6OF01CK0MO.9.67.G01.1.454.CMB.1.raw
  modified_base (299)..(299): a, c, t, g, unknown or other
  misc_feature (299)..(299): n is a, c, g, or t
  modified_base (348)..(348): a, c, t, g, unknown or other
  misc_feature (348)..(348): n is a, c, g, or t
  modified_base (504)..(504): a, c, t, g, unknown or other
  misc_feature (504)..(504): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctccagggtcctcatctacggtncgtccagcagggccatggtactcccggcaggttcagtggtagtgggtcngggacagagttcgttctcaccatcagcagcctgcagtctagaagtattttgctagtttattactgtcagctactataatgttcgccgtctctacgtttcggcggagggaccaagggtggagctacgaaacgtactgtggctgcacatctgtcttcnttcccg

SEQ ID NO: 160447 - DNA, 532 bp, Homo sapiens
  misc_feature: GYAE6OF01B31U5.9.67.G01.1.454.CMB.1.raw
  modified_base (265)..(265): a, c, t, g, unknown or other
  misc_feature (265)..(265): n is a, c, g, or t
  modified_base (420)..(420): a, c, t, g, unknown or other
  misc_feature (420)..(420): n is a, c, g, or t
  modified_base (457)..(457): a, c, t, g, unknown or other
  misc_feature (457)..(457): n is a, c, g, or t
  modified_base (497)..(497): a, c, t, g, unknown or other
  misc_feature (497)..(497): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcaganacctggcttggctccgagggtcctcatctacggtgccgtccagcgagggccacgtcggtactccccggcaggttcaggttggtagtcggggtcgtgggacaggacgtttcgtctcaccatcagcagcctgcagtctagaatatttgactagtttntactgtcagcatataatgtgccgtctactcgttcggnggtacggacctagggtgacgacgtacgaaacgtacgtggnggctcgactacctatcgtagtcttcgtacttcccg

SEQ ID NO: 160448 - DNA, 517 bp, Homo sapiens
  misc_feature: GYAE6OF01DYML6.9.67.G01.1.454.CMB.1.raw
  modified_base (510)..(511): a, c, t, g, unknown or other
  misc_feature (510)..(511): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccacttagcctggtaccagcagagacctggcttggctccagggtcctcatctacggtgcgtccagcagggccatggtatcccggcaggttcaggtggtagtgggtctgggacaggagttcgttctcaccatcagcagcctgcagtctgtaagtatttgctagtttattacttgtcagctactataagtagttggccgtctcgtacgtttcgggcggtagggaccgaagggtggagcctacgaacgactgtggctgcactatctgtcttnnttcccg

SEQ ID NO: 160449 - DNA, 544 bp, Homo sapiens
  misc_feature: GYAE6OF01BVZAH.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtactcccggcaggttcagtggtagtgggtctgggacaggtagttcgtctcaccatcagcagcctgcagtctgaagtatttgctagtttatacgtgtcagctactataatagttcggccgtctcgtacgtttcggacggtacgggtaccgaagggtggacgtcgtaacgaaacggtacgtaggtcggctcgaccaccgtattcttagttccttcgtacttccccg

SEQ ID NO: 160450 - DNA, 642 bp, Homo sapiens
  misc_feature: GYAE6OF01DF0AK.9.67.G01.1.454.CMB.1.raw
  modified_base (371)..(371): a, c, t, g, unknown or other
  misc_feature (371)..(371): n is a, c, g, or t
  modified_base (410)..(410): a, c, t, g, unknown or other
  misc_feature (410)..(410): n is a, c, g, or t
tcagtgatacgtctcacgaccggtgctcgatttagagtatacatattgggtttgggggaggaactgctcagttacggacccagacggaaccatggaagccccagcgcagcttctcttcctcctgctactctggctcccagataccactggaataatagtgatgacgcagtctccagccaccctgtctgtgtttccaggagaaacagccactctcacctgcgaggggccagtcagagtcgttggcaccgaattacgcctggtaccagccagacgacctggcttcggctcccagggtcctcatctacggtgccgtccgagcagggccacgtggactccccggcaggttcaggtggtagtgggtctgggacagngttcgtctcaccaatcagcagcctgcagtcgtagaagtnttttagactagtttattacgtagtacagtactaacttaattaaattacggttcggtacccgtacgttaccgtaaccgtttaccgggtaccgggtaacggggtaacccgaaaggggttacgggaacggtaccgttaaccgaaaaaccggtaaaccggttaggttacgggtccgtttacggacccgtaacccgtaacgttaccgttacggttacctttccgtacgtttaccccg

SEQ ID NO: 160451 - DNA, 550 bp, Homo sapiens
  misc_feature: GYAE6OF01CIAEK.9.67.G01.1.454.CMB.1.raw
  modified_base (203)..(203): a, c, t, g, unknown or other
  misc_feature (203)..(203): n is a, c, g, or t
  modified_base (388)..(388): a, c, t, g, unknown or other
  misc_feature (388)..(388): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagccaccctgtctgtgtttccaggagaaacngccactctcacctgcagggccagtcagagtcttggcaccaacttagcctggtaccagcagagacctggcttggctcccgaggtcctcatcgtacggtgcgtccagcagggccacgtggtactccccggcaggttcaggttcggtaggtgggtctggggactaggtacgtttcgttctacgacctntcagcacgctgctagtctagagtattttgattaggttttattacgttgtctagctaactataattagtcggctctacgtacgtttcggcgggtaggaccgtaaggtgagctacgaaacgtacgtggtggcgtagccactacttctagttccttgtcttcccg

SEQ ID NO: 160452 - DNA, 512 bp, Homo sapiens
  misc_feature: GYAE6OF01DIHGB.9.67.G01.1.454.CMB.1.raw
  modified_base (505)..(506): a, c, t, g, unknown or other
  misc_feature (505)..(506): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggcaggttcagtggtagtgggtctgggacaggagttcgttctcaccatcagcagcctgcagtctagaagtattttgctagtttattactgtcagctactataatagttggccgtctctacgtttcggcggagggaccaagggtggagctcaaacgactggtggctgcacatctgtcttnnttcccg

SEQ ID NO: 160453 - DNA, 530 bp, Homo sapiens
  misc_feature: GYAE6OF01B6OXY.9.67.G01.1.454.CMB.1.raw
  modified_base (357)..(357): a, c, t, g, unknown or other
  misc_feature (357)..(357): n is a, c, g, or t
  modified_base (495)..(495): a, c, t, g, unknown or other
  misc_feature (495)..(495): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtactcccggcaggttcagtggtagtgggtctgggacngagttcgtctcacatcagcagcctgctagtctgaagtattttgctagtttattactgtctagtctactataagttagttcgccgtctcgtacgtttcggcggtagggaccgaagggtgagctaacgaaacgtacgtgnggtctgcaccgtacttctagttcctgtacttcccg

SEQ ID NO: 160454 - DNA, 255 bp, Homo sapiens
  misc_feature: GYAE6OF01EQHCJ.9.67.G01.1.454.CMB.1.raw
  modified_base (253)..(255): a, c, t, g, unknown or other
  misc_feature (253)..(255): n is a, c, g, or t
tcagtgatacgtctcacgaccggtgctcgatttagagtatacatagtgggtctgggacagagttcgttctcaccatcagcagcctgcagtctgaagattttgcagtttattactgtcagcactataatagttggccgctcactttcggcggagggaccaaggtggagctcaaacgaactgtggctgcaccatctgtcttcatcttcccgccatctgaagacgtatcactgagcgggctggcaaggcgcatagnnn

SEQ ID NO: 160455 - DNA, 505 bp, Homo sapiens
  misc_feature: GYAE6OF01AMTYC.9.67.G01.1.454.CMB.1.raw
  modified_base (502)..(502): a, c, t, g, unknown or other
  misc_feature (502)..(502): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtggggtctgggacagagttcgttctcaccatcagcagcctgcagtctgaagattttgctagtttattactgtcagcactataatagttggccgctctactttcggcggagggaccaagggtggagctcaaacgactgtggctgcaccatctgtcttcntcc

SEQ ID NO: 160456 - DNA, 574 bp, Homo sapiens
  misc_feature: GYAE6OF01EGK90.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgtcgtccagcagggccacgtggtactcccggcagggttcaggtggtagtgggtctgggacagtagttcgttctcaccatcagcagctgcagtctagaagtatttgctagtttattacgtgtcagctaacttataagttagttcggaccgtctcgtacgtttcgggacggtaagggaccgtaagggtggacggtacctaacgaaaacggtaaccgtgggtacggtcgtcggacctaacccgtagttaccgttagttccttcgtacgtttccccg

SEQ ID NO: 160457 - DNA, 564 bp, Homo sapiens
  misc_feature: GYAE6OF01D00HO.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcacaacttagcctggtaccagcagagacctggcttggctccagggtcctcatctacggtcgcgtccagcgagggccacgtggtactcccggccaggttccaggtggtagtggggtctgggacaggagttcgttctcgaccatcagcagccgtgccgagtctaggtaagtattttgactagtttattactgtcagtcacgtataagtagttggccgtctcgtacgtttcgggcgggtacgggaccgtaagggtcggtagccgtacgaaacggtaacgtggtacggctaggacccacccgtatccgttagttcttcgacgttccccg

SEQ ID NO: 160458 - DNA, 553 bp, Homo sapiens
  misc_feature: GYAE6OF01CPO5D.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccacctgtctgtgtttccaggagaaacagccactctcacctgcagggccagtcagagtcttggcaccaacttagcctggtaccagcagagacctggcttggcctccgagggtcctcatcgtacggtgccgtccagccgagggccacgtggtactcccggctaggtcaggtggtagtgggtctgggacagtagttcgttctcaccatcagcacgcctgctagtctagaagtattttgcttagtttattacttgtctagactaacttaataagttagttcggtccgtctcgtcgtttacggcgggacgggacgaagggtggacgtcgtacgaaacgtacgtggtaggcgtcgacacgtacttctgttcttcgtcttcccg

SEQ ID NO: 160459 - DNA, 524 bp, Homo sapiens
  misc_feature: GYAE6OF01A9OG2.9.67.G01.1.454.CMB.1.raw
  modified_base (518)..(518): a, c, t, g, unknown or other
  misc_feature (518)..(518): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgcgtccagcagggccactggtactcccggcaggttcaggtggtagtgggtctggggacaggtagttcgtctcactatcagcagctgcagtctagagtatttgctagtttattactgtacagctatataatagttcggccgtctctacgtttcggcggtagggaccaaggtggagtacctacgaaacggactggtcggctgcaccgtatctgtcttcnttcccg

SEQ ID NO: 160460 - DNA, 508 bp, Homo sapiens
  misc_feature: GYAE6OF01BZWSD.9.67.G01.1.454.CMB.1.raw
  modified_base (501)..(502): a, c, t, g, unknown or other
  misc_feature (501)..(502): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggcaggttcagtggtagtgggtctgggacaggagttcgttctcaccatcagcagcctgcagtctgaagtattttgctagtttattactgtcagcactataatagtgccgctctacgtttcggcggagggaccaaggtggagctacgaacgactgtggctgcacctatctgtcttnnttcccg

SEQ ID NO: 160461 - DNA, 525 bp, Homo sapiens
  misc_feature: GYAE6OF01AU7IB.9.67.G01.1.454.CMB.1.raw
  modified_base (403)..(403): a, c, t, g, unknown or other
  misc_feature (403)..(403): n is a, c, g, or t
  modified_base (483)..(483): a, c, t, g, unknown or other
  misc_feature (483)..(483): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccacgtggtactcccggccaggttcaggttggtagtgggtctgggacaggtagttcgttctcaccatcagcacgcctgcagtctgaagtntttgctagtttattacgtgtcagtcaactataatagttcggcctctcgtacgtttcggcggtaggacaggtgagtcgtanaaacgtacgtgtcggctcgcaccgtatctgtcttgcttcccg

SEQ ID NO: 160462 - DNA, 521 bp, Homo sapiens
  misc_feature: GYAE6OF01AJ30F.9.67.G01.1.454.CMB.1.raw
  modified_base (515)..(515): a, c, t, g, unknown or other
  misc_feature (515)..(515): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtggggtctggggacagagttcgttctcaccatcagcagcctgcagtctgaagtattttgctagtttattacttgtcagcactataatagttcgccgctctacgtttcggacggtagggaccaagggtggagctacgaaacgactggtggtctgccacgtatctgtcttctnttcccg

SEQ ID NO: 160463 - DNA, 509 bp, Homo sapiens
  misc_feature: GYAE6OF01B0679.9.67.G01.1.454.CMB.1.raw
  modified_base (504)..(505): a, c, t, g, unknown or other
  misc_feature (504)..(505): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccacgtggatcccggccaggttcagtggtagtgggtctgggacagagttcgtctcaccatcagcagcctgcagtctgaagtatttgctagtttattactgtctagctactataatagtggccgctctactttcggcgagggaccaagggtggagcgtacgaacgacgtgtcggctgcacctatctgtcttnntccc

SEQ ID NO: 160464 - DNA, 549 bp, Homo sapiens
  misc_feature: GYAE6OF01EEGGD.9.67.G01.1.454.CMB.1.raw
  modified_base (392)..(392): a, c, t, g, unknown or other
  misc_feature (392)..(392): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtcagcagggccactggtatcccggcaggttcagtggtagtgggtctgggacagagttcgtctcacatcagcagcctgcagtctgaagtnttttgactagtttattacttgtcagcactaataatagttcggccgtctcgtacgtttcgggcgggagggaccgaagggtcggacgtctaccgaaaacggtacctggtcgggcttggacctaacccgtataccttacggttcctttcacgtttccccg

SEQ ID NO: 160465 - DNA, 517 bp, Homo sapiens
  misc_feature: GYAE6OF01D9O6A.9.67.G01.1.454.CMB.1.raw
  modified_base (511)..(512): a, c, t, g, unknown or other
  misc_feature (511)..(512): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcaggtggtagtgggtctggggacaggtagttcgttctcaccatcagcagcctgcagtctgaagtattttgctagtttattactgtcagcactataatagttggccgtctctacgtttcggacggagggaccaagggtggagctacgaaacgtactgtggctgcactatctgtcttnntcccg

SEQ ID NO: 160466 - DNA, 534 bp, Homo sapiens
  misc_feature: GYAE6OF01BPOTV.9.67.G01.1.454.CMB.1.raw
  modified_base (527)..(527): a, c, t, g, unknown or other
  misc_feature (527)..(527): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccatggtactcccggcaggttcagtggtagtgggtctgggacaggtagttcgtctcaccatcagcagcctgcagtctgaagtattttgctagtttattactgtcagtactactaataagttagttcggccgtctcgtacgtttcggacgggacgggtaccgaagggtggagtacgtacgaaacgacgtggtcggctcgacactatctgtcttcncttcccg

SEQ ID NO: 160467 - DNA, 571 bp, Homo sapiens
  misc_feature: GYAE6OF01AB9WN.9.67.G01.1.454.CMB.1.raw
  modified_base (393)..(393): a, c, t, g, unknown or other
  misc_feature (393)..(393): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtcaggcgagggccacgtggtactcccggcaggttcaggtggtaggtgggtctggggacaggtacgttcgttctcacatcagcagcctgcngtctgtaagtgtttgacttagtttattactgtacagtctacttataattacggttcgccgtcttcgtaccggtttcgggacgggtacgggaccgtaaggggtcggacgccgtaacgaaaaccgtcgttagggtcggtcgtcgacccaccgtactccgttgtcccttctacgttccccg

SEQ ID NO: 160468 - DNA, 571 bp, Homo sapiens
  misc_feature: GYAE6OF01EZTGF.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgccgtccagcgagggccagtggtactcccggcaggttcaggtggtagtggggtctggggacaggtacgttcgttctacgaccatcagcagccgtgcagtctagaagtatttgcttagtttattactgtcagtctacttaataagtaggttcggcccgtcttaccgtacgtttccgggacgggtaacgggtaccgaagggtggaacgaccgtaacgaaaaccggtacgtggtacggctcggacacgtctacttcttcgttccttcgtaccg

SEQ ID NO: 160469 - DNA, 538 bp, Homo sapiens
  misc_feature: GYAE6OF01C2U5X.9.67.G01.1.454.CMB.1.raw
  modified_base (303)..(303): a, c, t, g, unknown or other
  misc_feature (303)..(303): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagacgacctggcttggcctcccgagggtcctcatctacggngcgtccagcagggccacgtggtactcccggctaggtcaggtggtagtgggtctgggactaggtagttcgttctcaccatcagcagctgcagtctagtaatgtttgacttagtttattactgtcagctaactataagtgttcgcctctcgtacgttcgggcggtaagggaccgaagggtcggacgcgtacgaaacgtacgtggtggctgaccaactcttcgtnttctntcttcccg

SEQ ID NO: 160470 - DNA, 512 bp, Homo sapiens
  misc_feature: GYAE6OF01AS47K.9.67.G01.1.454.CMB.1.raw
  modified_base (507)..(507): a, c, t, g, unknown or other
  misc_feature (507)..(507): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtacccagcagagacctggcttggctcccagggtcctcatctacggtgcgtccagcagggccactggtatcccggcaggttcagtggtagtgggtctgggacagagttcgttctcaccatcagcagcctgcagtctgaagtattttgctagtttattactgtcagcactataatagttggaccgctctacgtttcggcggtacgggaccaagggtggagctacgaaacgactgtggctgcacatctgtcttcnttccc

SEQ ID NO: 160471 - DNA, 515 bp, Homo sapiens
  misc_feature: GYAE6OF01CLN43.9.67.G01.1.454.CMB.1.raw
  modified_base (396)..(396): a, c, t, g, unknown or other
  misc_feature (396)..(396): n is a, c, g, or t
  modified_base (508)..(508): a, c, t, g, unknown or other
  misc_feature (508)..(508): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccacttagcctggtaccagcagagacctggcttggctcccgagggtcctcatctacggtgcgtccagcagggccactggtactcccggcaggttcagtggtaggtgggtctgggacagagttcgttctcaccatcagcagcctgcagtctgaagtntttgctagtttattactgtcagctatataatagttgcgtctctacgtttcggacggaggaccgaagggtggagtcgtacaaacgtacgtggtggctgctaccatctgtcttncttcccg

SEQ ID NO: 160472 - DNA, 576 bp, Homo sapiens
  misc_feature: GYAE6OF01BA0PE.9.67.G01.1.454.CMB.1.raw
  modified_base (401)..(401): a, c, t, g, unknown or other
  misc_feature (401)..(401): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcaggccagtcagagtcttggcaccaacttagcctggtaccagcagagacctggcttggcctcccgagggtcctcactcgtacggtgcgtccagcagggccagtggtactcccggctaggttcaggtggtagtgggtctgggacaggtacgtttccgttcaccgactattccaggcacgccgtnccagtctaggaagttgttttcgactttaaggtttacttacgttgtctagactaacttataagttcgttcgcctactcgttacgtttcgggacgggtacggacgtaagggtcggactacgaacgaaacgtcgtgtacggctacgaccacgtcttcttagttccttgtccgttcccg

SEQ ID NO: 160473 - DNA, 573 bp, Homo sapiens
  misc_feature: GYAE6OF01CJYJK.9.67.G01.1.454.CMB.1.raw
  modified_base (302)..(302): a, c, t, g, unknown or other
  misc_feature (302)..(302): n is a, c, g, or t
  modified_base (372)..(372): a, c, t, g, unknown or other
  misc_feature (372)..(372): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtcctcatctacggtncgtccagcagggccagtggtactcccggcaggtcaggtggtaggtgggtcgtgggacaggtagttcgtcncaccatcagcacgcctgctagtctagaagtatttgacttagtttattactgtacagctaactataagttgttcggtcctatccgtacgttttcgggacgggtaacgggtaccgaagggttcgggagtccgtaacgaaaccggtaacgttggtagggccttacggccaaccgtactccgttagtcctttcgacgtttccccg

SEQ ID NO: 160474 - DNA, 520 bp, Homo sapiens
  misc_feature: GYAE6OF01CJTBT.9.67.G01.1.454.CMB.1.raw
  modified_base (204)..(204): a, c, t, g, unknown or other
  misc_feature (204)..(204): n is a, c, g, or t
  modified_base (513)..(513): a, c, t, g, unknown or other
  misc_feature (513)..(513): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccagcagagacctggcttggctcccgaggtcctcatctacggtgcgtccagcagggccacgtggtactcccggcaggttcaggtggtagtgggtctgggacagagttcgttctcaccatcagcagcctgcagtctagaagtatttgctagtttattactgtcagctactataatagttcgccgtctctacgttcggacggagggacgtaagggtggagctacgaacgtacgtgtcggctgcacctatctgtcttcncttcccg

SEQ ID NO: 160475 - DNA, 513 bp, Homo sapiens
  misc_feature: GYAE6OF01ANXPJ.9.67.G01.1.454.CMB.1.raw
  modified_base (358)..(358): a, c, t, g, unknown or other
  misc_feature (358)..(358): n is a, c, g, or t
  modified_base (489)..(489): a, c, t, g, unknown or other
  misc_feature (489)..(489): n is a, c, g, or t
  modified_base (498)..(498): a, c, t, g, unknown or other
  misc_feature (498)..(498): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccaggtcctcatctacggtgcgtccagcagggccacgtggtactcccggcaggttcaggtggtagtgggtctgggacngtagttcgtctcaccatcagtcagcctgcagtctagagtatttgctagttattactgtcagctatataatagttgcctctctacgtttcgacggtaggaccaaggtgagactacgaaacgtactggcggcngcaccgtanctgtcctgtctcccg

SEQ ID NO: 160476 - DNA, 595 bp, Homo sapiens
  misc_feature: GYAE6OF01DMG7P.9.67.G01.1.454.CMB.1.raw
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacngccactctcacctgcgagggccagtcagngtctggccaccaattagcctggaccagcagacgaccgtggtcttggcctcccgagggtcctcactcgtacggtcgcgtccaggcgacgggccacgtcggtactcccggctaggttcgaggttcggtaggtcgggtactggggaactaggtacgtttccgtctacaccgtatcgagcgagcctgctagtcgtagtaagtnttttgnttagtttatcgtgtcagctaactagttaagtgttcggcctcgtacgtacggtttcgggacgggtaacgggaccgtaagggtcggtagaccgtaacgaaaccggtagtcggtcggtccgtcgacctaccgtacttcgtagtttccttcgtacttccccg

SEQ ID NO: 160477 - DNA, 257 bp, Homo sapiens
  misc_feature: GYAE6OF01CSG2D.9.67.G01.1.454.CMB.1.raw
  modified_base (251)..(257): a, c, t, g, unknown or other
  misc_feature (251)..(257): n is a, c, g, or t
tcagtgatacgtctcacgaccggtgctcgatttagagtatacatagtgggtctgggacagagttcgttctcaccatcagcagcctgcagtctgaagattttgcagtttattactgtcagcactataatagttggccgctcactttcggcggagggaccaaggtggagctacaaacgactgtggctgcaccatctgtctcatcttccgccatctgaagacgtatcactgagcgggctggcaaggcgcatagnnnnnnn

SEQ ID NO: 160478 - DNA, 579 bp, Homo sapiens
  misc_feature: GYAE6OF01A2CCR.9.67.G01.1.454.CMB.1.raw
  modified_base (361)..(361): a, c, t, g, unknown or other
  misc_feature (361)..(361): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtcctcatcgtacggtgcgtccagcgagggccacgtcggtactccccggcaggttcaggtggtaggtgggtcgngggacaggtagttcgtctcgacctatcaggcacgcctgcagtctgaagtgtttgacgtagtttacttactgtacagtctactaataacgtagttcggccgtcgtacgtacgtttcgggacgggtacgggaccgaagggtcggacgtccgtaacgaaaccggtacgttggtcggtctacggacctaccgtattacgttagttccttcgtccgttacccg

SEQ ID NO: 160479 - DNA, 629 bp, Homo sapiens
  misc_feature: GYAE6OF01D2NQE.9.67.G01.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccagcaggacgacctggcttcggcctccgagggtccctacgtactccgtacggtcgtccgtccgaggtcgacgggcctacgtcggtaccgtccccggtacgtacggttcgaagggttcggtagggtcgggtcgtaggggactaggtacggtttccgttcgtaccacctacgtcgacgtcgacgtccgtcgacgtagtcgtaggtaagtttagtttgtacgttaagttttacttacgtgtacgacgtactaagttaataagttcggtcgctcgtccgtagtttcgggacggtacggacgtagggtggacgtacctacgaaacgtcgtaggtacggtcacgacctactacttcgttactccttcgtcttccccg

SEQ ID NO: 160480 - DNA, 793 bp, Homo sapiens
  misc_feature: GYAE6OF01ANC8J.9.67.G01.1.454.CMB.1.raw
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
  modified_base (310)..(310): a, c, t, g, unknown or other
  misc_feature (310)..(310): n is a, c, g, or t
tcagtgatacgtctcacgaccggtgctcgatttagagtatacatattgggtttggggtagggaacgtggctcagttaggacccagacggaaccatggaagccccagcgcagcttctcttctcctgctactctggctcccagataccactggaataatagtgatgacgcagtctccagccaccctgtctgtcgtttaccaggagaaacngccatctcacctgcagggccagtcagngtcttggcacaacttgcctggtaccagacagagactcgggcttcggcctcccgacgggtcctcacgtctacggcncgtccaggcgagggccctacgtgggtacctccccgggctacgggtttccaaggttcgggttacggttcggggtacttggggggaacctaggggtacggttttccggtttctaccgtaaccccgtagttccgaaacggtcccgtaaggtcccgttcggacgttaaccgggttccgttaggggtaaacgtttaacggttttttcgggaccctttaaaagggtttttactttaaccgttcgggtttacctaacggtctttaaacttaagtttaaacgttaacggtttccggggtaacccgttacggtttaccgttaccggttttaccgggggacgggtaacggggtaacccgtaagggggtttaccgggaggtaccccgtttaaaccggaaaaaccggttcggttacgggttcgggtaacccgttacggaacccttaaccgtacgtttccgttacggttcctttaaccccggtattttccccccgg

SEQ ID NO: 160481 - DNA, 637 bp, Homo sapiens
  misc_feature: GYAE6OF01BYDA0.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggcctcccagataccactggaataatagtgatgacgcagtctccagccaccctgtctgtgtttccaggagaaacagccactctcacctgcagggccagtcagagtctggcaccaattagcctggtaccagcagagacctggcttggcctccgagggtcctcatcgtacggtgccgtcagcagggccagtggtactcccggctaggtcaggtggtagtgggtcgtgggacaggtacgttcgtcctcaccagtcagcacgtccgtaggcctagtacgtaggtaagttagttttaggacgtttagttttaacgttacgttcgtactacggtactaacttaattaaacgttacggttcggtacccgtccgtaccggttacgtttccggggacgggtaacggggtacccgtaagggtacggacggtaccgtaaccgtaaacggtaacgttgggtacggtccgtacgtacctaaccgtacgttcgttacgttaccttcgtaaccgtttccccg

SEQ ID NO: 160482 - DNA, 592 bp, Homo sapiens
  misc_feature: GYAE6OF01B9NC2.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcgagggccagtggtactcccggcacggttcaggtggtagtggggtctggggacaggtagttcgttctcaccatcagcagcctgctagtctagtaagtattttgcttagtttattactgtcagtctactaataacgttagttcggaccgtctacgttacgtttccgggacgggtacgggtaaccgaaggggtacggaggtaccgtaacgaaaacgggtaaccgttgggtacggtcgtacgtaccgaaccgttacttcgttagttcctttcgtcctttacccccgg

SEQ ID NO: 160483 - DNA, 576 bp, Homo sapiens
  misc_feature: GYAE6OF01C53LV.9.67.G01.1.454.CMB.1.raw
  modified_base (416)..(416): a, c, t, g, unknown or other
  misc_feature (416)..(416): n is a, c, g, or t
  modified_base (481)..(481): a, c, t, g, unknown or other
  misc_feature (481)..(481): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagccaccctgtctgtgtttccaggagaaacagccactctcacctgcagggccagtcagagtcttggcaccaattacgcctggtaccagcaagagacctggcttggcctcccgagggtcctcatctacggtgcgtccagcgagggccacgtggtactccccggctaggttcaggtggtaggtcgggtcgtgggactaggtacgttcgttctccgaccatcagcagcctgctagtctagtaagttntttgacttagtttattactgtcagctactaataagttagtcgtccgtacttcgtacgtttcgggnggtaacgggtacgaagggtaggacgcgttaacgaaacggtacgttgggtacggcgtcgtacccacgtagttccgtttgtcccttcgtacttcccg

SEQ ID NO: 160484 - DNA, 563 bp, Homo sapiens
  misc_feature: GYAE6OF01B6BYN.9.67.G01.1.454.CMB.1.raw
tcagtgatacgtctcacgaccggtgctcgatttagagtatacatattgggtttggggaggaactgctcagttaggacccagacggaaccatggaagccccagcgcagcttctcttcctcctgctactctggctccagataccactggaataatagtgatgacgcagtctccagccaccctgtctgtgtttccaggagaaacagccactctcacctgcagggccagtcagagtcttggcaccaacttagcctggtaccagcagtagacctggcttggctcccgagggtcctcatcacggtgcgtccagcagggccacgtcggtactcccggcaggttcaggtggtagtgggtctggggacaggagtttcgtctcaccatcagcagcctgcagtctagaagtattttgcttagtttattacgtgtcagacaacttataattcggttgaccgtcttccgtacgtttcgggacgggtaacgggtaccgaagggtggaacgtctaacgaaacggtactggtacggccttagaccgtacctagttccgtagtcctttcacgtttccccg

SEQ ID NO: 160485 - DNA, 530 bp, Homo sapiens
  misc_feature: GYAE6OF01BEDK8.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgcgtccagcagggccactggtactcccggcaggttcagtggtagtgggtctgggacaggtagttcgtctcaccatcagcagcctgcagtctgaagtatttgctagtttattactgtcagctactataatgttggaccgtctcgtacgtttcgggcgtagggacgtaagggtggacgtcgtacgaaacgtacgtggtacggtctacgcactactctagtcttcgcttcccg

SEQ ID NO: 160486 - DNA, 388 bp, Homo sapiens
  misc_feature: GYAE6OF01DEMGE.9.67.G01.1.454.CMB.1.raw
  modified_base (198)..(198): a, c, t, g, unknown or other
  misc_feature (198)..(198): n is a, c, g, or t
  modified_base (350)..(350): a, c, t, g, unknown or other
  misc_feature (350)..(350): n is a, c, g, or t
  modified_base (379)..(388): a, c, t, g, unknown or other
  misc_feature (379)..(388): n is a, c, g, or t
tcagtgatacgtctcacgaccggtgctcgatttagagtatacatattgggtttgggggaggatctgctcagttaggacccagacggaaccatggaagccccagcgcagcttctcttcctcctgctactctggctcccagataccactggaataatagtgatgacgcagtctccagccacctgtctgtgtttccagganaaacagccactctcacctgcagggccagtcagagtcttggcaccaactagcctggtaccagcagagacctggcttggcctcccgagggtcctcatctacggactgtcggctgccacatctgtcttcatcctcccgcatcagaacgtactacncactgagcggctaggcgaaggcgcatagnnnnnnnnnn

SEQ ID NO: 160487 - DNA, 528 bp, Homo sapiens
  misc_feature: GYAE6OF01CYYWE.9.67.G01.1.454.CMB.1.raw
  modified_base (364)..(364): a, c, t, g, unknown or other
  misc_feature (364)..(364): n is a, c, g, or t
  modified_base (377)..(377): a, c, t, g, unknown or other
  misc_feature (377)..(377): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatcgtacggtgcgtccagcgagggccactgggtactcccggcaggttcagtggtagtgggtctgggacaggngttcgtctcaccntcagcagcctgctagtctagagtatttgctagtttattactgtcagtcaactataagtagttcggctctctacgtttcgggacggacggacgaaggtggagctacgaaacgaactggtcggctagccacgtactctgttcctgtcttcccg

SEQ ID NO: 160488 - DNA, 592 bp, Homo sapiens
  misc_feature: GYAE6OF01DWLAZ.9.67.G01.1.454.CMB.1.raw
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccacctgtctgtgtttccaggagaacagccactctcacctgcgagggccagtcagagtcttggcaacctaacttacgcctggtaccagcagagacctggcttggcctcccgaggtcctcatccgtacggtcgccgtcaggcgacgggcctagtcggacgtcccggctaggttcgaggttggtaggtgggtacgngggacngtacgttcgttcacacctatcgagcacgtctgctagtcgtagtaagttcgtttagtacttaagtttacttacgttagtactagtactaacttataagttaggtcgaccgtcgtcgttacgtttacgggacggtaacgggacgtaagggtgacgtacgtaacgaaacgtacgtggtacggtctacgacctacgtacttactcgttccttctcgttcccg

SEQ ID NO: 160489 - DNA, 565 bp, Homo sapiens
  misc_feature: GYAE6OF01BG0ZM.9.67.G01.1.454.CMB.1.raw
  modified_base (556)..(556): a, c, t, g, unknown or other
  misc_feature (556)..(556): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcaggccagtcagagtcttggcaccaacttagcctggtaccagcagagacctggcttggcctcccgagggtcctcatcgtacggtgccgtccagcgagggccacgtggtactcccggctaggttcaggtggtaggtggggtctgggacaggtagttcgtctcacatcagcacgctgcagtctagaagtatttcgacttagtttattacgtgtcagtactactagtaagttacggtcggccgtcgtcgtacgtttcgggacggtacgggtaccgagggtcggacgtcgtaaccgaaacggtacgtggtcggctacgacccacgtactcgttagtccttcncgttacccg

SEQ ID NO: 160490 - DNA, 522 bp, Homo sapiens
  misc_feature: GYAE6OF01EJJ7H.9.67.G01.1.454.CMB.1.raw
  modified_base (516)..(516): a, c, t, g, unknown or other
  misc_feature (516)..(516): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccagtggtactccccggccaggttcaggtggtagtgggtctgggacaggagttcgttctcaccatcagcagcctgcagtctgaagtatttgctagtttattactgtcagcactaatatagttggccgctctacgtttccgggcggtagggacgaagggtggagtctaacgaaacgaactggtggctgccacatctagtcttcnttcccg

SEQ ID NO: 160491 - DNA, 548 bp, Homo sapiens
  misc_feature: GYAE6OF01BMANI.9.67.G01.1.454.CMB.1.raw
  modified_base (300)..(300): a, c, t, g, unknown or other
  misc_feature (300)..(300): n is a, c, g, or t
  modified_base (525)..(525): a, c, t, g, unknown or other
  misc_feature (525)..(525): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccaggtcctcatctacggtncgtccagcagggccatggtactcccggccagggttccaggtggtagtggggtctggggacaggtagttcgttctcgaccatcagcagcctgcagtctgaagtattttgctagtttatactgtcagtcacttataataggttggaccgtctcgtacgtttcgggcggtagggaccaagggtcggagtccgtacgtaaaccggacgttggtggtctgaccaaccgtntaccgtgttcttctacgttcccg

SEQ ID NO: 160492 - DNA, 602 bp, Homo sapiens
  misc_feature: GYAE6OF01DBLYU.9.67.G01.1.454.CMB.1.raw
  modified_base (206)..(206): a, c, t, g, unknown or other
  misc_feature (206)..(206): n is a, c, g, or t
  modified_base (306)..(306): a, c, t, g, unknown or other
  misc_feature (306)..(306): n is a, c, g, or t
  modified_base (421)..(421): a, c, t, g, unknown or other
  misc_feature (421)..(421): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgttgtttccaggagaaaacngccactctcacctgcagggccagtcagagtcttggcacctaacttacgcctggtacccagcagagacctggcttggctccagggtcctcatctacgggtnccgtcagcagggccagtggtactcccggcaggttcaggtggtacggtggggtctggggacaggtacggtttcgttctaccacattcgagccaacgcctagcagtcgtgaaagttnttttaggacttagtttattactgtacagtactaattaataattaggttcggacctcgttaccgttaccgtttacgggacgggtaacggggtaccgtaaggggtcggaacggtaccgtacgaaaacggtacgtaggtcggtcgtgaccctaacctacttcgtagttccttcacgtttccccg

SEQ ID NO: 160493 - DNA, 613 bp, Homo sapiens
  misc_feature: GYAE6OF01B2QL3.9.67.G01.1.454.CMB.1.raw
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtcctcatcgtacggtgcgtccagcgacggccacgtcggtactcccggctaggttcaggtggtagtgggtcgtgggactaggtacgttcgtctcacatcagcacgcctgctgtcgtagaagtagtttgacttagtttacttacgtgttacagtactaacttaagttaacgttaggttcggacccgtccgttacgtaccgttttcgggacgggtacgggaccgtaaggggttcgggaacgtccgtaaccggtaaaaccggtacgttaggtcgggtacgtcgacctacccgtattaccgttagtttcccttcgttaccgtttacccccg

SEQ ID NO: 160494 - DNA, 701 bp, Homo sapiens
  misc_feature: GYAE6OF01DX4OJ.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcgagggccagtcagtagtcttggcaaccaattgcctgtaccagcagacgacctggcttggcctccgaggtcctcatcgtacggtgcgtcagcgagggccacgtcggtactccccggacctagggttccaaggttcggtaggttcggggtcgtggggtactaagggttaggtttccggttacctcctaaccacgtttccaaggacctaacggccccgttggaccgtaacggttccgttaagaaaggtttacgtttttcggaaccgttaggtttttacttaaccgttgttactaggtacctaacgttaacttaagttcggttaccggtccgtacttaccgttacggttttccgggacgggtaacgggtaccgtaaggggttacggaacgggaccttaccggaaaaccggtaacgttagggtaccggtcgtaacggtcccgaaccgttacgtaccgtttgttacccttccgttactttacccccgg

SEQ ID NO: 160495 - DNA, 815 bp, Homo sapiens
  misc_feature: GYAE6OF01CWEUX.9.67.G01.1.454.CMB.1.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagccaccctgtctgtgttccaggagaaacngccactctcactgcgagggccagtcagngtctggacaccgaacttagcctaggtaccagcaggagaccgtggcttggcctacccgtagggtccctactacgtccgtacggtcgtcgtccaggccgacgggccctaacgttcgggtaccgtccccgggtaccgtacgggtttcgtaaggggttcgggttagggttacgggggttcgtacgggggtaacgtagggttaaccggtttccggtttacccttacctaaacccggtactttaccggaaccggtcccgtaacggttccccggtaggtacccgttaaggttccggtaacgttaaaggtttactttttacggtaaccgtttaagtttttaagtttaccgttacgttaaccgtacgtaaccgttaacgtttaaagtttaacggttaacgggtttccggacccggtttaccgttacccgtttaaccgggggtttaccggggaaccgggtaaccggggtaccggtaaagggggttcggaaccggtacgtaaaccgggtaaacggtaccggtgggttaccgcgttacccgtaccgtaacccgttgttaccgtttccgtaaccgtttcccgtacttttaccccccgg

SEQ ID NO: 160496 - DNA, 672 bp, Homo sapiens
  misc_feature: GYAE6OF01BZENU.9.67.G01.1.454.CMB.1.raw
  modified_base (203)..(203): a, c, t, g, unknown or other
  misc_feature (203)..(203): n is a, c, g, or t
  modified_base (596)..(596): a, c, t, g, unknown or other
  misc_feature (596)..(596): n is a, c, g, or t
  modified_base (626)..(626): a, c, t, g, unknown or other
  misc_feature (626)..(626): n is a, c, g, or t
tcagtgatacgtctcacgaccggtgctcgatttagagtatacatattggggtttgggggaggaactgctcagttaggacccagacggaaccatggaagccccagcgcagcttctcttcctcctgctactctggctccagataccactggaataatagtgatgacgcagtctcagccacctgtctgtcgtttccaggagaaacngccactctcactgcacgggccagtcagtactctggcaaccaattacgccgtagtaccagcaagacgacctggcttcggaccttccgacgggttcctacgattcgtacggtcggtccgtaccgaggccgacgggtccctacgttcgggtacctcccgggacgtaggttaccgaggttgggtaagttcggggtcgtaaggggtacctagggtacgtttcggtactcctaactacgtactacggacctacggtcctgtaccgtagtacgtagtaagttactttaggactttaagttttactacgttgtacgacttacctaagttaataagttacggttcggccctaacgtccgttacggtttacgggacggaaccggggtaacaagggtcggaacnccgttaaacgaacgggtaactggtacggtnaccgtactaccgtacgttactaccggttcttacgcgtttaccccgg

SEQ ID NO: 160497 - DNA, 589 bp, Homo sapiens
  misc_feature: GYAE6OF01DS5CX.9.67.G01.1.454.CMB.1.raw
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (319)..(319): a, c, t, g, unknown or other
  misc_feature (319)..(319): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggcctcccagataccactggaataatagtgatgacgcagtctcagccaccctgtctgtgttccagganaacngccactctcacctgcagggccagtcagngtcttggcaccaacttagcctgtaccagcagagcctggcttggctcccgaggtcctcatctacggtgccgtcagcagggccatggtacncccgcgtacggttcgaggttcggtaggtgggtccgtggggaactaggtacggtttcgttcacacccatcaagcagcctgcagtctagaagtagtttgacttagtttattacgtgttcgagtactaacgttaattaagttacggttcggaccgtcgtccgttaacgtttcgggacgggtacgggaaccgtaagggtcggacgtacgtaaccgaaaggtacccgtaggtcggctcggactaccgactcgttgttaccttgtaacgttccccg

SEQ ID NO: 160498 - DNA, 579 bp, Homo sapiens
  misc_feature: GYAE6OF01BYJZM.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatccgtacggtcgccgtccgagcgagggccacgtcggtactcccggcctaggttcaggtggtagtggggtctgggacaggtagttcgtctcacctatcagcagcctgcagtctagaagtatttgacttagtttattacgtgtcagtactaacttataagtcggttcgccgtctacgtacggtttccgggacgggtacgggaccgtaagggtcggacgtaccgtaacggaaacgtacgttggtcggtcgtcggaccaccgtacttctccgtttactcctagttccccg

SEQ ID NO: 160499 - DNA, 621 bp, Homo sapiens
  misc_feature: GYAE6OF01BYMZM.9.67.G01.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaattagcctggtaccagcagacgacctggcttggctcccagggtcctcactctacggtgccgtccagcgagggccacgtggtacgtccccggcctaggttcaggtggtaggtgggtctgggacaggtgttcgtctcaccatcagcagcctgcagtctagaagtatttgctagtttacttacgtgtactacgactaacttaactaagttcggttacggtcccggtacttaccgtaaccggtttcgggaccgggtaacggggaacccgtaaggggtcggtaaccggtaccgtaaccgaaaaccggtaacggttagggtacgggccttaccggaccaaccgtacttaccgttcggttacctttccgtacgtttaccccccg

SEQ ID NO: 160500 - DNA, 565 bp, Homo sapiens
  misc_feature: GYAE6OF01EX7B6.9.67.G01.1.454.CMB.1.raw
  modified_base (409)..(409): a, c, t, g, unknown or other
  misc_feature (409)..(409): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagaccgtggcttggctcccgagggtcctcatcgtacggtgcgtccgagcagggccacgtggtactcccggccaggttcaggtggtagtgggtcgtgggacaggtacggttcgtctcaccatcagcacgctgcagtctagtaagtntttggctagtttattacgtgtcagtctacttaatattacgtcggcgtctcgtacgtttcgggacggaacgggacgagggtcggagtaccgtaacgaaacgtacgtggtacggcgtacgaccgtaacgtacgttcttagttccttcgtcgttccccg

SEQ ID NO: 160501 - DNA, 711 bp, Homo sapiens
  misc_feature: GYAE6OF01E5Q3A.9.67.G01.1.454.CMB.1.raw
  modified_base (203)..(203): a, c, t, g, unknown or other
  misc_feature (203)..(203): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcacgggccagtcagacgttcgttcggacctaccctaacgtttacgcccgttaggtacccaggtcaggacgtaccgtggcttcggcctccccgcgggtcctcacgtccgtacggtgccgtcgacggcgacgggccctacgttcggtaccgtcccgggtctagggttcgacggttggtacggtggggtctagggactaggtcgttcgttctacaccgatcacggctacgtcctggactaggtacgtagtaagttagtttcggactttaacgtttactacgtgttacacgttactaacgttagttaacgtacgggttccggtacctaccgtttacgggttaccggtttacgggacggggtaacgggtaaccggtaagggtacggtacgtaaccgtaaaccgaaaccggttacgttcgggacggttcccgtacggtaccccttaacccgttactttcccggtttaaccttccgtttaaccgtccccgttttaccccgg

SEQ ID NO: 160502 - DNA, 429 bp, Homo sapiens
  misc_feature: GYAE6OF01C083O.9.67.G01.1.454.CMB.1.raw
  modified_base (294)..(294): a, c, t, g, unknown or other
  misc_feature (294)..(294): n is a, c, g, or t
  modified_base (399)..(429): a, c, t, g, unknown or other
  misc_feature (399)..(429): n is a, c, g, or t
tcagtgatacgtctcacgaccggtgctcgatttagagtatacatattggggtttggggggaggaactgctcagttaggacccagacggaaccatggaagccccagcgcagcttctcttcctcctgctactctggctcccagataccactggaataatagtgatgacgcagtctccagccaccctgtctgtgtttccaggagaaaacagccactctcacctgcagggccaagtcagagtcttggcacaacttagcctggtaccagcagagacctggcttggctcccagggtcctnatctagggactgtgactgacacatctgtcttcactcttcccgctaatcgtagaagtactactcaacgttggacgcgggctgggaaccaagggacgcgtaagtagnnnnnnnnnnnnnnnnnnnnnnnnnnnnnnn

SEQ ID NO: 160503 - DNA, 599 bp, Homo sapiens
  misc_feature: GYAE6OF01EF1HM.9.67.G01.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccagcagagacctggcttggctcccgagggtcctcatcgtacggtcgcgtccagcagggccacgtggtactcccggctaggttcaggtggtagtgggtctggggacaggtacgttcgtctcacctatcgagcagcctgcagtctagaagtatttgactagtttacttacgtgtcagtctaactataagttagtggccgtcttcgtacgtttcgggacgggtaacgggtaccgtaagggtacggacgtaccgtaaccgtaaaaccggtaacgttagggtacggtccgtacggaccctaaccgtacttaccgttagtttacccgtttcgtaccgtttacccccg

SEQ ID NO: 160504 - DNA, 632 bp, Homo sapiens
  misc_feature: GYAE6OF01EA7P5.9.67.G01.1.454.CMB.1.raw
  modified_base (204)..(204): a, c, t, g, unknown or other
  misc_feature (204)..(204): n is a, c, g, or t
  modified_base (420)..(420): a, c, t, g, unknown or other
  misc_feature (420)..(420): n is a, c, g, or t
  modified_base (443)..(443): a, c, t, g, unknown or other
  misc_feature (443)..(443): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaaacngccactctcacctgcagggccagtcagagtcttggcaccaacttgcctggtaccagcagagacctggcttggcctcccgagggtccctcatctacggttgcgtccagcagggccacgtggtactcccggacaggttccaggttggtagttggggtctcggggacaggtagtttccgttactcaaccgatcgagcacgcctgctagtctagtaagtntttcgacttagtttattacgttntcgtagctaacttataagtagttcggtccgtcttccgtacgtttccgggacgggtaacgggtaccggtaacgggttggaacggtacccgtaacggtaaaaccggtaaaccgtttggggtaccggtaccgttacggacccgtaacccgtacgttacccgttggtttaccccttagtaccgtttacccccg

SEQ ID NO: 160505 - DNA, 624 bp, Homo sapiens
  misc_feature: GYAE6OF01AELL8.9.67.G01.1.454.CMB.1.raw
  modified_base (206)..(206): a, c, t, g, unknown or other
  misc_feature (206)..(206): n is a, c, g, or t
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
tcagtgatacgtctcacgaccggtgctcgatttagagtatacatattgggtttgggggagggaacgtgctcagttaggacccagacggaaccatggaagccccagcgcagctctcttcctcctgctactctggctcccagataccactggaataatagtgatgacgcagtctccagccacctgtctgtcgtttccaggagtaaacncgcctactcctcacctgcgacgggccaggtacagtacgtcttggcaccaacttagcctggtaccngcngagactggctgcncctaggcctcatcgacggtnccgtcacgtcacgggccacgttggtacgtcccggactaggtttccaagggtcggtaaggtcgggtacgtcggggtacacggtacgtttcggttcacgtactagccgtagccgaagccgtgcgtagtccgtagtaacgtagtttcgacgttcgtttacttacgtcgtacgtacgtactagtactaagttacgttcggtaccgtctcgttacggttcggaggtaaccgggacaaaccgggtgacgtaacgtacgaaaccgttaacgtcggtagtccgttagaccctaccgtacgttccgttgtcttcgtacttccccgg

SEQ ID NO: 160506 - DNA, 531 bp, Homo sapiens
  misc_feature: GYAE6OF01EEV8B.9.67.G01.1.454.CMB.1.raw
  modified_base (362)..(362): a, c, t, g, unknown or other
  misc_feature (362)..(362): n is a, c, g, or t
  modified_base (525)..(525): a, c, t, g, unknown or other
  misc_feature (525)..(525): n is a, c, g, or t
tcagtgatacgtctcacgaccggtgctcgatttagagtatacatattgggtttggggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgccgtccagcagggccacgtggtactccccggcaggttcaggtggtagtgggtctgggacngagttcgtctcaccatcagcagcctgcagtctagaagtatttgctagtttattactgtacagctactataatagttcggcctctctacgtttcgggcggagggaccgaaggtggagactacgaaacgtaacgtggtacggctcgcaccgtactctgtcttctnttcccg

SEQ ID NO: 160507 - DNA, 634 bp, Homo sapiens
  misc_feature: GYAE6OF01DKCFJ.9.67.G01.1.454.CMB.1.raw
  modified_base (203)..(203): a, c, t, g, unknown or other
  misc_feature (203)..(203): n is a, c, g, or t
  modified_base (401)..(401): a, c, t, g, unknown or other
  misc_feature (401)..(401): n is a, c, g, or t
  modified_base (432)..(432): a, c, t, g, unknown or other
  misc_feature (432)..(432): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcgagggccagtcagagttcttggcaccaacttcgccgtggtaccagcaagagaccgtggcgtttcggacctcccgacgggtccctctacgtccgtacggtcgccgtccagcgacgggccacgtcggtacgtcccggcgtaggttcaggtggtaggtgggtcgtgggactaggtacgttcgttcncacatcagcgacgctgctagtctagtaagtntttcgacttagttttactacgttcgtacagtactaattattaagttacggtccggtaccgtcttaccgttacgtttcggggacgggtaacgggtaccgtaagggtcggtaacgtaccgtaaccgaaaacggtaacgttgggtacggtcgtacggtaccctaaccgtcgttacgttcgtttaccttccgtaccgtttcccccg

SEQ ID NO: 160508 - DNA, 723 bp, Homo sapiens
  misc_feature: GYAE6OF01D3T35.9.67.G01.1.454.CMB.1.raw
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggccaaccaacttagcctggtaccagcagacgacctggcttggctccgagggtcctcactctacggtcgcgtccaggcgacgggccacgttggtactccccggctaggttcaggtggtaggtgggtcgtggggactaggtacgtttcggttcctcgaccgtatccgaagccgacgccgttcgccgtaaggttcctaagggtaaacgtttagtttttacggtacttaacggtttttactttacgttcggttactaggtacctaaaccgtttaattaaacgttacgggtttacggcccgttaccgttaccgttaccggtttttccggggacggggtaacggggtaaccggtaaacggggttacgggtaacggtacccggttaaaccgaaaacgggtaaccggttagggttacgggtaccgttaccggaaccgtaacccgttaacgttacccgtttacggtttaccctttccgtacgttttaccccccgg

SEQ ID NO: 160509 - DNA, 645 bp, Homo sapiens
  misc_feature: GYAE6OF01BIMQX.9.67.G01.1.454.CMB.1.raw
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccagganaacngccactctcacctgcagggccagtcagtagtcttggcaccaacttagcctgtaccagcagagacctggcttggctcccgaggtcctcatccgtacggtcgccgtccgagccacgggccacgtggtactcccggctaggtcaggtggtagtgggtcgtagggactaggtacgtttcgttcctacgaaccctatcgtaagccgtaacgccttcggcgtacgttcgtaaggttaagttaacgttttcgtaccgttaaggtttttaattaccgttagttacgtaacgtaccttaacgtttaagttaaacgttacgggttcggacccgttcgttaccgttacggtttaccggggacggtaacgggtacgaagggtcggacgtcgtaacgaaacgtcgttggcggtctacgacctacccgtattcgttaggttccttcgtcttccccg

SEQ ID NO: 160510 - DNA, 606 bp, Homo sapiens
  misc_feature: GYAE6OF01E1R9W.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatcgtacggtgccgtccgagccgagggcccacgtcggtactccccggctaggttcaggtggtaggtcgggtctgggacaggtcgttcgtctcactatcagcacgctgcagtctgtaagtagtttgacgttagtttacttacgtcgtactacgtactacttaattaagttaggttcggccgtcgttcgtacgtttccgggacgggtacgggaccggtaagggtcgggacgtaccgtaacgtaaacggtaccgttaggtacggtccgtacgtacctaccgtacgttcgttacgttcctttccgtacgtttccccgg

SEQ ID NO: 160511 - DNA, 751 bp, Homo sapiens
  misc_feature: GYAE6OF01CBCP4.9.67.G01.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccagganaaacngccactctcacctgcgagggccagtcagagtcttggccaacctaacttacgccttacggtacccagacagacgacccgtggcttcggcctcccgagggtcctcagttccgtacggcgccgtccaggcgacgggcctacgtcgggtaccgtccccgggacctagggttccgaagggttcgggttaaggtcggggttcctagggggaactaggtacggttttccgttacctccaaccgtatccgacgcaacgtccgtgcgtagtcgtagtaagttagttttgtacgtttagttttacgttacgttaggttactacgtacctaaacgttaagtttaacgttacgggttccgtaccgttaccgttaccgttaccggttttaccggggacgggtaaccgggtaccggtaaacggggtacggtaacggtacccgttaaacggtaaaacccggtaacggttagggtaccggttaccggtaccggtaacccgtaacccgttacggtttacccgttaccgggttttacctttaccgttaacccgttttccccccgg

SEQ ID NO: 160512 - DNA, 539 bp, Homo sapiens
  misc_feature: GYAE6OF01CIXQY.9.67.G01.1.454.CMB.1.raw
  modified_base (400)..(400): a, c, t, g, unknown or other
  misc_feature (400)..(400): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgccgtccagcagggccagtggtactcccggcaggttcaggtggtagtgggtctgggacaggagttcgttcgtcaccgatcagcagcctgcagtctgaagtntttgctagtttatactgtcagctactataattacggtgacctctctacgttcggcggtacgggacctaagggtggagccttaacgaaaccgtgtgtacggctacggccaccgtattcgtacgttcttctacgttccccg

SEQ ID NO: 160513 - DNA, 631 bp, Homo sapiens
  misc_feature: GYAE6OF01BHXWS.9.67.G01.1.454.CMB.1.raw
  modified_base (291)..(291): a, c, t, g, unknown or other
  misc_feature (291)..(291): n is a, c, g, or t
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagcccaccctgtctgtgtttccaggagaaacagccactctcacctgcaggccagtcagagtcttggcaccaacttagcctggtaccagcagagacctggcttggcctccgagggtcctnatcgtacggtgccgtccgagccgtagggcctacgtcgggtactccccggctaggttccgaggttggtaggtcgggtctaggggactaggtacgtttcgtctacaacctatcgaagcagcctgcagtctagaatntttgacttagtttatacgtntacaacgtactaataagttacgtcgtcgtacccgtacgttaccgttaccgggtacgggaacgggtaacgtaacgggtaggtacggtaaccgtacgtaaaaccggtaacggtacggttccggacggttccgacccgtaaccgtcgttaccgttacgtttacttacccttacgttcccgtttaccccg

SEQ ID NO: 160514 - DNA, 623 bp, Homo sapiens
  misc_feature: GYAE6OF01BK6DX.9.67.G01.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (392)..(392): a, c, t, g, unknown or other
  misc_feature (392)..(392): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagcccacctgtctgtgtttccggganaaacngccactctcacctgcagggccagtcagagtcttggcacaacttagcctggtaccagcagacgacctggcttggcctaccgagggtcctcgactccgtacgggtcgccgtccgaggcgacgggcctacgtggtactcccgggctaggttccaggtcggtagtcgggtcgtgggacagtacgtttcgtcncgacatcgagcagcctgctgtcgtggtaattagtttgacttagtttacttacgtgtacctagtcctaagttaacttaagttacggttcggcccgtacttaccggtacgtttcggggacgggtacgggaaccgtaaggggtcgacggtaccgtaacgtaaaccggtacgtcggtacggtacgtcgaccgaaccgtactccgttacgttaccttctacgttcccgttacccgg

SEQ ID NO: 160515 - DNA, 579 bp, Homo sapiens
  misc_feature: GYAE6OF01A9M1Y.9.67.G01.1.454.CMB.1.raw
  modified_base (389)..(389): a, c, t, g, unknown or other
  misc_feature (389)..(389): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagcccaccctgtctgtgtttccaggagaaacagccactctcacctgcgagggccagtcagagtcttggccaccaacttagcctggtaccagcagagacctggcttggcctcccgagggtcctcatcgtacggtgcgtccagcgagggccacgtcggtacgtcccggcctagggttccaggtggtaggtgggtctgggactgtagttcgtctcaccntcagcacgcctgctagtcgtagaagtattttcgattagtttattactcgtacagtcctaattattaagttaggttcggcccgtcgtccttacggtttacgggcgggtagggtaccgagggtcggacgtctacgaaacgtacgtggtcgtcgtcgaccgtaccgtacttcgttgttcctgtccttaccccg

SEQ ID NO: 160516 - DNA, 604 bp, Homo sapiens
  misc_feature: GYAE6OF01DEME1.9.67.G01.1.454.CMB.1.raw
  modified_base (381)..(381): a, c, t, g, unknown or other
  misc_feature (381)..(381): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccacttgcctggtaccagcagacgaccgtggcttggcctccgagggtccctcagtccgtacggtcgccgtccagccgagggccacgtggtactcccggcgtaggtcaggtggtaggtgggtcgtggacagtgttcgttcncgacatcagtcagcctgctagtcgtagagtttagttcgtacttagttttactacgttgtcgagtcctaacttagttaacgttaggttcgacccgttcgttacgttaccggtttcgggcgggtaagggaccggtaagggtacggacgtccgtacgaaacggtacgttgggtacggcgttacggacctacgtacttacgttacggttccttcgtcgtttaccccg

SEQ ID NO: 160517 - DNA, 522 bp, Homo sapiens
  misc_feature: GYAE6OF01AU585.9.67.G01.1.454.CMB.1.raw
  modified_base (204)..(204): a, c, t, g, unknown or other
  misc_feature (204)..(204): n is a, c, g, or t
  modified_base (515)..(516): a, c, t, g, unknown or other
  misc_feature (515)..(516): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccagcagagacctggcttggctcccagggtcctcatctacggtgcgtccagcagggccactggtatccccggcaggttcagtggtagtggggtctgggacaggagttcgttctcaccatcagcagcctgcagtctgaagtattttgctagtttattactgtcagctactataatagttcggcctctctacgtttcgggcggtagggaccaagggtggagtctacaaacggtactggtggctgccactatctgtccttnnttcccg

SEQ ID NO: 160518 - DNA, 772 bp, Homo sapiens
  misc_feature: GYAE6OF01B7QEB.9.67.G01.1.454.CMB.1.raw
  modified_base (466)..(466): a, c, t, g, unknown or other
  misc_feature (466)..(466): n is a, c, g, or t
tcagtgatacgtctcacgaccggtgctcgatttagagtatacatattggggtttgggggaggaactgctcagttaggacccagacggaaccatggaagcccagcgcagcttctcttcctctgctactctggcctcccagataccactggaataatattgatgacgcagtctccacgccaccctgtctgttcgttccaggagaacacgccactctcaccgtgacgacgggccagtacgaggtagtccgttcggacctaacctaacgttacgtaccgtcggtaaccagacgtaacgacgtaccgtggtccgtttacggccctaccggtacgggttccctacgtacgttcgtacggtccgcgtacgacggcggtacggccctacgtcggtaccgtcccgggacgtacggttcgaggttcggtagggtcgggtcgagggtactaggtacgttccgttacgtccaaacgtntaccgagtaccgctccgtaggacccgttgtaccgtagggtaaacgtttacgttttacggaaccgttttagttttaccgtttacggtagtttacccgaagttacctaacgtttaagtaacgtttcgggttccgttacccggtaccgtttacgttacccgggtttacgggggaaccggttaacggggtaaccggtaggggtaccgggtaacgtaacccgtaaccggttaaaaggtccggttagggtacccggtcgttaccgacttacccgtactttcgttaccgtaccttcccgtaactttcccccgg

SEQ ID NO: 160519 - DNA, 552 bp, Homo sapiens
  misc_feature: GYAE6OF01B78E1.9.67.G01.1.454.CMB.1.raw
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagcccaccctgtctgtgtttccaggagaaacagccactctcacctgcagggccagtcagagtcttggcaccaacttagcctggtaccagcagacgacctggcttggctcccgagggtcctcatctacggtgcgtccagcagggccacgtggtactcccggcaggttcaggtggtagtgggtcgtgggacaggtagttcgtctacaccatcagcagccgtgctagtctagtagtagtttgacttagtttattacgtgtacagtctactataattacggttcgaccgtctacgtacgtttcgggacgggtacgggtacgagggtggacgtctacgaacgtacgtgtcggtcgtcgcaccgtatcgttagtcttctcttcccg

SEQ ID NO: 160520 - DNA, 684 bp, Homo sapiens
  misc_feature: GYAE6OF01BFC42.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtccctacactcgtacggtgcgtccgagcgacgggccctacgtcggtacgtccccggaccgtacgggttcgaggttgggtaacggttcgggggttaccgtagggggaacctagggttaacggtttccgttaccgtacccaaccgtatccgacgtccacgtcccgtgaccgtagtacgtagtaaggttagttttcggacgttagttttacttacgttgtacgtacgtactaacttaagttaagttacggttacggtccgtacttaccgtacggtttccgggacgggtaacgggtaaccgtaagggtacggtacggtaccgtaacgtaaaccggtaacgttggtacggtcgtacggacctaccgtacttacgttcgttaccttccgtaccgttaccccg

SEQ ID NO: 160521 - DNA, 573 bp, Homo sapiens
  misc_feature: GYAE6OF01DTNNV.9.67.G01.1.454.CMB.1.raw
  modified_base (333)..(333): a, c, t, g, unknown or other
  misc_feature (333)..(333): n is a, c, g, or t
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
  modified_base (404)..(404): a, c, t, g, unknown or other
  misc_feature (404)..(404): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcgagggccagtcagagtcttggcaccacttagcctggtaccagcaagacgacctggcttggcctcccgagggtccctcatcgtacggtgccgtccagcgagggccacgtggtacncccggcaggttcagtggtagtgggtctgggacagtgttctcncacatcagcngcctgcagtctagaagttntttgcttagtttattacgtgtcagcctagttaataagtgttcggcccgtcttaccgtacgtttcgggacgggtaacggggtaccgaagggtcggacgtacgtaccgaaaacggtacgtaggtcggcgttacgcgaaccctacttcgttcgttaccttcgtactttcccg

SEQ ID NO: 160522 - DNA, 577 bp, Homo sapiens
  misc_feature: GYAE6OF01B8NM2.9.67.G01.1.454.CMB.1.raw
  modified_base (204)..(204): a, c, t, g, unknown or other
  misc_feature (204)..(204): n is a, c, g, or t
  modified_base (400)..(400): a, c, t, g, unknown or other
  misc_feature (400)..(400): n is a, c, g, or t
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
  modified_base (452)..(452): a, c, t, g, unknown or other
  misc_feature (452)..(452): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttacgcctggaccagcagacgacctggcttggctcccgagggtcctcatcgtacggtgcgtccagccgagggccagtcgggtactcccggcgtaggttcaggtggtaggtcgggtctagggacagtacgttcgtctacgacatcagcagctgcngtctgatattgctagttntactgtanactctactaatacgtaggtcgtaccncgttacgtcgttcgggacggtaacggtacccgtaaggggtcgtacgccgtaaaccgaaacggtacgtgggtcggcgtacggaccctaacgtacgttccgttagttaccgttcgtacgtttccccg

SEQ ID NO: 160523 - DNA, 804 bp, Homo sapiens
  misc_feature: GYAE6OF01EPU9I.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagccacctgtctgtgtttccaggagaaacagccactctcacctgcgaacgggccagtcagacgtcttggcaaccaacgttagcctaggtaaccagacaaggacgacctggtcttcggcctcccgagggtccctacagtccgttaacgggtgccgtccgaagcgacggggccctaacgtacggtactccccggaccgtagggttccaaggtcggtagtgggtcgtaggaactagtacgtttcgtctacgacctatacacgacgacgtccgtacgtaccgtagttccgtaaggtaacgttaacgtttttcggaacgtttaacggtttttaaacgtttaacgtttaacggttacctaacggtaccttaaaacgtttaatttaaacggttaaacgggtttccgggtacccggttacccgtttaaccggttaacccgggtttttacccggggtaaccgggggtaaccggggtaaacccggtaaaacggggggttacgggtaaacggtacccgttaaaccgtaaaaaacccggggtaaacgttaaccgggggttaggaccggttacggtaaacccgttaacccgtaacgtttacccgttaacgttttacccgtttacgttaacccgtttaccccccgg

SEQ ID NO: 160524 - DNA, 711 bp, Homo sapiens
  misc_feature: GYAE6OF01CKFZP.9.67.G01.1.454.CMB.1.raw
  modified_base (205)..(205): a, c, t, g, unknown or other
  misc_feature (205)..(205): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagcccaccctgtctgtgtttccaggagaaacngccactctcacctgcagggccagtcagagtcttggcaccaacttagcctggtaccagcagacgaccgttggcttggcctcccgagggttccctctatccgtacggtcgccggtccaggccgagggcccacgttcggtaacgtccccggacgtacggttcgaggttcggtaggttggggtcgtggggactaggtaacgtttcgttactccgaacattccgagtccgacgtcctggactacgtctagtaagttacttttgtacttagtttacttacgttggtactacggtacttaacgttaagttaaacgttaggtttaccggtacccggttcctttacccgttaaccggtttttaccggggaaccgggtaacgggggtacccgtaaacgggggttacgggtaacgtacccgtaaaccggtaaaaccggtaacgttacgggtacggtccgtacggacccgtacccgtattacccggttactttccgttccgttacccgtttaccccgg

SEQ ID NO: 160525 - DNA, 726 bp, Homo sapiens
  misc_feature: GYAE6OF01BL5D9.9.67.G01.1.454.CMB.1.raw
  modified_base (298)..(298): a, c, t, g, unknown or other
  misc_feature (298)..(298): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaacagccactctcacctgcagggccagtcagtagtcttggaccacctaacttagcctggtaccagcgagacgccgtggcttggcctccgagggtccctnactcgtacggtcgccgtccaggccgtagggacccctaggtacggtaccgtccccgggaccgtacgggttccgaagggttcggtaggttcggggtcgtaggggaacgtaggtacgtttccgtacctcgaaccctagttaccgaggacctacgtcccgtaggtcctaacggttcgtaaggtaaagtttacgttttcggtaactttaaggttttacttaaccgttgtaccgtaaggtacctaaacgtttaagttaaagttcgggttccggtacccgttccgtaccggtttaccggtttaccggggacgggttaacgggtaccggtaaggggtaccggtaacgtaccgttaaacggtaaaccggtaacggttggtacggccttacggaccctacccgttatttccgttagttaccttcgttccttaccccgg

SEQ ID NO: 160526 - DNA, 683 bp, Homo sapiens
  misc_feature: GYAE6OF01BUYUT.9.67.G01.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccagganaaacgngccactctcacctgcagggccagtcagagtcttggcacctaattacgcctaggtaccagcagagacctggcttcggctcccgacgggtcctcatccgtacggtcgccgtaccgaggcgacgggccacgtcggtactcccggctaggttcgaggttggtaggtgggtcgtaggggtacaggtcgtttcgtctccgtaccgtacttacgacgccgtacgtccgtagtccgtagtcgtacggtaagttagttttacgtacgttaagttttacttaacgttcgtacgtagtccgtattaagtaacgttaggtccgtaccgtacgttacgttacgggttaccgggacgggttaacggggtaccgtaacgggtcgggtaccgtaacgttaacccggaaaaccgggttctaggggttacccgcggttacgtaaccctaccggtactttacccggttacgtttaccgttcctcccggtttacccccg

SEQ ID NO: 160527 - DNA, 256 bp, Homo sapiens
  misc_feature: GYAE6OF01A2T03.9.67.G01.1.454.CMB.1.raw
  modified_base (252)..(256): a, c, t, g, unknown or other
  misc_feature (252)..(256): n is a, c, g, or t
tcagtgatacgtctcacgaccggtgctcgatttagagtatacatagtgggtctgggacagagttcgttctcaccatcagcagcctgcagtctgaagattttgcagtttattactgtcagcactataatagttggccgctcactttcggcggagggaccaaggtggagctcaaacgaactgtggctgcaccatctgtcttcatcttcccgcatctgaagacgtatcactgagcgggctggcaaggcgcatagnnnnn

SEQ ID NO: 160528 - DNA, 648 bp, Homo sapiens
  misc_feature: GYAE6OF01AVFJ6.9.67.G01.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcaggccagtcagagtcttggcaccaacttagcctggtaccagcagacgactggcttggctcccgagggtcctcatcgtacggtgcgtccagcgagggccacgtggtactcccggcgtacggttcgaggttcggtaggtcgggtcgtgggacaggtacggtttcgttcacaccatcacgcacgtccgtgcgtagtcgtagtaagtagttttgacttaagttttacttacgtggtacctagtacctaaacgttaattaagtttacggttcggtccgtccgttaccgttaccggtttccgggacggggtaacgggtacccgtaaagggttcggtacggtaccgttaaaccggaaacgtaacggttggtacgggtaccgtacggacccgtaacctacgtttccgtttaccggttcttaaccgttcgttaccccg

SEQ ID NO: 160529 - DNA, 651 bp, Homo sapiens
  misc_feature: GYAE6OF01EFOKO.9.67.G01.1.454.CMB.1.raw
  modified_base (204)..(204): a, c, t, g, unknown or other
  misc_feature (204)..(204): n is a, c, g, or t
  modified_base (257)..(257): a, c, t, g, unknown or other
  misc_feature (257)..(257): n is a, c, g, or t
  modified_base (435)..(435): a, c, t, g, unknown or other
  misc_feature (435)..(435): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcacacttgcctggtaccngcagagacctggctggcctcccgagggtccctcatccgtacggtcgccgtaccaggcgacgggcctacgtggtacctcccgggacctaggttcaggttggtaggtcggggtcgtgggactaggtacgtttcggttactccactagtcacgtacacggcctggctagtctagtaagttntttgacttagtttacttacgtgtactagtacctaacttaagtaacgttaggttccggaccttaccgttaccggttaccggtttaccggggaccgggtaacggggtaacccgtaaggggtagggtaacgtaccgtaaacggaaaacccggttacgttacgggtcggtcctacggaccctaccgtacttcgtaccgtttcttacccgtctttccccgg

SEQ ID NO: 160530 - DNA, 726 bp, Homo sapiens
  misc_feature: GYAE6OF01AQTEC.9.67.G01.1.454.CMB.1.raw
  modified_base (209)..(209): a, c, t, g, unknown or other
  misc_feature (209)..(209): n is a, c, g, or t
  modified_base (241)..(241): a, c, t, g, unknown or other
  misc_feature (241)..(241): n is a, c, g, or t
  modified_base (265)..(265): a, c, t, g, unknown or other
  misc_feature (265)..(265): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggcctcccagataccactggaataatagtgatgacgcagtctccagcccaccctgttctgttcgtttccaggagaaacncgccactcctcacctgcgacgggccagtcagngtctggccacactagcctgtaccngcagacgcctggtctggcctccgaggtcctcagttacgtacggtcgccgtactaggcgaacgggcctacgtggtaccgcccggtcctaggttactagggtcggtaggtcgggtacgagggtaccgtagtacggtttccgttactacgacctagttccgacgtaccgtacgtccgtacgtacctaggttcgtaaggttaacgtttagtttcgtaacgtttaacggttttacttaccggttagttaccgtacgttaccgtaagtttaacgttaacgtttacggttccggtacccttaccgttacgttaccgggtttacgggacgggtaacgggtaaccggtaagggtacgggtaacgttacccgtaacggtaaaaccggtcggtttacggacgggtacgttaccggaaccgttacccgttacgttaccgtttaccggttaccttccgttacccgttaccccgg

SEQ ID NO: 160531 - DNA, 764 bp, Homo sapiens
  misc_feature: GYAE6OF01EVGGZ.9.67.G01.1.454.CMB.1.raw
  modified_base (206)..(206): a, c, t, g, unknown or other
  misc_feature (206)..(206): n is a, c, g, or t
tcagtgatacgtctcacgaccggtgctcgatttagagtatacatattgggtttggggggaggaactgctcagttaggacccagacggaaccatggaagccccagcgcagcttctcttcctcctgctactctggcctcccagataccactggaataatagtgatgacgcagtctccagcccacctgtctgtgtttccaggagaaacncgccactcctcacctgcgagggccagtcagtagtcttggcacctaacttagccgtcggtaccaggacagacgaccgtggctcggcctcccgagggtccctcgatcgtacggtcgccgtccgagcgacgggccctaggtcggttacgcccccgggtacgtacggttccgtagggttacggtagggttggggtcgtacgggacgtaggttacgtttcgttcctaccgtacacgttaccgacgacgtaccgtccgtacggaccgtacgtacggtacggttaaaggttacgtttttcggaacgttttaaggttttaaccttaccgttagtaccgtacggttaaccctaaactttaaggttaaccgttagggttaccggtacccgtccgtttaccggtacccgggtttcggggaacgggtaaccggggtaccggttaagggggtacgggaacgttaccgtaaacccggtaaaaccggtacggttcggggtaccggttacgtaccggtacccgtaaccgttacctttacggtttccgtaccctttccgtaccccgtttaccccg

SEQ ID NO: 160532 - DNA, 813 bp, Homo sapiens
  misc_feature: GYAE6OF01CJ7JY.9.67.G01.1.454.CMB.1.raw
  modified_base (173)..(173): a, c, t, g, unknown or other
  misc_feature (173)..(173): n is a, c, g, or t
  modified_base (597)..(597): a, c, t, g, unknown or other
  misc_feature (597)..(597): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggcctcccagataccactaggaataatagtgatgacgcagtcnccacgcccaccctgtctgttcgttaccgaggacgaaacacgccactcctccaccgtgacgaggccagtcagtacgtcgttcggaccaacctaacttacgtaccgttacggtaacccgaagaccgtaaggaacgtacccgttgggtccgttccggtaccctaccccggtacgggttcctacgtacgttccgtaccgggtcgcccgtaccgacggccggtaaccgggacccgtaccggttaccgggttaccccgtaccccgggtaccgttaacgggttacggtacggggttacgggttaggggttcgggggttaccggtacgggtaaccgtagggttacggtttaccgttacccgtacctaaccgtacgttaccgacggtccgtaaccgtccctaggaccgttaacgtcgttaaggtaaggttttnttttacggtacgttttaagtttaaccgtttacgtggttaccctagtacctaaagtttaacgttaaggtcgggttcccgaccgttaccgttacccggttacgggttaccgggggaacgggtaacgggtaccggtaaggggtacgtaacggtaccctaaagtaacccggagttcggacggtcactccgtaatcgtacgttctccgtactccgttcccg

SEQ ID NO: 160533 - DNA, 835 bp, Homo sapiens
  misc_feature: GYAE6OF01CGGZJ.9.67.G01.1.454.CMB.1.raw
  modified_base (208)..(208): a, c, t, g, unknown or other
  misc_feature (208)..(208): n is a, c, g, or t
tcagtgatacgtctcacgaccggtgctcgatttagagtatacatattggggtttgggggaggaactgctcagttaggacccagacggaaccatggaagccccagcgcagcttctcttcctcctgctactctggcctcccagataccactggaataatagtgatgacgcagtctccagcccaccctgtctgtcgtttccaggagaaacngccactcctcacctgcagggccagtcaagtacgttcttcggaccaacctaacgttacgccgtacggtaaccaggaccgaggacgtaccgttcgggtcgtttcggaccctaccccggacggggttcccctacgtacgttccgttaccgggtcggtaccgtccgaggaccggtacggggaccctacggttacggggttaccgtcccccgggtaccggttaacgggtttacggtaacggggtttcggggtttaacggggtcgggggttaccggtacggggggtaacctaagggttaccggttttccgttccgtacccgtaaccgtattacccgaagggtacccgacgggtcccgtacgggtaccgttaacgggttaccgttagggttaaacgggtttacgtttttaggaccggtttttaagttttaacgtttaccggtttcgttaccgtaacgtacctaactttaagttaaacggttacgggttaccggtaccggtccgttacccgttacgggtttccggggaacgggtaacgggaccggaagggttcggaacgtaccgtaaccgtaaacggtacgttggtacggaccgtcggaccctacgtacttcgttactccgttctccgttacccg

SEQ ID NO: 160534 - DNA, 888 bp, Homo sapiens
  misc_feature: GYAE6OF01C2EP0.9.67.G01.1.454.CMB.1.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagccaccctgtctgtgtttccaggagaaacngccactcncacctgcgagggccagtcagtagtcttggcacacttcgctcggtacagcagacgaccgtggcgttcggccgtcccgacgggtcctcgtatccgtacggtcgtccgtaccgaggccggacggcctacgtggttaccgtccccggtaccgtaagggttccgtagggttagggttacgggttcgggggttacggtcggggaacgtagggttaccgtttcggttttacccgaccgtaaccgtacgttacgaacggtccgtacgtacccgtggtcccggtaacgttcgggttaaacggtaaacgtttttacggttttacgttaacgtttacgttttttaactttcggttacggttaaccgtaacggttacctttaaacggtttaaacgttttaaacgggttaacggggttttcccgggtacccgttaccgttttaacccggtttaccggggggtttttacccgggggaacccgggggttaaaaccggggtacccgggtaaaacggggggtttccgggaaaaacccgggtcccgttaaaaaccccggggtaaaaacgggttaccggtttaccgggggttaacgggttcccggtaacccgggtaacccgttaaccccgtttaacggttttcccgttttaacggtttacccccgttttacggttccccgtttttaacccccccgg

SEQ ID NO: 160535 - DNA, 586 bp, Homo sapiens
  misc_feature: GYAE6OF01CHKGI.9.67.G01.1.454.CMB.1.raw
  modified_base (265)..(265): a, c, t, g, unknown or other
  misc_feature (265)..(265): n is a, c, g, or t
  modified_base (304)..(304): a, c, t, g, unknown or other
  misc_feature (304)..(304): n is a, c, g, or t
  modified_base (330)..(330): a, c, t, g, unknown or other
  misc_feature (330)..(330): n is a, c, g, or t
  modified_base (376)..(376): a, c, t, g, unknown or other
  misc_feature (376)..(376): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccaggtcagagtcttggcaccattagcctggtaccagcaganaccgtggcttggctcccgagggtcctcactcgtacggtnccgtccagcgacggccacgtggtacncccggccaggttcaggtggtagtgggtctgggacagtagttcttcncacatcgagcacgcctgcagtctgaatgtttgacttagtttacttacgtgtactagctaacttataagttaggttcgacccgtcgttacttaccggtttccgggacggtaacggggacctaaaggggtcggaacgtaccgtacgaaaacggtacgttggtacggcttaccggctaacccgtatccgttagtcctttcgaccgtttccccg

SEQ ID NO: 160536 - DNA, 891 bp, Homo sapiens
  misc_feature: GYAE6OF01BS7IM.9.67.G01.1.454.CMB.1.raw
  modified_base (199)..(199): a, c, t, g, unknown or other
  misc_feature (199)..(199): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagcccacctgtctgtgtttccagganaacagccactctcacctgcacgggccagtcagtacgttcgttgggaccaacctaacgttacgcccgttacggttaacccaaggccaacggtaacgacccgttgggtaccgtttcggggaccccttaccccggaacggggttacccccttacgaacgtttcccggttaaccggggtcggtacccggttacccgaaggtacccggaacgggggaccccttaccgggttacgggttaacccgtccccccggggaccgttaacggggttttacccaagggggtttcgggttaacgggttcgggggtttaacgtacgggggtaacctaacgggttacgtttcccggtttaccctaccgaacccgtattcccgaacggccgtacgtcccgtggaccgtacggttccgtaaggttaaacgttacgtttttacggaaccgtttaagttttactttaaccgtacggtaaccgtaacggtaccgttaaacttaagttaaacgtttacgggttaccggtaccccggttacttaccggttaacccgggtttaccgggtaaccgggtaacggggtaacccgtaacggggttcggaaccgttaccgtaaaccggtaaaaccggtacgtttacggggtaccggtcgtaacgtacccgtaaccgtttaacgtaccgtttacgtcctttacccgcgttttaacccccgg

SEQ ID NO: 160537 - DNA, 830 bp, Homo sapiens
  misc_feature: GYAE6OF01ESFWI.9.67.G01.1.454.CMB.1.raw
  modified_base (158)..(158): a, c, t, g, unknown or other
  misc_feature (158)..(158): n is a, c, g, or t
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtnatgacgcagtcctccagcccaccctgtctgtcgttccagganaacngccactcctcacctgacaggccagtcgagacttcgttcggaccaacctaacttacgccgtacggtaccacggacacgacgaccgtggtcgttcggaccgtaccccgagggtccctactagttccggtacggtccgccgtcgacggaccgacggtcccagtccgggtaccgtcccgggtacctacgggttcgaacggtttcgggtaggttcggggtacggttagggaccgtaggttacgtttccggttacgtacccgtacctagtaccgacggacctaccgtaccgtacggtaccgtacggtaccgttaaggtaaccgtttagttttacgtaccgtttaacgtttttacgttttaccgttacgtacgtaaccgtaaccgtaacgtttaacgttaacggtttacgggttaccggtacccgttaccggtttacccgttaacccgggttttccggggaaccggggtaaccgggtaaccggtaaacggggttaccgggtaaccggttaacccgtaaccggttaaaaacccggttcgttaaccggggttaccggtaccggttacccggaaccttacccgttaaaccgtttaccttacggtttaacccgtttacccgtaccgtttacccccgg

SEQ ID NO: 160538 - DNA, 836 bp, Homo sapiens
  misc_feature: GYAE6OF01BGZSB.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagactaccactggaataatagtgatgacgcagtctccagccctacctgtctgttcgtttaccgaggagaacagccactctccacgtcgacgacgggccacgtcagtacggtaccgttcggacctaacctaaacgtttaccggcccgttacggaaccacggacgtaacggacggtaccgtcgggtccgtttcggcccgttaccccgtacgggttccctacgtcttacccggtacgggttcggacccgtccgacggacccggtacgggccctacgggtaccggtaccccggtcccgggtaccgtacgggttacgtaacggggttacgggtacgggttcggggttaccggtaggggtaacctaggggtttaccgtttccgtacgtaccgaccgtaagtccgagaccgtacggtccgtcgtacgttaccggtagtacggttaaagtttagttttagtaaccgtttttaagtttacgtttacgttacgtacgtaacgtaaccgtttaagttaagtaaacggtttcggttaccggaccgttacccgttacgttaaccggggtttcggggaaccgggttaacgggaacggttaagggttccgggaactacccggtaaaaggaaccgttacgggtcggtacggtactacccgggtactaaccgttcgttacggttaacccgtttcgttaaccctccgtttaccccgg

SEQ ID NO: 160539 - DNA, 678 bp, Homo sapiens
  misc_feature: GYAE6OF01BYTAO.9.67.G01.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccacctgtctgtgtttccagganaaacngccactctcacctgcagggccagtcagagtcttggcaccaacttacgcctggtaccagcagacgacctggcttggcctcccgagggtcctacatcgtacggtgccgtccaggcgacgggcccacgtggtactccccggactagggttccagggttcggtacggtgggtcgtggggactaggtacgtttccgtctccgacctagtcgagcacgtcctgacgtacgttcgtaaggtaacgtttgttttacgactttaggttttactttacgtgttaccgagttaccgtaattaacgttaaggtttacggttccggtcccgtacttacccggttaccggtttacggggaccggtaacgggtacccgaaggggttcggaacgtaccgtaaccggtaaacggtaccgttgggtacggtccgttaccggacccgtaaccgttcgttacccgttacgtttccgttccgtacgtttccccccgg

SEQ ID NO: 160540 - DNA, 652 bp, Homo sapiens
  misc_feature: GYAE6OF01CU3Y2.9.67.G01.1.454.CMB.1.raw
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (276)..(276): a, c, t, g, unknown or other
  misc_feature (276)..(276): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (320)..(320): a, c, t, g, unknown or other
  misc_feature (320)..(320): n is a, c, g, or t
  modified_base (348)..(348): a, c, t, g, unknown or other
  misc_feature (348)..(348): n is a, c, g, or t
tcagtgatacgtctcacgaccggtgctcgatttagagtatacatattgggtttgggggaggaactgctcagttaggacccagacggaaccatggaagccccagcgcagccttctcttcctcctgctactctggcctcccagataccacgtaggaaataatagtgatgacgcagtctccacgccacctgtctgttcgtttccaagganaaacncgccactctcacctgcacgggcctatcgagagttccttggcctaacgattacgcgtcgtaccancgaagacgccgtgcttcggccnccgaggtcctcntacgtggtcnccgtcgcgacgcggcctagtcggtaccncccggtacgtacggttcgtaaggttggttacgggcgggttacgacgggtactaagggtcgtttccgttcacgacctagtgacgacgtcggctgactagtctagttacgttagtttgtacgttagttttagttacctaggtactactaactaacgttaaagttagggttacgtttccgaaccttcgttaccgtcggttaccgggacgggttaacgggagttaacggggctacgtacgtaacgaaagttccggtagacggttacgcccgacgtactacgttcttatttactccgttaccttccccg

SEQ ID NO: 160541 - DNA, 723 bp, Homo sapiens
  misc_feature: GYAE6OF01BQT7J.9.67.G01.1.454.CMB.1.raw
  modified_base (199)..(199): a, c, t, g, unknown or other
  misc_feature (199)..(199): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccagganaaacagccactctcacctgcgagggccagtcagagtctggcaccaacttagcctggtaccagcagagacctggcttggcctcccgagggtcctcactcgtacggtcgcgtccgagcgacgggcctacgtggtactcccggactaggttcaggttcggtaggtcgggtcgtagggacaggtcgtttcgtctccacgtatcgacgcgacgtcctgactagtcgtagtaacgttagtttacgacttaagttttactacgttcgtactacgtacttaacgttaagttaacgttacggttccggtacccgttaccgtaccgtttaaccgggttttaccggggaaccggggtaacggggtaaccggtaaggggtacggggtaaccgttaccgttaaaaccgggtaaaaccggtaacgggtttacggggttacgggtacccgttacccggtacccgttaaacccgttacggttttcccggtttaacggttttccccgttttaacccgttaccccggttttaacccccccgg

SEQ ID NO: 160542 - DNA, 380 bp, Homo sapiens
  misc_feature: GYAE6OF01ALBTY.9.67.G01.1.454.CMB.1.raw
  modified_base (204)..(204): a, c, t, g, unknown or other
  misc_feature (204)..(204): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
  modified_base (368)..(368): a, c, t, g, unknown or other
  misc_feature (368)..(368): n is a, c, g, or t
  modified_base (374)..(380): a, c, t, g, unknown or other
  misc_feature (374)..(380): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtacccagcagagacctggcttggctcccagggtcctcatctacggactgtggctgcaccatctgtcttcatctcccgcntctganacgtancactgagcgggctggcaaggcncatagnnnnnnn

SEQ ID NO: 160543 - DNA, 641 bp, Homo sapiens
  misc_feature: GYAE6OF01B9A11.9.67.G01.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtctggcacaacttagcctggtaccagcagagacctgggcttggcctcccgagggtcctcagttccgtacggtgccgtccgagggacgggccacgtggtactccccgggctagggttcagggtggtagtggggtctggggacaggagtttccgttctcaccatcgaacgcaggcctggcagtcgtagaagtattttggacttaagtttacttacgtgttccagtacctaacttaataagttacggtttcggcccgttacttaccgtaccggttttccggggacgggtaacggggaccgtaaggggtacggaggtacgtacgaaaaccggtacgttaggtcgggtaccgtcggaccctaaccgtaacgttcgtacggtttaccctttactccgtttcccgttacccccgg

SEQ ID NO: 160544 - DNA, 581 bp, Homo sapiens
  misc_feature: GYAE6OF01A3EXB.9.67.G01.1.454.CMB.1.raw
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtccctcactcgtacggtgccgtccaggcacgggccacgtcggtactccccgggctaggttcaggtggtaggtgggtctgggacagtagttcgtctcaccatcagcacgcctgcagtcgtagtaagtagttttgacttagtttattacgtgtacagtctaactattaataggttcggtccgtcgtaccgttaccgtttcgggacgggtacgggaccgtaagggtcggagtaccgtacgaaaccgtacgttggtcggcgtacgaccaccgtacttcgtcgttcttcgtacttcccg

SEQ ID NO: 160545 - DNA, 641 bp, Homo sapiens
  misc_feature: GYAE6OF01DYQB9.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccacgccaccctgtctgttcgtttaccaggagaaaacacgccactcctcacctgcgagggccagtcagagttcttcggacaccaacgttacgccttggtaccagcgaagacgaccgtggacgttcggcctaccgacggtcctcatacgtcggtcgccgtcgacgcgacgggtcctacgtggtaccgtcccggaccgtaggttacgaggtcggtagggtgggtacgtgggactaggtacgtttcgttcctacgaccctataccgacgccgacgtcctcgaccgtaagtcgttaaggtaagttcgttttacggactttaagttttacttacgttcgtacacgtactaacttaagttaagttacgttcggacctcgttccgtacggtttcgggacggtacggacgtaggtagactacgtaacgaaacgtcgtgcggtcacgaccacgttactacgttcttcttcgtcttcccg

SEQ ID NO: 160546 - DNA, 818 bp, Homo sapiens
  misc_feature: GYAE6OF01C35P9.9.67.G01.1.454.CMB.1.raw
  modified_base (778)..(778): a, c, t, g, unknown or other
  misc_feature (778)..(778): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctccagataccactaggaataatagtgatgacgcagtctcacgccaccctgtctgttgtttccaaggacgtaaaacagccactctacgacctgacgacgggaccagtacgaagtacgtcttacggactaaccgtaacttacgtccgtacggttaccaacgaccgtaaaggacgtaaccgttggtaccgtttcggcccttaccccggtaacgggtccccttacgtaaccgttccgtaacggttcgaccgttaccgacggaccggtacgggaccctacggttacggtaccgtaccccgggaccgttaacgggttcgtaaggttggtaacggttcgggtaaccgttagggaacgtaacggtttaacggtttccgttaccgttacgaaaccttacgtacgtaaacccgcgtaacggtccgttacggaccgtttaacggtcgtttaaagtaaggttttacgttttaacgacttttaaacggttttacttacggttacgtacgacgtacccttaaagtaagtttacgtacggtttcggaccttaccacgttaacgggttccggacgggttaacggaccggttaaggtcggtaacgttaccgtaaacggtaaaccggtacgttcggtacggtaccgttaccgaccgtttaacnccgtttaagtcccttaacgttaccgtaccgttaacccccg

SEQ ID NO: 160547 - DNA, 735 bp, Homo sapiens
  misc_feature: GYAE6OF01B0DMI.9.67.G01.1.454.CMB.1.raw
  modified_base (221)..(221): a, c, t, g, unknown or other
  misc_feature (221)..(221): n is a, c, g, or t
  modified_base (720)..(720): a, c, t, g, unknown or other
  misc_feature (720)..(720): n is a, c, g, or t
tcagtgatacgtctcacgaccggtgctcgatttagagtatacatattgggtttgggggaggaactgctcagttaggacccagacggaaccatggaacgccccagcgcagcttctcttcctcctgctactctggcctcccagaactaccactaggaataatagtgatgacgcgagtcctacacgccctacctgtcgtggttcgtttccgaaggaacgaaacncgacctactcctacacctgcgacggcagtcagtacgttcgtaggctaaccgtacttacgccgttacggaccaggtacaggaccgccgtggtcgttcggccgtcccggacggtttccacgtacgtaccggtacggtcgtaccgtcccgaagggcccgaccgggtccaaccggttccggtacccgtccccgggtaccgtaggttccgagggttggtacgggtggtaccggtaggtccagggttccgttccggtacctcgaaccgtagtccgaacgcgttaccggccgtgaccgtaggttcgtaaacgttacgtttagtttcgagttttaaacggtttacctttactacggttactaagttacccttaattacgttaacgttcgggtcccgtccgttaccttaccgggttcggttacccgggaacgggtaccggtaggtacggtcgtaacgtacgaaaccgtaaggtcgtaggccgtcaccgactaccgttctcgtaccttntcccgtccgttcccg

SEQ ID NO: 160548 - DNA, 857 bp, Homo sapiens
  misc_feature: GYAE6OF01DOFL1.9.67.G01.1.454.CMB.1.raw
tcagtgatacgtctcacgaccggtgctcgatttagagtatacatattgggtttggggaggaactgctcagttaggacccagacggaaccatggaagccccagcgcagcttctcttcctcctgctactctggcctcccagataccactggaataatagtgatgacgcagtcctccagccctacccgtgttctgttcgtttaccgaagggaacgaaaccagcccacttcctccaccgtggaccgacggggacctaggtaccgaaggtacggttccgttacgggaccctaaacccgttaacgtttaccggcccgtttacgggtaacccacggaccgaaggtaaccgtaccgttcgggtaccgtttcgggccctaccccggtacggggttccccttcgtacgttaccggtacgggtccgtaccgtaccagggccggtacgggaccctacggtcggtacccgtcccggacgttacgggttcagggttagggtacggttcgggtacggtagggtaacgtacggtttacgtttccggttctacctaccgtagtaccgagtaccgtacgtccgttacgacgttacggtacgttaggttaacgttttgtttacggtactttagtttaactttacgttacgtcgaacgtacttaagttaacgttacggttacggttccggtaacccgtcgttaaccgtttaccgggtttacggggaaccgggttaacgggtacgggaacgggttacggtaacggtaaccgttaaaccggaaaacgggttccggttacggtacggtacccggtacgtaaaccccgtacgttaactttacccgttacggtttacccttaccgttcccgtttacccccgg

SEQ ID NO: 160549 - DNA, 674 bp, Homo sapiens
  misc_feature: GYAE6OF01DF0SC.9.67.G01.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagccacctgtctgtgtttccagganaaacngccactctcactgcgaggccagtcagagtcttggcaccattcgctaggtacagcaagacgtaccgtggcttggcctccgaggtcctnagtctaggtcgcgtcagcgacgggccagtcggacgtcccggactaggttcaggttggtagtgggtcgtaggacgtagttacgttcgttcncacctntaccgngaccgtcgtccgtgcgtaagttcgtaagtacgtttgtttacgacttttaaggtttacttagtcgttacgacgttaactaactttaagtaacgtttcgggttaccggcccgttacgttacccgtttacggtttaccggggaaccgggtaacgggtaacccgtaaggggttaccgaacggttcccgttaaacggaaaccgggttaacgtgggttacggtacctaccgtaaccctaaccgttacgtttaccgttcggtttacccttccgtaccggttttacccccg

SEQ ID NO: 160550 - DNA, 769 bp, Homo sapiens
  misc_feature: GYAE6OF01DZW5G.9.67.G01.1.454.CMB.1.raw
  modified_base (179)..(179): a, c, t, g, unknown or other
  misc_feature (179)..(179): n is a, c, g, or t
  modified_base (217)..(217): a, c, t, g, unknown or other
  misc_feature (217)..(217): n is a, c, g, or t
  modified_base (492)..(492): a, c, t, g, unknown or other
  misc_feature (492)..(492): n is a, c, g, or t
tcagtgatacgtctcacgaccggtgctcgatttagagtatacatattgggtttgggggaggaactgctcagttaggacccagacggaaccatggaacgccccagcgcagcttcctcttcctcctgctactctcggcctcccagactaccatggtaaataagtagtgatcgacgcagtcnccgacgccaccttgtctgttcgttaccaaggaacaacncgccactccgtcacctgcgacggccagtacagtacgttcgtcgacctaacgtacgtacgcgttacgaccgagagaacgacgtcgaggtccgtcggcctaccggtaccggtcctcgtaacctcggtaccggtccgacctccgacggccgaccggccttaaccggttcgggaaccctcccgggacgttacggttacggtacgggtgggttacggttcggggtacgagggtaacccgtaagtttcccggtttctaccgacctaacgcgttaaccgacnccgtaacgtcgtaccgacgttaacgttaccggtaaggttaacgtttaacggtttcgttaacgttaacgtttttacgtacccgttagtaccgtacgtaacctttaaacggtaagtttacggtaaccgttccgggtacccttaccgttacggtttaccgggtaccggggaccgggtaacggacggtacggtcggtaacgtaccggtaaccgtaacggtcgtggtaccggtcctacgtaccctaacggtcctaccggttattccccttggtcccttcccg

SEQ ID NO: 160551 - DNA, 746 bp, Homo sapiens
  misc_feature: GYAE6OF01EDW31.9.67.G01.1.454.CMB.1.raw
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggccaacctaacttacgcctggtacccagcagacgaccgtggctttcggcctcccggacggtccctactacgtccggtacggtcgccgtaccgacgcggacggcctacgtgtacccgtcccggaccgtacggtcgtaggttcggtacggtcgggtcgtagggactacggttacgtttccgttcctacctacctataccgacgcgtacgtcctagaccgtagtaccgttaggttaaactttagtttacgtaacgttttaacgttttaacgtttcgttacgttaccgaacggtacttaaacgttaagtttaacgttaccgggttcggtacccgttacgtttacccgggttaccgggttttaccggggaaccgggggtaaccgggtaacccggttaaggggtcggtaaacccggtaccgtaaaaccggtaaaccggtaacgttaggggtccgtaccgaacggtaccctaccgttaccgttccttaacgttcctttacccgccgttttcccccg

SEQ ID NO: 160552 - DNA, 653 bp, Homo sapiens
  misc_feature: GYAE6OF01AIXH6.9.67.G01.1.454.CMB.1.raw
  modified_base (204)..(204): a, c, t, g, unknown or other
  misc_feature (204)..(204): n is a, c, g, or t
  modified_base (264)..(264): a, c, t, g, unknown or other
  misc_feature (264)..(264): n is a, c, g, or t
  modified_base (323)..(323): a, c, t, g, unknown or other
  misc_feature (323)..(323): n is a, c, g, or t
  modified_base (440)..(440): a, c, t, g, unknown or other
  misc_feature (440)..(440): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggacgaacncgccactctcactcgcacgggccagtcagacgtctggccaactactacggcctcggaccngacgacgacgacctggccttcggcctacccggtaggtccctacgtactccgtcgggtcnccgtcgacgtcgacgggcctacggtcggtacgtccccggtcgtacgggttctaggtacgggtaggtcgggtactgggactcggtacgttcgttacacgacctatcgacgcgacgtcngactacgtcgtagtacgtatttcggtaactttagtttagtacgttcacgaagtctaacgttataaggttacggttcgacccttgaccgttcccggttagggaccgggtacgggaacctaggggtacggcgtaaccgtaacgaaaccggtgtcggggtacgtcgtacggaccttaccggtattcccgtagtttccgtaatcccgtttaaccccg

SEQ ID NO: 160553 - DNA, 732 bp, Homo sapiens
  misc_feature: GYAE6OF01BIA68.9.67.G01.1.454.CMB.1.raw
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (719)..(719): a, c, t, g, unknown or other
  misc_feature (719)..(719): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagactaccactggaataatagtgatcgacgcagtctccagcccaccctgtctgtgtttccagganaaacngcctactctccacctgcacgggccagtcagacgtcttggacctacctaacttgcctggtaccagtcaggacctaccgtggtcttcggcccttcccgagggttcctacgactccgtacggttcgccgtccgaggccgagggtcccagtccggttacgcccccggtactacgggttccgaggttagggtacggttcgggtacgttaccgggataacggttacgttttccggtaccttaccgaaccctagtacccgaagccgtacgtccgtacggcgtacgtcgtacggtaagttagtttacgtacgttagttttaactttacgtacgttacctaacgtacttaaccgttacttaaacgtttacggtaccggttacccgtaccgtacgttacccggtttacggggacgggtaacccgggtacgtaaacgggggttcgtacggtaccgttaaaccgaacgggtacgttcgggtacggtccgtacggacctaaccgtcgttacttaccgttcgtttntacccgtttcccg

SEQ ID NO: 160554 - DNA, 776 bp, Homo sapiens
  misc_feature: GYAE6OF01C5UJ8.9.67.G01.1.454.CMB.1.raw
  modified_base (207)..(207): a, c, t, g, unknown or other
  misc_feature (207)..(207): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctccagataccatggaataatagtgatgacgcagtctccacgcccaccctgtctgttgtttacccaggagaaacncgccactcctcacctgcgacgggccaagtccagacgttcttacggacctaaacctaacgtttacggccgttaacgggaacccaagaccgaaggaaccgtaccgttcgggtcctttacgggacccttaccccggtaacggggtccctacgtacgttaccgtaacgggtcgccgtccgaacggtccggacgggccctaacgtacgggttaccgcccccgggtacgtacggttcgtaaggttcgggttacggggttcgggtaccggtaggggtactaggttaacggtttccgttcctactacgatccgaagcgtacgccttacggccttacgttagtaagttaacgttagtttcgaacgttagttttacttacgttacggactagtaccttaaacgtttaattaacggtttcggtacggtacccgttacttaccgttacggttcggggtaacggggacggtaacggtaagggtacggtaacgacccgtaacgtaaacggtacctggggttaccgcggtaccggtaaccacggttacttacggtttactacccttacctacggtttacccccg

SEQ ID NO: 160555 - DNA, 660 bp, Homo sapiens
  misc_feature: GYAE6OF01DFRCQ.9.67.G01.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (392)..(392): a, c, t, g, unknown or other
  misc_feature (392)..(392): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagcccaccctgtctgtgtttccaggagaaacngccactctcacctgcagggccagtcagntctggcaccattacgcctggtaccagcagacgacctggcttcggcctcccgagggtcctcagtccgtacgggtcgccgtccaggcgacgggccacgtcggtacctcccggcagggttcaggttcggtagtcgggtcgtgggactaggtcgtttcgttcnctaccatcgacgcgacggtcctggacgtacgtcgtagtaacgttgtttacgtacgttacggttttattaccttgtacgtacgtaccttaagttaacgttaagtttacggttacggcccgttaccgttacgttaccggtttaccggggaccgggtaacggggtaccgaaggggttacggaacggtacccgttaacgaaacggtaccgtagggtcggtaccgtaccgaccgtaaccgtcttacgttcgttccgttactcccgttaccccg

SEQ ID NO: 160556 - DNA, 847 bp, Homo sapiens
  misc_feature: GYAE6OF01AOYYO.9.67.G01.1.454.CMB.1.raw
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
tcagtgatacgtctcacgaccggtgctcgatttagagtatacatattgggtttgggggaggaactgctcagttaggacccagacggaaccagtggaagccccagcgcagccttctcttcctcctgctactctggctcccgagactaccatggaaataatagtgatgacgcagttctccagcccacctgtcgtgttcgtttaccaggagaaaccncgccactccncacgtcgcgacggcctacncgacgtagtccgttacggaccaacctaacctttcggccttagggtacctaacggacgacggaccggtaccgtcgggtaccgttaccggccgttccccgtaacgggttcctacgtacgttaccggttcggggtccgaccggtacccgaacggccggtaacgggccctacggtaccggtacccgtacccggtacctacggggtttaccgtaggggtacggttaaccggttggggttacgaaccggggtcctaacggttcgtttacccggtttacgacccgtaacggtctacggtacgacccgtaagtccgtaacgtaccgtccggttaagtacggtaacgtttacgtttacgttaccgtttaagtttcgtttaacgttacgttaccgtacgttaaccgttaaacgttaacgtttaacgttaacgggtttcccggtaccgttaaccccggtttaccgggtaaccgtttcgggaacccgggtaaccgggtacggtaaccggttaacgggaccgttaacggtaaacccgtaaggtccggttacggtaccggttacggcccgtaactaccccgtagttcccttacgttccttcccgttaccgttaccccg

SEQ ID NO: 160557 - DNA, 738 bp, Homo sapiens
  misc_feature: GYAE6OF01A3GGK.9.67.G01.1.454.CMB.1.raw
  modified_base (205)..(205): a, c, t, g, unknown or other
  misc_feature (205)..(205): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccacctgtctgttgtttccgaggagaaacncgccactctcaccgtgcgacgggccagtcaggtacgttcgttcggacctaacctaacgtttacggacccgttaggtaaccccaggaccgaaggacgaccgtcggtcgtttcggccgttacccgtacgggtccctcgtacgttccggtacggtcgccgtccgaggccggacggcctacgtcggtaccgtcccggacgtacgggttcgagggttggtaggtcgggtcgtacgggacgtaggttacgtttccgttctaccgaactacgtcgacgcgacgtccgtgacgtagttacgtaggttaagttcgtttcgtactttagttttacttacgttcgtacctacgtacttaaacgttaagttaaacgttcgggttaccggtcccgttacgttaccggttaccggttacggggacgggtaacgggtaaccgaggggtacggtaaccgtacgtaaaccgtaacggtacgtggtacggtaccgtaccgtacgtaacccgttacttccgttagtttcccgttaacgttcccgttaccccg

SEQ ID NO: 160558 - DNA, 767 bp, Homo sapiens
  misc_feature: GYAE6OF01BHYYS.9.67.G01.1.454.CMB.1.raw
  modified_base (207)..(207): a, c, t, g, unknown or other
  misc_feature (207)..(207): n is a, c, g, or t
  modified_base (313)..(313): a, c, t, g, unknown or other
  misc_feature (313)..(313): n is a, c, g, or t
  modified_base (457)..(457): a, c, t, g, unknown or other
  misc_feature (457)..(457): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggcctcccagataccactaggaataatagtgatgacgcagtctccagccaccctgtctgtcgtttccaggagaaacncgccactctcacctgcagggcctagtcagtagtcgttcggacacctaacttacgccgtaggtacccagcagacgtaccgtggcttggcctacccgcgggttccctntacgtcgtaccgggtcgaccgttccacgtacgaccggggtccaacgttggtaacccgtccccgggacctagggtttcgagggttcggtagggtcggggttcgtacgggaacgtaggttacggtttcgttacctccaaacccgtntaccgacggtaccgtacgtccgtacgtaccggtacgtccgttaaggtaaagtttattttacggtacgtttaagtttactttacgttacggtctaacggtacctaacgtttaacgtaacgttacgggttaccgttaccggtacctttaccggttaccggttttaccggggaaccggggttaacgggtaacccggtaagggtaccggaacggtaccgtaaacccgaaacgtaaccggttacggtcggtccgtaacggtacccgacccgttaacttccgttaccgtttccttaaccgttccgtttaacccccg

SEQ ID NO: 160559 - DNA, 755 bp, Homo sapiens
  misc_feature: GYAE6OF01EU9ZO.9.67.G01.1.454.CMB.1.raw
  modified_base (166)..(166): a, c, t, g, unknown or other
  misc_feature (166)..(166): n is a, c, g, or t
  modified_base (182)..(182): a, c, t, g, unknown or other
  misc_feature (182)..(182): n is a, c, g, or t
  modified_base (188)..(188): a, c, t, g, unknown or other
  misc_feature (188)..(188): n is a, c, g, or t
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (538)..(538): a, c, t, g, unknown or other
  misc_feature (538)..(538): n is a, c, g, or t
  modified_base (583)..(583): a, c, t, g, unknown or other
  misc_feature (583)..(583): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggcctcccagataccactggaataatagtgatgacgnagtctccagccacctntctgtnttcagganaacngcactctcacctgacgacggaccngtacgngtacgtcttggacctacaacttacgccgtacggtaaccacgtacgaggaccgtacgtaggtccgttcggacctcccggtacggtcccttcgaactccgtacggtcgccgtacgacggtcgaccgggcctaacgtcggtccgtaccccgtagtagggtcctaggggtggtacgttgggtcggtacggaactaggttccgtttccgttactacccgcctaagtcctaggccgtacgtccgacgtcgtaacgttacgtacgttaagttacgttttcgaacgtttagtttaacttacttggtacgttaaacnccgtttaaagtttaacgttaaccggtttacggtcccggttacccncggtttaaccgttcccggttaccgggggacccggtaagggttaccgaaccggggtacggtaccgtaacgttaaaccggtaaccgggtagggttaccgtcggtacccgttaagaccccgttacgtacccgtttccgtttacttacccgtttaaaccgtccctttacccccggg

SEQ ID NO: 160560 - DNA, 813 bp, Homo sapiens
  misc_feature: GYAE6OF01CQ5JY.9.67.G01.1.454.CMB.1.raw
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (642)..(642): a, c, t, g, unknown or other
  misc_feature (642)..(642): n is a, c, g, or t
tcagtgatacgtctcacgaccggtgctcgatttagagtatacatagttgggtttggggaggaactgctcagttaggacccagacggaaccatggaagccccagcgcagtcttctcttcctcctgctactctggtcctcccgagtactaccgtacgtaggtaaataataggtgaatcgacgctacgttcctaccgacgccctacccgttgttctgttacgtttaccgaggtaacaaacncncctactcctacacctgacgcggacctgtacgagtacgttctacggacctaacctacgttccgacgttggaaccgacgcaacggacgtcgtacggcgttcggacctccggtacggtctcgctacggttcggccaccggtcaccggtcgaacgggcctaacgttcggtacccgccggtacggttagtggtacgggttcgggttaaaggttccgggtaacggtcgggtaacgtttagggttaacctttccggaacttcccgtaaccgttaagcggaacgtcgtcgtaaccgtcggtacgtacggtttacgaagttaagtttactttacggtaacgtttgtttacccgttaaggtacttcggtaactaacgttttacttaaacgttaacggtttcgggttaacccnccgggtttaccgtttaaaccggtcgggtttaaccgggggtaaccgggtaacgggtacggggtttaggaaaccggtaacgtaccggtaaaacggacggttacgtaggtttcccgccggtaacgtaaacctcggttaacttcggtttaccgtaacttccggttacctccccgg

SEQ ID NO: 160561 - DNA, 601 bp, Homo sapiens
  misc_feature: GYAE6OF01CE6EK.9.67.G01.1.454.CMB.1.raw
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcgttggccaaccaacttagccttggtaccagcgagacgacctggcttaggcctcccgnggtcccnatctacggtncgtcagcgaggcctacgtcggtactcccggcaggttcaggtggtaggtgggtcgtgggactaggtacgttcgttccactaccgattccagtccgagtccgtgaccgtagtctagtaagttatttgaccgtttagtttatactgtcagtcctaataagtagttagtcggtaccgtctacgtcgtttcgggacggtagggaccgtagggtacggataccgtaacgaaacggtacgtagggtcggtccgtacgaccctacgtacttcgttacgtttacctccgttcttacccccg

SEQ ID NO: 160562 - DNA, 694 bp, Homo sapiens
  misc_feature: GYAE6OF01AL92X.9.67.G01.1.454.CMB.1.raw
  modified_base (206)..(206): a, c, t, g, unknown or other
  misc_feature (206)..(206): n is a, c, g, or t
tcagtgatacgtctcacgaccggtgctcgatttagagtatacatattgggtttgggggaggaactgctcagttaggacccagacggaaccagtggaacgccccagcgcagcttctcttcctcctgctactctggcctccagataccactggaataatagtgatgacgcagtctcacgccacctgtctgttcgttccaggagaaacncgccactctccactgcgacgggccagtccaaggtctcgttcggccaaccgtaacttacggccttacggtaccagcgaagtacgccgtaggtcgttcggacctcccggtacggtccctcgtacgttcggtaccggtcgtccgtaccgaggtcgacgggctacgtcggtacgtcccggacgtaggttctaggttcggtaggttacgggcgttacgggactacggtacggtttccgtttacaccctacgtacgtaccgtaggtccgaccgtcctacggtactacggttacgtacggtaagtttacgtttacgtagtttacgtttacttacgttgtactacgtacgtattactaagttcgttcgtccgtacgttacgtacgtttacgggacggtaacgggtacggacgggtaggtacgtaccgtaacggaaacgtaccggtagtacggtcgaccgactaccgtactacgttcttaccgttctcccgttaccg

SEQ ID NO: 160563 - DNA, 682 bp, Homo sapiens
  misc_feature: GYAE6OF01E1ISR.9.67.G01.1.454.CMB.1.raw
  modified_base (163)..(163): a, c, t, g, unknown or other
  misc_feature (163)..(163): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggcctcccagactaccacgtaggaataatagtnatgacgcagtctccacgcccacctgtctgttacgttaccgaggaacgaaacacgaccactcctccaccgtgacgacgggcctagtcaggtacgttcgtacggacctaacctaacttacgccgtacggaccagacgacgacgtaccgtgcgttcggcctaccggacggtcctactacgtcgtacggtcgaccgtccgagcggacggcctacgtcggactcccggacgtaggtacgtggtcggtaggtcgggtacgtacggacgtacgttcggtttctccaccgtaaccgtcgtcaaccgcggtaacgcctcggacctagtgtacgtaagttagttacgtattagtttacttacgtagtactacgtaactaacttaataggttacgtcggtacctacgtaccgtacggtttacggggacgggtaacggtacggtagggtacggacgtaccgtaaacggaacgtacgtagggcggtaccgcggtacctacgtacttacgttaccttcttctccgttaccccg

SEQ ID NO: 160564 - DNA, 718 bp, Homo sapiens
  misc_feature: GYAE6OF01EZLJ0.9.67.G01.1.454.CMB.1.raw
tcagtgatacgtctcacgaccggtgctcgatttagagtatacatattgggtttggggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcacgggccagtcagagtcttggacacctaacttacgccttcggtaccagacagacgtaccgtggtccttcggccgtccccggagggttccctacacgttccgtacgggtcgtccggtccgacgccggacgggacctacgtcgggtacgtccccggacgtagggttcgagggttgggtaggtcgggtcggtacgggaactgggttacggtttccgtacgtaccgacctagtaccgacgcgtacggtcctagcgtacgtcgtaaggtaagtttacgttttggaccttttaaggttttacttacgtacgtacgtagtaccttaagtttaacgtaagttcgggtacgggtacccttccttacgggttaccgggttcggggaaccgggtacgggtaacgggtaacgggtcggaaccgtacgtaaaccggtaaacggtacggtttgggcgggtacttacggaacccttacgtcgttcgttactttccgttccctcgttacccccg

SEQ ID NO: 160565 - DNA, 648 bp, Homo sapiens
  misc_feature: GYAE6OF01EOE0U.9.67.G01.1.454.CMB.1.raw
  modified_base (171)..(171): a, c, t, g, unknown or other
  misc_feature (171)..(171): n is a, c, g, or t
  modified_base (407)..(407): a, c, t, g, unknown or other
  misc_feature (407)..(407): n is a, c, g, or t
  modified_base (436)..(436): a, c, t, g, unknown or other
  misc_feature (436)..(436): n is a, c, g, or t
  modified_base (494)..(494): a, c, t, g, unknown or other
  misc_feature (494)..(494): n is a, c, g, or t
  modified_base (554)..(554): a, c, t, g, unknown or other
  misc_feature (554)..(554): n is a, c, g, or t
  modified_base (573)..(573): a, c, t, g, unknown or other
  misc_feature (573)..(573): n is a, c, g, or t
  modified_base (610)..(610): a, c, t, g, unknown or other
  misc_feature (610)..(610): n is a, c, g, or t
tcagtgatacgtctcacgaccggtgctcgatttagagtatacatattgggtttgggggaggaactgctcagttaggacccagacggaaccatggaacgcccagcgcagcttctcttcctcctgctactctggctccagataccactaggaataatagtgatgacgcagtcncagccacctgtctgtgttccaggagaacacgccactctcactgcgacggcagtacaggtacgtctggacaactaacgtacgcgtacgtaccgaagcagacgacgtggtccttcggaccgttccagggttcctacgtacgtccgttacggtcgaccgtacgagccgtacggggaccacgtacggtactcccgggtcgtaggttcgtagggtcggtacggttcgggtacgtcggacgngttaacggtttcctacgtaccactacgtnacggcacgcgtacgctagtctaagggtaattcgtttacgacgttagttttacttacgntacgtaagactaagttactaagtttacggccggtacctacgtacggttacgttaccgggngggtaacgtaacggtaagngggactacgaaaccgtaaagtccggtagcgtacgtanaccacggttcttccgatttcccgtacttcgttaccccg

SEQ ID NO: 160566 - DNA, 911 bp, Homo sapiens
  misc_feature: GYAE6OF01BQ2TT.9.67.G01.1.454.CMB.1.raw
  modified_base (208)..(208): a, c, t, g, unknown or other
  misc_feature (208)..(208): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggcctccagataccactggaataatagtgatgacgcagtctccacgcccacctgtcttggttcgtttccaggagaaacncgccactctcacctgcgacgggcagtcagtacgttcgtcggacctaaccgtaacgttacgccgttacggtaacccacggacgacgacggtaccgttggtaccggtttcggcccgttacccggtacgggttccctacgtaccgttaccgggttaccgggttccggtaccggtaccgacgggtaccggaccggggtaccctaaccgggtttacggggttacccggtacccccgggtacggttaaccggggtttcgggtaacggggtttacggggttaggggtaccggggttacggtacgggggtaacgttacggggttaccgtttttccggttacccggtaacctacccggtaactccggaaacgtccgacgtaccggttacgaccgttacgttacgtaaggttaacgttacgttttacgaacgttttaacggttttaacgtttacgtacggtttacgacgttacccgtaaagttttaagttaacgttaccgggttaccggtccgttaccgtcggtttaacccgggtttacggggaaccggggtaacgggaccgggttaaagggtccgggtaaaccgttaccccggtaaaacggtaaaccggggtttaaccggtgggttacccggttaaccgtccggtaaacccggttaccttaccgttttcccgggttaccgtttaccctttcccgtttacccgttacccccgg

SEQ ID NO: 160567 - DNA, 806 bp, Homo sapiens
  misc_feature: GYAE6OF01B0D2L.9.67.G01.1.454.CMB.1.raw
  modified_base (200)..(200): a, c, t, g, unknown or other
  misc_feature (200)..(200): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtcgtttccagganaacagccactctccacctgcgacgggccagtcgagtacgttcgttcggaccaacctaacgttacgacccgttcggttaacccacggaccgaaggaacgtacccgtgggtccgtttcgggaccttacccccgaggggtacccttcgaacgtccggttaaccgggtcggtcccggtccaaggtccgacggggaccctacgtacgggttaacccgtccccgggaccgtacgggttactacggggttgggttaacgggttcggggttcggtcggggaacgtacgggttacggtttccggttcctaccggaacctaagttccgacggtaccgtacggtccccgtggaccgtacgttacgtaagggtaacgtttaacgtttttcgaacggttttacgtttttaacgttaacgttcggttaccgaacgtaccgttaaacgtttaagttaacgttaagggtttcccggaccgttaccgttcccgttacgtttaccgggggaccgggtaacgggtaacggacggggttgaacgtaccgtaaccgtaaacggtccgttaggcggtactcggaacctaccgtattccgtttgtaccctttcgtaccgtttcccccgg

SEQ ID NO: 160568 - DNA, 779 bp, Homo sapiens
  misc_feature: GYAE6OF01B2BL5.9.67.G01.1.454.CMB.1.raw
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
  modified_base (356)..(356): a, c, t, g, unknown or other
  misc_feature (356)..(356): n is a, c, g, or t
tcagtgatacgtctcacgaccggtgctcgatttagagtatacatattgggtttggggaggaactgctcagttaggacccagacggaaccatggaagccccagcgcagcttctcttctcctgctactctggctcccgagataccacgtggaataagtagtgatgacgcgagtctccagccacctgtctgtcgttcagganaacngccactcncncctgcaggcagtcagacgttctaggacaaccagttacgccgtacgaccngtacgagacgtacgtggacttcggcctaccggnggtacctanacgttcggtaacgccgtaccgaccgcgaccgacggacctacgtcggttaccnccccggtagacggttacgaggtacggtagggtcggacgtaacgggacctagtaaccgtttcgacctacctaacgatccgagacgtacggtcgtacgaccgttagtaccggtaagtaaacgttagtttcacggttttaaattttacgttacgttagtacgtaaacgttaccggtaaacttaaggttaacgttcggggttccgggtaaccccgttcgttaaccggtttaaccggggtccccggggtaaaggggtaaaccgggtaacccggttaaacgggtaccgggtaaaccgttacccgtaaaacccgggtaaaacgggttccggttacccggtacgggtaaccccttccggaaacccgttaaccggtttaacctttcccgggtttacgtttaacccgttcccgtaaacccttttccccccggg

SEQ ID NO: 160569 - DNA, 877 bp, Homo sapiens
  misc_feature: GYAE6OF01CPF3B.9.67.G01.1.454.CMB.1.raw
  modified_base (239)..(239): a, c, t, g, unknown or other
  misc_feature (239)..(239): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttaccgaggaacgaaacagccactctacacctagcgaggcctagtcagngtcttggcaaccgtaacttacgcctacggtaccagcgagacgactggcttggacctccgtacgggtcctacacgttcctacggttcgcgtccaggcgacggcctaagtccggtaacgtccccggaccgtagggttaccgtagggttacgggaggtttacggggtacgttacggggaacttaacgggacgttttaccggttaccctaccgttaaccgaacgttccgaaacggccgtaacccggtccgttacgggaccgttaagggttcgttaaacgtaaacggtttttacgttttaaggtaaccgtttttaaagttttacgttttaaacccggtaggtttacccgtaaagggttaaccccttaaacgttttaaaagttaaacccgttttacgggggtttttaacccggcccggtttacccgtttaacccgggttttaacccgggggtttaaccggggaccgggggtaaaccgggttaacccggtaaaggggtttaccgggaaacgtttacccgtaaaaaccgggtaaaacccgttaaagggttcccgggttaaggggttaaccccgttagtaaaaccccgtaccgttaacccgttttaccttaacggtttccccgttaagttaacccgtttccccccgg

SEQ ID NO: 160570 - DNA, 766 bp, Homo sapiens
  misc_feature: GYAE6OF01CZ3IS.9.67.G01.1.454.CMB.1.raw
  modified_base (225)..(225): a, c, t, g, unknown or other
  misc_feature (225)..(225): n is a, c, g, or t
tcagtgatacgtctcacgaccggtgctcgatttagagtatacatattgggtttgggggaggaactgctcagttaggacccagacggaaccatggaacgccccagcgcagcttctccttcctcctgctactcgtggcctacccagactaccacgtaggaaataagtagtgatcggaacgcacgtcctccacgcccaccctgtcttgttcgttaccaaggacaaacncgaccacctctccaccgtcggacgacgggacctgcgagtacgttcgttacggacccaaccgtacgttacgacccgttacggtaacccgagccgacggtaaccggtaccggttcggtcgttccgggtacccgtccccggtacgggtcccctacgtagtttcccggtacgggtccgactcccgaacggcggaccggacctacggttcgtacccggccggtaccggttacggttagtacggggttgggttacgggtcggtacggtacgggacgttaacgtcgttttccgtaaccgtcccaacgttagaccgtagcccgtacgtccgtgtaccgtacgttagtacgggttatttagtttacgtacgttttaagttacgttacgtttcaccgtagtactaacgttagtacgttaggttccgtaccgtcgttaccgttccggtacgggtacggacggtacggtaggtcggaacgtaccgtaacgtacggtaccggtaggtcgtcgacgtaccgacgttcttacggttccttcctacgtccgttcccg

SEQ ID NO: 160571 - DNA, 890 bp, Homo sapiens
  misc_feature: GYAE6OF01COXMN.9.67.G01.1.454.CMB.1.raw
tcagtgatacgtctcacgaccggtgctcgatttagagtatacatatttgggtttgggggaggaactgctcagttaggacccagacggaaccatggaacgccccatcgcagcttctcttcctcctgctactctggctccagataccacgtaggaataatagtgacgtcgacgctacgtctccgacgccacctgtctagttcgttaccgaggtacgaaactcgtccgacttctccgaccgtgacgaggtcagtcgagtacgttcgttcggacctaaccgtacgttaccggccgtacggtacccgacgtaccgacggtacggtacccgttcggtccgttccggaccccgtacccgggtacgggttaccccttaccgtaaccgtttccggtaaccgggttccacccggttacccggaccggtaccggtaaccggggtacccttacgggttaccgggtaacccgtcccccggggtaaccgttaacgggtttaccggtaacggggttacgggtttaacggttcggggtttaccgggtaccgggtaacgtacggggttcgtttccggttaccgtaaccgtacccgtaacgtaccgaacggtcccgaaccggtccgtacgaccgttacgtacgtagtaacgtttacgtttacgtacgtttagtttacgtttacgttacgtacgtacgttaccgtaaagttacgttaacgtttacggtaccggttaccgtaccgtttacggtcccgggtttaacgggacgggtttaacccgggacgggttaacgggtacggttaaccggaaccgtaacggtaaaacccggtcgttaacgggtacggtacttaccggtactaacccggtctttacggttccgtttacccgtttccgtaacccgttacccg

SEQ ID NO: 160572 - DNA, 754 bp, Homo sapiens
  misc_feature: GYAE6OF01BPVJT.9.67.G01.1.454.CMB.1.raw
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggcctcccagactaccactggaataatagtgatgacgcacgtctccacgccaccctgtctgtnttccagganaacacgccactcgtcactgacacgggcagacagacgtcgttggaccgaacctaacgttacgccgtacggtaccgacgacgacgaacgtaccgtacggtacgttacggtaccgtaccggtaccggtacctacgtacgttaccggtaccggtacgtaccgtaccggacggtacggacggtaccgtacgtacggtaccgtccggtaccgtacggttacgagggttacgggtaggtacgggtacgtacgggaacgtacggtacgttacgtacgtacgtaacgtacgtacgacgtacgtacgtccgtacgtacgtacgtacgtacgtaagttacgttacgtaacgttacgtttacgtacgtacgtacgtacgtacgtaacgttaagtacggtacgtacggtaccttaccgtacggtacggttacgggaccggtaacggtaaccggtaagggtacggtaacgtaccggtaaaccgtaaaccggtacgtacggtccggtacgtaccgtacccgtacctacggttaccgttaccggtttccttaccgtaccgttaccccg

SEQ ID NO: 160573 - DNA, 731 bp, Homo sapiens
  misc_feature: GYAE6OF01DPXAN.9.67.G01.1.454.CMB.1.raw
  modified_base (178)..(178): a, c, t, g, unknown or other
  misc_feature (178)..(178): n is a, c, g, or t
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (231)..(231): a, c, t, g, unknown or other
  misc_feature (231)..(231): n is a, c, g, or t
  modified_base (694)..(694): a, c, t, g, unknown or other
  misc_feature (694)..(694): n is a, c, g, or t
  modified_base (713)..(713): a, c, t, g, unknown or other
  misc_feature (713)..(713): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagactaccactggaataatagtgatgacgcagtcctccacncccacctgtctgttcgttccagganaacncgccactctcacctgcgacggccngtacgagagttcttcggacacctaacgttcgcgtacggtaccagcgaacgacgtaccgtggtcttcggcctccggacggttccacagttaccgtacggtcgaccgtccgaggccgacggtacccgacgttcggtaccgtcccgggtacgtacggtttacgagggtttcgggtacgggttcgggtacggtacggggtaaccgtaggtttaccgtttccggttactacccgtaaccgtaataccggtacgaccgtaaccggtcccgtagtaccgttaacggttccggttaaggttaacggtttagtttacggtacgttttacggtttaactttgttacccgtacgtaacggtaaccttaacttaagttaacgtttacggtacggtacccgtgttaaccgttcggtacgggggcggtaaccggacggtagggtcgaacgtacgaacgtaacccgtgtcggtaccgntaccgtacacgtcgttacnctttcacgtcctacccgg

SEQ ID NO: 160574 - DNA, 662 bp, Homo sapiens
  misc_feature: GYAE6OF01BJ53D.9.67.G01.1.454.CMB.1.raw
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
  modified_base (304)..(304): a, c, t, g, unknown or other
  misc_feature (304)..(304): n is a, c, g, or t
  modified_base (319)..(319): a, c, t, g, unknown or other
  misc_feature (319)..(319): n is a, c, g, or t
  modified_base (386)..(386): a, c, t, g, unknown or other
  misc_feature (386)..(386): n is a, c, g, or t
  modified_base (454)..(454): a, c, t, g, unknown or other
  misc_feature (454)..(454): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggcctcccagataccacgtggaataatagtgatgacgcagtctccagcccaccctgtctgtcgtttacgaggagaaacngccactcncactgcgagggcctagtcagacgtctggcactaacgtgccgtggtacagcgaagacgaccgtggcttcggacctccgaggttccctntacgtcgtcgggtcnccgtcgagcgacgggcctagtcggtaccgtcccggcgtacgttcgaggttcggtggtcgggttccgngggactaggtagtttccgtacacgaccagttcgacgtctacgcctagaccgtgtacgtagtaacgttntttacggactttaacggtttattaccgtttcggaacctaggtaacccttaagtttattaaacgggttcgttccggtaccgttcctaccgggttaccggttacgggtaccgggaacgggtaccgtaaagggtggacgttacgaaccgttaaggtaccgtggtacggtctacggcttacgtacgttcgtactttcgtccgtaccttcccg

SEQ ID NO: 160575 - DNA, 764 bp, Homo sapiens
  misc_feature: GYAE6OF01DEVO6.9.67.G01.1.454.CMB.1.raw
  modified_base (174)..(174): a, c, t, g, unknown or other
  misc_feature (174)..(174): n is a, c, g, or t
  modified_base (225)..(225): a, c, t, g, unknown or other
  misc_feature (225)..(225): n is a, c, g, or t
  modified_base (707)..(707): a, c, t, g, unknown or other
  misc_feature (707)..(707): n is a, c, g, or t
  modified_base (726)..(726): a, c, t, g, unknown or other
  misc_feature (726)..(726): n is a, c, g, or t
tcagtgatacgtctcacgaccggtgctcgatttagagtatacatattgggttgggggaggaactgctcagttaggacccagacggaaccatggaacgccccagcgcagcttctcttcctcctgctactctggctccacgataccactaggaataatagtagatagacgcagtcnccacgccacctgtctgttgtttaccaggacgaaacacgcctactctcaccngacgacggccacgtcgagtacgttcgttacggaccaaccgtaacttaccgtaccgtacgggtaccaacggtaccgaacggtaaccggtaaccggttggtaccggtttacgggtaccccgttacccggtaccggggtcccttaacgtacgtttaaccggttacgggtcggtaccgtaccgacggaccggtaccgggtaccgtaacgttacgggtaccgtacccgggtaccgtaacgggtttacgtaacgggtttcgggtacggggttcggggtacgggtacgggaacgtaacggtttacggtttacgttccgtaccaacgtacgtaaccggacggacctaacgggtccctaagtcctaacggtacgtaagtttaaacgtttcgtttaacggtacgtttaagttttactacggttagtcaagtaccttaagtacttaagtacggtcgcgtactcgtcgggtacggacgggacgtactaaggcgntaacgaacgaacggtatgngtctaccacgtactcgtactcgttaactctacgtcccg

SEQ ID NO: 160576 - DNA, 825 bp, Homo sapiens
  misc_feature: GYAE6OF01C89DX.9.67.G01.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagcccacctgtctgttcgttccagganaaacncgcctactcctccacctgcgagggccagttcgagagtcttggaccacctacttacgccgtacgtaccagcgagacgccgtaggcgttcggtccgtacccgtacgggtcctactacgtccgttacggtcgccgtccgacgccggacgggaccgtacgtacgggtaccgtccccgggaccgtacgggttacgtaggggttcgggttagggttcggggttacggttagggggtaaccgtaagggttaaccggttttccgggtttaccctaccgtaaacccgtacgtttaccgacgggtaccgtaccggtcccgttaccggtaccgttaccggttacggtaaggttaaacggttttacgtttttaggtaccttttaaggtttttactttaacggttacgttaccgtacgtaaccgttaacttaacgtttaaaggtttacggtttcggacccggtttccttaccggttaccgggtttccggggaccggggtaaggggtacccgtaagggggttaccgggaactaccggttaaaccgaacggtaaccggttgggaccggtcgtacccgtaccgttaacccgtcgttacgtttacggttttacctcccggttttcccgttaccccccg

SEQ ID NO: 160577 - DNA, 788 bp, Homo sapiens
  misc_feature: GYAE6OF01COFO9.9.67.G01.1.454.CMB.1.raw
  modified_base (118)..(118): a, c, t, g, unknown or other
  misc_feature (118)..(118): n is a, c, g, or t
  modified_base (164)..(164): a, c, t, g, unknown or other
  misc_feature (164)..(164): n is a, c, g, or t
  modified_base (583)..(583): a, c, t, g, unknown or other
  misc_feature (583)..(583): n is a, c, g, or t
  modified_base (628)..(628): a, c, t, g, unknown or other
  misc_feature (628)..(628): n is a, c, g, or t
tcagtgatacgtctcacgaccggtgctcgatttagagtatacatagttggggttgggggaggaactgctcagttaggacccagacggaaccatggaacgcccagcgcagctctctccnctgctactctggctccagactaccgataggaataatgtgatgacgnagtcctcacgccctccgtgtctagttcgttaccgaaggacgaaaccggcctactctcgactgccgaggtccagtcgagtagttcgtagacctaacaacgttcggacttggaccaagccgaagtacgtaaccgttcggtcggttacggaacccttccggaaggttcccttaacgacgtttaccggttaacgggtcgaccggttaccctaaggaccgacgggacccttacggtcgggttaaccgtccccgggtagtaacggtttcgaagggttcggttaacgggttcgggttaacgaccggggtatacggggttaacgtttccgttacccgacgtaacctacggttccaaacgggtctaccgtacccgtgaaacccgttgtacggtaagttacgtacgtttacgtaacttaggtttaactntaccggtcaattaactagttaagttaagttacggacgtttacccncgtttaacggttacgtacccggggacgggtaacggtaaccgtaagggggttaccgaagttacccggtaaaacgaaacggtaccgggttaggaccgtacgggaccctttaaacacgggtacctttacgtcggttaaacccctttgggaaccctttccccgg

SEQ ID NO: 160578 - DNA, 818 bp, Homo sapiens
  misc_feature: GYAE6OF01CUY8Y.9.67.G01.1.454.CMB.1.raw
  modified_base (582)..(582): a, c, t, g, unknown or other
  misc_feature (582)..(582): n is a, c, g, or t
  modified_base (635)..(635): a, c, t, g, unknown or other
  misc_feature (635)..(635): n is a, c, g, or t
tcagtgatacgtctcacgaccggtgctcgatttagagtatacatattggggtttggggggaggaactgctcagttaggacccagacggaaccatggaagccccagcgcagcttctcttcctcctgctactcgtggcctcccagtataccacgtaggaataatagtgatggacgcagtctccagcccacctgtcgtcgttcgtttccgaggaacgaaaccacggcctactcctaccgccgtcggacgacgggcctaggtaccgaaggtacgttccgttacgggacctaacccgtaacgtttaccggaccgtttacgggaacccaggacgaacggttaaccggaccgttcggggtaccgtttcgggccccgttacccggtacggggttaccccttagtaaccggtttccggttaaccggggtcgaccggtaccgacgggcggacgggaccctacggttcgggtaaccgtcccggaacgttcgggtacaggggttggtacggttggggtaccgtagggacttaacgggttccgttcgttaccgcgtaacctacggtacgacgtcgacggttcccgactacgggtntacgggttaggtaagttttattaccggttattttaagtttactacgtcgtacncgttaacctagtttaagttaacggttccggttaccgacggttaccctttacgggtaccgggtttccggggaacgggtaacgggtaccggttaagggccggttacgaacccgttaaaggaacggttacgtggttacgggctaacgtcccaaagttcttcttagttcctccgtccgtttaacccg

SEQ ID NO: 160579 - DNA, 857 bp, Homo sapiens
  misc_feature: GYAE6OF01DVGOJ.9.67.G01.1.454.CMB.1.raw
tcagtgatacgtctcacgaccggtgctcgatttagagtatacatattgggtttgggggaggaactgctcagttaggacccagacggaaccatggaacgccccagcgcagcttctcttcctcctgctactctgcctcccagactaccactaggaataatagtgatgacgctagtcctccgacgccctacccgttcgttcgttcggttcgttttacccgaagggaacgaaaacgacgaccctacctccttacccaaccgtcggaccggacgggaccctaggtacgtaggttaccgttccggttacgggacccctaaaccgttacttaaccggcccggtttaccgtaacccgacggaccgaaacggtaccggtaacccggtcggttaccgttccggtcccgttccccggttaccgggttccctaacgttaccgttaccggttacgggtccgtaccggtaccgacggaccgtaccgggccgttacgtccggtaccgtaccccggtacggttacggttcgaggggttcggtaggggttacgggttcgggaggtaacggtacggttacggtttcccgttcgtaacccaccgtaacgtacgacacggtacctccggtacgacgttcgtacgttagtaagttttcgtttacgtaacgttttagtttacgttgttaccgtagtattaaccgtactttaagtaacgggtttcgtccggtaccgttacgttcccggttaacggttcgggggaaccggttaacggggccggttaaagggtccggtaactacggaaaccctaacggtaccgtgggtaaccgtctacggaacctcgttacttacgttccctacttaccgtcccttaccccg

SEQ ID NO: 160580 - DNA, 673 bp, Homo sapiens
  misc_feature: GYAE6OF01BLHOA.9.67.G01.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcaggccagtcagagtctggcacctaacgttacgcctcggtaccagcagacgtaccgtggtcttcggcctcccgtagggtccctcgtactcgtacggtcgccgtccgaggcgacgggcctacgtcgggtactcccggactacgggttcaggttggtgggtggggtcgtaggggactaacggtgtttccgtcctacgaacccagtccgagaccgacgtcccgtaggccgtagttacgtacgggtaaattagttttacggtacttaagtttacttacgttcgtacacgtacgtaaacttaagttaacgttcgttcggacccgttacgttccgttacggttaccggggacgggtaaccgggacggtaacggggttcggaacgtaccgtaacggaaaccgtcggttggtacggtctaccgtaccaccgttagtcgtcggttaccttcgtaccgttccccg

SEQ ID NO: 160581 - DNA, 733 bp, Homo sapiens
  misc_feature: GYAE6OF01A1WD0.9.67.G01.1.454.CMB.1.raw
  modified_base (252)..(252): a, c, t, g, unknown or other
  misc_feature (252)..(252): n is a, c, g, or t
  modified_base (648)..(648): a, c, t, g, unknown or other
  misc_feature (648)..(648): n is a, c, g, or t
tcagtgatacgtctcacgaccggtgctcgatttagagtatacatattggggtttgggggaggaactgctcagttaggacccagacggaaccatggaagccccagcgcagcttctcttcctcctgctactctggctcccagataccactggaaataatagtgatgacgcagtctaccagccctaccctgtcctggttcgtttccgaagggaacaaaaccgcgcccaacttccgcacctgcgaggccagtcagngtctagcacaacttacgctaggtacagacgagacgtacctggtccttaggcctacccggacggttcctacgtacgtaccggtacgggttcgaccgtaccggacgaccggacgggtaccctaaggtaccggtaccgtacccccggacgtttaagggtacacggggttaggttacggtcgggtaccgtagggtactaagggttcgttaccggttacaccgacctaggtaccacgggaccgtaacgtccgtaagaccgtaggtacgtaaggttaagttaacgtttacgaacgtttaacgtttacttaacgtcgtaataccggtacttaacgttaattacgttaggtacccgtcgaccgttacgtccgggttaccgggaccgggaacggtacgtacgggnggtaaccgtaactaaccgggaaagtacgtagggtaggtcctacggctaaccgtcgtttacgaccgttactccgttaacgtccccg

SEQ ID NO: 160582 - DNA, 935 bp, Homo sapiens
  misc_feature: GYAE6OF01B004H.9.67.G01.1.454.CMB.1.raw
tcagtgatacgtctcacgaccggtgctcgatttagagtatacatatttggggtttgggggaggaactgctcagttaggacccagacggaaccatggaacgccccagcgcagcttctcttcctcctgctactctggcctcccagataccactggaataatagtgatgacgcagtcctccacgcccacccttgtccttgttcgtttccgaaggaacgaaaacacgccctactcctaccacctcgcgacgggcctacgtacgaggtacgttcgttcggaccaacctaacgttacggtccgttacggtaaccacggaccgaacggtaccggtacccgtcgggtccgttcgggtcccgttccccggtacgggttacccctcgtaccgtttaccggttaccgggttccggtacccggtcccgacggccggaaccgggacccctacgggttaccgggttaccccggtcccccgggtaccgtttaacgggttacgtaggggtttacgggttaaggggtccggggtttacggtacgggggtaacgtaacgggttacggttttccgtaccgttacccaacccgttagtacccgtaagtaccggtaccgtcccgtagtacggtacgtttcgtaacggttagttacggttttacgtaacgttttaacttttacgtttacgttacgtacgtaacgttaccttaaacgttaagtttaccgggttaacggtttccggtacccgttaccgtttaccgggttacccgggtttaccgggggaacggggttaacccggggtaacgggtaacggggtcgggtaaacggtaacccggttaaaccggtaaaaccggtcgggtttaccggacggggtcccttaacccgggtacccgttaaccgttaccggtttaccgtttacccgtttaccttttccggtaaccccgttttcccccgg

SEQ ID NO: 160583 - DNA, 718 bp, Homo sapiens
  misc_feature: GYAE6OF01BJRO4.9.67.G01.1.454.CMB.1.raw
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (547)..(547): a, c, t, g, unknown or other
  misc_feature (547)..(547): n is a, c, g, or t
tcagtgatacgtctcacgaccggtgctcgatttagagtatacatagttgggtttggggaggaactgctcagttaggacccagacggaaccatggaacgccccagcgcagcttctcttcctcctgctactctggctccgagataccacgtagaataagtagtgactgacgcagtctccgagcccacctgtctgttcgttacaaggacgaacncgccactcncacgtgcgacggctagtacgagagtcgttagacctaaccgtaacgttcgaccttacggacagacgaagacggtccgtggtcgtccgcgtacccggtaggtcctacgacgttccggtacggtcgaccggtacgacggtaccgacgggacctaaccggttcggtaacccgtccccgggtacgtacggttccggtaggttaacgggttggtcggggttaccgaggtaccgtaggttcgtttccgtcctacgaacctagtaccgacgtacgacgtcgtacgtcgtaacgttcgtaagttaagttacgtttgaccgtttagtttaacgtctntacgtactactacgtagttaacgtcggtctaccgttactacgggttacggtaccgggaagggtaccggtacggtaggtacggtaaccgaacgttaaacgacggttaccggtgggtcgaccgtacgaccgttaactaccggttcttaaccgttcgtacccttacgttcccgg

SEQ ID NO: 160584 - DNA, 655 bp, Homo sapiens
  misc_feature: GYAE6OF01D3ACX.9.67.G01.1.454.CMB.1.raw
  modified_base (128)..(128): a, c, t, g, unknown or other
  misc_feature (128)..(128): n is a, c, g, or t
  modified_base (183)..(183): a, c, t, g, unknown or other
  misc_feature (183)..(183): n is a, c, g, or t
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctacnctggcctccagataccataggaataatagtgatgacgcagtctcagccacctgtntgtgttccagganaacgnccactctcactgacgaggccagtcagtagtctggaccacgtactagctgtaccagcagacgacgtgcgtgcctacgacggtcctcgtagtcgtacggtcgacgtaccgacggccgtacgggacctacgtacgtaccggtcccgaaccgtaggttaccggagggttggtaggttcgggtacgacgggtaacgtacggtacgttcgttacctaccgaacacgtacgaacgtacgtacggtctacggactaagtcgtaggtaaagtttgtttagtagtttaacgtttacttaacggttgtactagtacggtaaattaagtaacgttagtacccgagttcctaccgttacgttacgggaccgggaagggtaccaagggtggtacacgtaaacaaaggttaccgtaggtacgtccgtcgacgttacctcttacgtggtttacccttacgacgttccccg

SEQ ID NO: 160585 - DNA, 744 bp, Homo sapiens
  misc_feature: GYAE6OF01BFAYL.9.67.G01.1.454.CMB.1.raw
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (264)..(264): a, c, t, g, unknown or other
  misc_feature (264)..(264): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccacctgtctgtgtttccagganaacagccactctnacctgcagggccagtcagtagtcttggccaccaactttagcctaggtaccagngagagacctggactttggctcccagggtcctcatcgtaacggtgccgtccaggcaagggccaacgtcggtactcccggctaagggttccaagggtggtaaggtcggggtacctggggactacgtacggtttacgttcctacaacccgattccgaaggctaacgtacccgtaggtccgtaagttaccgttagtaaaagttacgttttaggaacctttaaagggttttaactttaacgtcggttacgaaggtacccttaacgttaaagttaaacgttaaggtttccgggtaccccgtacgttaccgttaaccggtttaccggggtacggggtaaaccgggggtaacccgtaaagggggtaacgggttaaaccggtaccggttaaaacccaaaaacggggttaacctgggttacgggaccttacgggtaaaccgaacccgtaaactttcgttacggtttacccctttagtacctttaccccgg

SEQ ID NO: 160586 - DNA, 778 bp, Homo sapiens
  misc_feature: GYAE6OF01B3TKL.9.67.G01.1.454.CMB.1.raw
  modified_base (210)..(210): a, c, t, g, unknown or other
  misc_feature (210)..(210): n is a, c, g, or t
  modified_base (214)..(214): a, c, t, g, unknown or other
  misc_feature (214)..(214): n is a, c, g, or t
  modified_base (216)..(216): a, c, t, g, unknown or other
  misc_feature (216)..(216): n is a, c, g, or t
  modified_base (752)..(752): a, c, t, g, unknown or other
  misc_feature (752)..(752): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggcctcccagactacccacgtaggaattaagtagtgagtgacgcagtctccagcccaccttgtctgttcgttaccgagganaacncnccactctccacgtgcgacgggcagtcgagtacgttcttcggacctaaccgtaacttcggccgttacggaacccagacgtaacgaccgaccgttggtccttacggtcccttacccggtacggttcccctcgtaaccgttccggttacggtccgtccgtccgaggtccgaccgggtccctacggttcggtccgtcccggcgttaggttccgtaggttcggtaggttcggtacgtacgggtaatcggtttagttccttacgtcccaacgttatcccgagtccaccgtccgtggaccgttacgtactaaggttattttacgtttacggacttttaacggtttacttacccgggtagttaccacggttaaccctttaaagggtttaaacttaacggttcgggttacccggtactttaccccgttacgggttttaacccgggttcggggaaccgggtacgggtaaccggtacggtacggtacgtacccgttaaacggaaccggtttgtacgggtcgtactccgtaacctccgtttaacgttnttaaccgttcgtccgttcgtcccccg

SEQ ID NO: 160587 - DNA, 844 bp, Homo sapiens
  misc_feature: GYAE6OF01BWOCE.9.67.G01.1.454.CMB.1.raw
  modified_base (143)..(143): a, c, t, g, unknown or other
  misc_feature (143)..(143): n is a, c, g, or t
  modified_base (552)..(552): a, c, t, g, unknown or other
  misc_feature (552)..(552): n is a, c, g, or t
tcagtgatacgtctcacgaccggtgctcgatttagagtatacatattggggtttgggggaggaactgctcagttaggacccagacggaaccatggaacgccccagcgcagcttctcttcctcctgctactcgtggcctccganactaccacgtaggaataagtagtgactcgacgacgacgtccaccacgtcccaccctggtcctggttacgtttaccgaaggaacgaaacgacgacctaactcctacaccgtcgacgacgggccaggtacgagtcgtacggttcgaaccaaccgttaactacggacgtaacggtaccgacgtacggtacggtaacgtaccggttcggtacgttccggaccgtacccggacgggttacctaccggtacgtttaccggacggttccgaccgtacggaccgtacggtacgcccgtaacggtacgttacccgggcccgtaaccgagggttaccgaggggtaggttacggtaccgggttaaggacgggtaaacgtttacggttaaccgtttccgtaaccgtaacccgtacgtaaanccggaaccgtagaccgtcggtacgtacgtagtaccgtaaagttagttattacggttacttaattcgtacgtatctagtaacaattaacgtagtacgacccgggttactacgttacggttacccgtaggggtaccgggtaacggtaaccgggtaaggtacgtaacgttaaacccgggtaaaccttaaacggggttactacccgggaggttacccccggtaaaggtccccttaaaccggtttaacgttccccgtttcgtttaaaccccttggtaaccccccgttttaaccccgg

SEQ ID NO: 160588 - DNA, 721 bp, Homo sapiens
  misc_feature: GYAE6OF01DRL6K.9.67.G01.1.454.CMB.1.raw
  modified_base (229)..(229): a, c, t, g, unknown or other
  misc_feature (229)..(229): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctccagataccactggaataatagtgatgacgcagtctccagccacctgtctagtcgtttccaggagaacagccactctcacgtgcaggccagtcagntctggacacctatacgctaggtaccagtcgagacgtacctggtatttacggccttacccgaagggttccctcgtaatccggtagggtccacggtaccaggaccggacggggtaccaagttcgggtaacgccccggtaaccgtagggtttccaaggttcggtaaggttcgggacgtgggtaactacggtacgtttaccgtttccgctaaaccacgttagaacgggaccttacggacccgttagaccgtacggttaccgtaaggtaacggttacttttacggaccgtttaaggttttaacgttacgtttacgggtaactacggtacctaacttaagttaaagttaacgggttccggaccgtaccgtttaacggaacgttttccgggagggttaaccgggtaccgtagggtaccggtagtaccgtaacgaaacggtaacgtcggtcgtcgtacggcctaccgtaacgttcgttacttccgttataccgttccccg

SEQ ID NO: 160589 - DNA, 502 bp, Homo sapiens
  misc_feature: GYAE6OF02GAMZE.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggcaggttcagtggtagtgggtctgggacaggagttcgttctcaccatcagcagcctgcagtctgaagtattttgctagtttattacttgtcagcactataatagttggccgtctctactttcggcggaggaccaaggtgagctcaacgactgtggctgcacatctgtcttcatcc

SEQ ID NO: 160590 - DNA, 525 bp, Homo sapiens
  misc_feature: GYAE6OF02ITWQ2.9.67.G01.1.454.CMB.1.raw
  modified_base (441)..(441): a, c, t, g, unknown or other
  misc_feature (441)..(441): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtccctcgatctacggtgcgtccagcagggccacgtggtactcccggcaggttcaggtggtagtgggtctgggacaggagttcgttctcaccatcagcagctgcagtctgaagtattttgctagtttattactgtcagcactataagtgttggccnctctacgtttcggcggagggacaagggtggagctacgaaacgacgtagtcggctgacaccgtatccgtggttcttcgattcccg

SEQ ID NO: 160591 - DNA, 527 bp, Homo sapiens
  misc_feature: GYAE6OF02IE75H.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggcaggttcagtggtagtgggtctggggacagagttcgttctcaccatcagcagcctgcagtctgagattttgctagttttattacttgtcagcacttataatgttggccgtctcacttttcgggcggtaagggacccgaaagggttcggagctacgaaacggaacgttggtggctggcaccattcctgtcttcattcccg

SEQ ID NO: 160592 - DNA, 503 bp, Homo sapiens
  misc_feature: GYAE6OF02H3WSK.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccacttagcctggtaccagcagagacctggcttggctcccagggtcctcatctacggtgcgtccagcagggccatggtatcccggccaggttcagtggtagtgggtctgggacagagttcgttctcacatcagcagcctgcagtctgaagtatttgctagtttattactgtcagcactataatagttggccgtctcactttcggcgtagggaccaaggtgagctacaacgtaactgtggctgcacactctgtcttcattccg

SEQ ID NO: 160593 - DNA, 505 bp, Homo sapiens
  misc_feature: GYAE6OF02HT5Q2.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtcagcagggccactggtatcccggcaggttcagtggtagtgggtctgggacagagttcgtctcaccatcagcagcctgcagtctgaagtattttgctagtttattacttgtcagcactataatagttggccgtctctacgttcggcggagggaccaagggtggagctacgaacgactgtggctgcacatctgtcttcatccg

SEQ ID NO: 160594 - DNA, 517 bp, Homo sapiens
  misc_feature: GYAE6OF02GUBVJ.9.67.G01.1.454.CMB.1.raw
  modified_base (393)..(393): a, c, t, g, unknown or other
  misc_feature (393)..(393): n is a, c, g, or t
  modified_base (511)..(511): a, c, t, g, unknown or other
  misc_feature (511)..(511): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggcaggttcagtggtagtgggtctgggacagagttcgttctcacatcagcagcctgcagtctgaagtnttttgctagtttattacttgtcagcactataagtagttggaccgtctctacgtttcgggcggagggaccgaagggtggagcgtcaaacggactgtggctgcaccgatcctgtcttcgnttcccg

SEQ ID NO: 160595 - DNA, 507 bp, Homo sapiens
  misc_feature: GYAE6OF02F5HYY.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtactcccggccaggttcagtggtagtgggtctgggacagagttcgttctcaccatcagcagcctgcagtctgaagattttgctagtttattactgtcagcactataatagttggccgctcactttcggcggaggaccaaggtggagctacgaacgaactgtggctgcaccatctgtcttcattcccg

SEQ ID NO: 160596 - DNA, 526 bp, Homo sapiens
  misc_feature: GYAE6OF02IQJKB.9.67.G01.1.454.CMB.1.raw
  modified_base (356)..(356): a, c, t, g, unknown or other
  misc_feature (356)..(356): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggcaggttcagtggtagtgggtctgggacngagttcgtctcacatcagcagcctgcagtctgaagtattttgctagtttattactgtcagtcactataatagttggccgtctcgtacgtttcggacggtagggaccgaagggtgagctacgaacgaacgtaggtcggctcgaccaccacgtctgtctttactcttacccg

SEQ ID NO: 160597 - DNA, 525 bp, Homo sapiens
  misc_feature: GYAE6OF02JAZKN.9.67.G01.1.454.CMB.1.raw
  modified_base (519)..(519): a, c, t, g, unknown or other
  misc_feature (519)..(519): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccacgtggtactcccggcaggttcaggtggtagtgggtctgggacagtagttcgtctcacatcagcagcctgcagtctagagtattttgctagtttattacgttgtctagctacttataattagttcggccgtctactacgtttcggcggacgggacctagggtgagtctacgaacgtaacgtgtggtctgcacatctgtcttctnttcccg

SEQ ID NO: 160598 - DNA, 541 bp, Homo sapiens
  misc_feature: GYAE6OF02GSMQO.9.67.G01.1.454.CMB.1.raw
  modified_base (300)..(300): a, c, t, g, unknown or other
  misc_feature (300)..(300): n is a, c, g, or t
  modified_base (357)..(357): a, c, t, g, unknown or other
  misc_feature (357)..(357): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctccagggtcctcatctacggtncgtccagcagggccactcggtatcccggcaggttcaggtggtagtgggtctgggacnggagttcgttctcgaccatccagcagcctgcagtctagagtatttgctagtttattactgtactagcatataattacgttggaccgtcttcgacgtttcgggaccgtaagggacctaagggtcggagtacgtacgaaacggtactggttacggctacgcactacgttcgtgtcttccattcccg

SEQ ID NO: 160599 - DNA, 515 bp, Homo sapiens
  misc_feature: GYAE6OF02F9VMT.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtactcccggccaggttcagtggtagtgggtctgggacagagttcgttctcaccatcagcagcctgcagtctgaagtattttgctagtttattacttgtcagcactataatagttgccgctctacgtttcggcggtagggaccaagggtgacgctacgaaacgactggtggctgcaccgatctgtcttcattcccg

SEQ ID NO: 160600 - DNA, 574 bp, Homo sapiens
  misc_feature: GYAE6OF02IBFXB.9.67.G01.1.454.CMB.1.raw
tcagtgatacgtctcacgaccggtgctcgatttagagtatacatattggggtttgggggaggaactgctcagttaggacccgagacggaaccatggaagccccagtcgcacgcttctcttcctcctgctactctggctcccagtataccactggaataatagtcgatgacgcaggtctccgagccaccctgtctgtgtttccaggagaaacagccactctcacctgccagggccagtcagagtcttggcaccaacttagcctggtacccagccacgacgaccttaggcttggctccgagggtaccctacgactctacggtggtccgtccgagccgtagggccacgtcggtactcccggcaggttcagtcgtagtgggtctgggacagtagtcgttctcacagtcagcagctgcagtctgaagtatttgctagtttatactgtcagcactataatagttggccgtcgtcgacgtttcggacggtacgggaccgaagggttggacgtcgtaccgaacgtaacgtcggtacggtcctacgacctaccgtacttccgttacgtcctttccattccccg

SEQ ID NO: 160601 - DNA, 509 bp, Homo sapiens
  misc_feature: GYAE6OF02HBPMI.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggcaggttcagtggtagtgggtctgggacagtagttcgttctcaccatcagcagcctgcagtctgaagtatttgctagtttattacttgtcagctactataatagttggccgctcacgtttcggcggtacgggaccaaggtgagctacgaacgactgtggctgcaccatctgtcttcatcccg

SEQ ID NO: 160602 - DNA, 511 bp, Homo sapiens
  misc_feature: GYAE6OF02JE059.9.67.G01.1.454.CMB.1.raw
tcagtgatacgtctcacgaccggtgctcgatttagagtatacatattgggtttgtgggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtactcccggccaggttcagtggtagtgggtctggggacagagttcgtctcaccatcagcagcctgcagtctgaagtatttgctagttttatactgtcagtcactataagtagttggccgtctcgtacgtttcggcggaggaccgaggttggagcgtacgaaacgtatggtgctgcacatctcgttctctac

SEQ ID NO: 160603 - DNA, 531 bp, Homo sapiens
  misc_feature: GYAE6OF02JD0YI.9.67.G01.1.454.CMB.1.raw
  modified_base (206)..(206): a, c, t, g, unknown or other
  misc_feature (206)..(206): n is a, c, g, or t
  modified_base (366)..(366): a, c, t, g, unknown or other
  misc_feature (366)..(366): n is a, c, g, or t
  modified_base (377)..(377): a, c, t, g, unknown or other
  misc_feature (377)..(377): n is a, c, g, or t
  modified_base (407)..(407): a, c, t, g, unknown or other
  misc_feature (407)..(407): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (449)..(449): a, c, t, g, unknown or other
  misc_feature (449)..(449): n is a, c, g, or t
  modified_base (477)..(477): a, c, t, g, unknown or other
  misc_feature (477)..(477): n is a, c, g, or t
tcagtgatacgtctcacgaccggtgctcgatttagagtatacatattgggtttgggggtaggaacgtggcgtcagttaggaccagacggaaccatggaagcccagcgcagcttctcttcctcctgctactctggctcccagataccactggaataatagtgatgacgcagtctccagccaccctgtctgtgtttccaggagaaacngccactctcaccgtgcagggccagtcagagtcttggcaccaacttagcctggtaccagcagagacctggcttggcctcccgaggttcctcatcgtacggtcgcgtccagcgacgggccacgtcggtatcccggcaggttcacggtgtagtggtctggacngagttcgttcncgactatcagcacgctagcagtctgaagtnttgctgttatcttgtnagtnactatattagtcgtacgcttcncgtttcggcgtacggacgtaagtgggancgtacgaagtaaccgtagtggtactgacgctacgtactggttctgtacttcccg

SEQ ID NO: 160604 - DNA, 547 bp, Homo sapiens
  misc_feature: GYAE6OF02IQ8Q1.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagccaccctgtctgtgtttccaggagaaacagccactctcacctgcagggccagtcagagtcttggcaccaacttagcctggtaccagcagagacctggcttggctccaggtcctcatctacggtgcgtccagcaggccactggtatccggcaggttcagtggtagtgggtctgggacagagttcgttctcaccatcagcagcctgcagtctgaagtgtttgctagtttattacgttgtctagctacttataattagttggccgtctcgtacgtttcgggacggtagggaccgtaagggtggaggtcctacgaaacggtaacgttggtacggtcgtacgacgacctacgttcctacggtactttccgattccccg

SEQ ID NO: 160605 - DNA, 508 bp, Homo sapiens
  misc_feature: GYAE6OF02J180B.9.67.G01.1.454.CMB.1.raw
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtactcccggccaggttcagtggtagtgggtctgggacaggagttcgttctcaccatcagcagcctgcagtctgaagtatttgctagtttatactgtcagcactatatagttgccgtctctacgttcggtcggaggtaccaaggtgagctacgaacggtactgtgcgtagcacgtatctgtctctattcc

SEQ ID NO: 160606 - DNA, 578 bp, Homo sapiens
  misc_feature: GYAE6OF02JWY8R.9.67.G01.1.454.CMB.1.raw
  modified_base (388)..(388): a, c, t, g, unknown or other
  misc_feature (388)..(388): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtctggcaccaattgcctggtaccagcagagacctggcttggctcccgagggtccctcatccgtacggtcgccgtccagccacgggccacgtggtaactccccgggctagggttcacggtggtagtgggtctgggactaggtagttcgtctcgacntccagctagccgtgctagtcgtgtaagtcttttgactagtttatctgtcagtcactatatagtgaccgtctgtacgtttcgggacggtacggaccgtaagggtcgaagtccgtaagtaaaccgtaacggttcgtacgggaccttgtacccggtaactacgttccgttcgtcctttaccgaccgtttcccg

SEQ ID NO: 160607 - DNA, 546 bp, Homo sapiens
  misc_feature: GYAE6OF02H1NWH.9.67.G01.1.454.CMB.1.raw
  modified_base (203)..(203): a, c, t, g, unknown or other
  misc_feature (203)..(203): n is a, c, g, or t
  modified_base (411)..(411): a, c, t, g, unknown or other
  misc_feature (411)..(411): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccagcagagacctggcttggctcccgagggtcctcactctacggtcgcgtccagccacgggccacgtcgggtatccccgggccagggttcaggtggtagtggggtctggggactagagtttcgttctcaccatcagcagctgcagtctagaagtntttgctagttttattacttgtcagtcactaataattagttcgcgtctcacgtttcgggacggtacgggaccaagggtggacgacgtacgaaacgaacttaggtcggcgtgccactactcctgtcttctattcccg

SEQ ID NO: 160608 - DNA, 527 bp, Homo sapiens
  misc_feature: GYAE6OF02HEO38.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtactcccggcctaggttcagtggtagtggggtctgggacagtagttcgtctcaccatcagcagcctgcagtctgaagtatttgctagtttattacttgtcagctactataattagttggccgtctctacgtttcggcggtacgggaccgaagggtggagtctacgaacggaacgtgtacggctagcacctatctgtcttcattcccg

SEQ ID NO: 160609 - DNA, 596 bp, Homo sapiens
  misc_feature: GYAE6OF02JW9E1.9.67.G01.1.454.CMB.1.raw
  modified_base (204)..(204): a, c, t, g, unknown or other
  misc_feature (204)..(204): n is a, c, g, or t
  modified_base (409)..(409): a, c, t, g, unknown or other
  misc_feature (409)..(409): n is a, c, g, or t
tcagtgatacgtctcacgaccggtgctcgatttagagtatacatattgggtttgggggaggaacgtgctcagttaggacccagacggaaccatggaagccccagcgcagcttctcttcctcctgctactctggctccagataccactggaataatagtgatgacgcagtctccagccaccctgtctgtgtttccaggagaaacngccactctcacctgcagggccagtcagagtcttggcacgaacttagcctggtaccagcagagacctggcttggctccgagggtcctcactcgtacggtcgccgtccagcagggccacgtggtactcccggcctaggtcagtggtagtgggtcgtgggacagtagttcgttctcgaccatcgagcacgtctgcagtctagaacgtntttcgctagtttatacgtgtacgagtcctaattagtaagttagttcggtaccgtcgttaccttaacggtttccgggaccgggtaacgggtacccgtaaagggttcggaaggtcctaacggtaaaccggaacgttggtcggagttacggcctaaccgtgtccgttaggtcctttacgacttaccccgg

SEQ ID NO: 160610 - DNA, 605 bp, Homo sapiens
  misc_feature: GYAE6OF02IHJ7P.9.67.G01.1.454.CMB.1.raw
  modified_base (391)..(391): a, c, t, g, unknown or other
  misc_feature (391)..(391): n is a, c, g, or t
tcagtgatacgtctcacgaccggtgctcgatttagagtatacatattggggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcacaacttagcctggtaccagcagagacctggcttggcctcccagggtccctcatctacggtgcgtccagcagggccacgtggtactccccggccaggttccagtggtagtgggtctgggacaggagttcgtctcacatcagcagcctgcngtctagaatatttgcgttagtttattacttgttacagtctaactataagttaggttacggcctcgtccgtaccgtttcggggaccgggtaacggggtaacccgaaggggttaggacgtaccgtaaccgtaaacggtaaccgttggtcgggtacttacggcccgtaacccgtagtttacccgttcggtttacctttacccgtacgtttacccccg

SEQ ID NO: 160611 - DNA, 607 bp, Homo sapiens
  misc_feature: GYAE6OF02GGJEE.9.67.G01.1.454.CMB.1.raw
  modified_base (206)..(206): a, c, t, g, unknown or other
  misc_feature (206)..(206): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagcccaccctgtctgttgtttccaggagaaacngccactctcacctgcgagggccagtcagagtcttggacaccaacttagcctggtaccagcagagacctggcttggcctccgagggtccctcatccgtacggtgccgtccagcgacgggccacgtggtacgtcccggcgtacggtcgaggtggtaggtgggtcgtgggacaggtagttcgttctacacactcacgcagtccctgctagtctagaagttatttcgacgttagtttattacgtgtactagtacctacttaattaagttgttcggccgtctaccttacgtttcgggacggtaacgggaaccgtaagggtcgggacgtaccgaacgtaaaccggtacggtaggttcgggacttcggaccgtacctagttccgtgtttacctttcgacctttccccg

SEQ ID NO: 160612 - DNA, 519 bp, Homo sapiens
  misc_feature: GYAE6OF02FLYMM.9.67.G01.1.454.CMB.1.raw
  modified_base (502)..(502): a, c, t, g, unknown or other
  misc_feature (502)..(502): n is a, c, g, or t
  modified_base (512)..(512): a, c, t, g, unknown or other
  misc_feature (512)..(512): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctggggacaggagttcgttctcaccatcagcagcctgcagtctgaagtattttgctagtttattacttgtcagcactataatagttggccgtctctactttcgggcgggagggaccgaagggtcgagctacgaacgtactggtggctgacacntctgtcttcncttcccg

SEQ ID NO: 160613 - DNA, 589 bp, Homo sapiens
  misc_feature: GYAE6OF02I7HD3.9.67.G01.1.454.CMB.1.raw
  modified_base (360)..(360): a, c, t, g, unknown or other
  misc_feature (360)..(360): n is a, c, g, or t
  modified_base (409)..(409): a, c, t, g, unknown or other
  misc_feature (409)..(409): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagacgacctggcttggctcccgagggtcctcatccgtacggtgcgtccgagcgacgggccactcggtactcccggcaggttcaggtggtaggtgggtntgggacaggtagttcgtctcacatcagcagcctgcagtcgtagaagttntttgacttagtttattactgtcagtacacttaagtaattggttcgaccgtactcgtacgtttcgggacgggtaacggaccggtagggtacgggtacgtaccgttaacgaaaccggtacgttaggtacgggtcctacggacctaacgtacttccgttcggttccttaccgttacttccccg

SEQ ID NO: 160614 - DNA, 538 bp, Homo sapiens
  misc_feature: GYAE6OF02HIJIR.9.67.G01.1.454.CMB.1.raw
  modified_base (398)..(398): a, c, t, g, unknown or other
  misc_feature (398)..(398): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtactcccggcaggttcaggtggtagtgggtctgggacaggagttcgttctcaccatcagcagcctgcagtctgaagtnttttgctagtttattactgtcagcactataatagttggccgtctctacgtttcggacgggacgggacctaaagggtggagtcgtacgaaaccgtaacgtggtaggctagccaccgtacgtcttggtcttacgacttcccg

SEQ ID NO: 160615 - DNA, 524 bp, Homo sapiens
  misc_feature: GYAE6OF02F8WCE.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccacgtggtactcccggccaggttcaggtggtagcggggtctgggacagtagttcgttctcaccatcagcagcctgcagtctgaagtatttgctagtttattactgtcagactactataatagttgccgtctctacgttcggcggagggaccgaaggtgagctacgaaacgtactggtacgcgtcgcacgtatcctgtccttcacttcccg

SEQ ID NO: 160616 - DNA, 525 bp, Homo sapiens
  misc_feature: GYAE6OF02I1D9K.9.67.G01.1.454.CMB.1.raw
  modified_base (518)..(518): a, c, t, g, unknown or other
  misc_feature (518)..(518): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgccgtccagcagggccacgtggtactcccggcaggttcagtggtagtgggtctgggacagacgttcgttctcacatcagcagcctgcagtctagaagtatttgctagtttattacgtgtcagctactataattgtgcctctctcgttcggcggacgggacgaagggtgagtacgtacaaacggtaactggtacggctcgaccactagtcctgtcttcncttcccg

SEQ ID NO: 160617 - DNA, 256 bp, Homo sapiens
  misc_feature: GYAE6OF02ID6FD.9.67.G01.1.454.CMB.1.raw
  modified_base (253)..(256): a, c, t, g, unknown or other
  misc_feature (253)..(256): n is a, c, g, or t
tcagtgatacgtctcacgaccggtgctcgatttagagtatacatagtgggtctgggacagagttcgttctcaccatcagcagcctgcagtctgaagattttgcagttttattactgtcagcactataatagttggccgctcactttcggcggagggaccaaggtggagctcaaacgaactgtggctgcaccatctgtcttcatcttcccgcatctgaagacgtatcactgagcgggctggcaaggcgcatagnnnn

SEQ ID NO: 160618 - DNA, 517 bp, Homo sapiens
  misc_feature: GYAE6OF02H1SZH.9.67.G01.1.454.CMB.1.raw
  modified_base (508)..(508): a, c, t, g, unknown or other
  misc_feature (508)..(508): n is a, c, g, or t
  modified_base (513)..(513): a, c, t, g, unknown or other
  misc_feature (513)..(513): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctccagggtcctcatctacggtgcgtccagcacgggccacgtggtactcccggccaggttcaggtggtagtgggtctgggacagagttcgttctcaccatcagcagcctgcagtctgaagtattttgacttagttttattacttgtcagcagcgtgccaagtcgacttctctacgtttcgggcggacggacaagggtgacgtacgagacgaactgtcggctgcacatcgtntcttntacg

SEQ ID NO: 160619 - DNA, 552 bp, Homo sapiens
  misc_feature: GYAE6OF02H65MR.9.67.G01.1.454.CMB.1.raw
  modified_base (288)..(288): a, c, t, g, unknown or other
  misc_feature (288)..(288): n is a, c, g, or t
  modified_base (304)..(304): a, c, t, g, unknown or other
  misc_feature (304)..(304): n is a, c, g, or t
  modified_base (321)..(321): a, c, t, g, unknown or other
  misc_feature (321)..(321): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcacacttagcctggtaccagcagagacctggcttggctcccagggtcctnatctacggtgcgtccngcagggccagtggtacncccggccaggttcaggttggtaggtgggtctggggacaggtgttcgttcncacntcagcagcctgcagtcngaagtnttgctagtttattactgtcatctactataatgttcgccgtctcgtacgtttcgggacgggtacgggaccgaagggtgggagtaccgtacaaaccggtacgtcggtacgggtccgtgacctacgtagttccgttgttccgttcctactttccccg

SEQ ID NO: 160620 - DNA, 680 bp, Homo sapiens
  misc_feature: GYAE6OF02H3RVL.9.67.G01.1.454.CMB.1.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (388)..(388): a, c, t, g, unknown or other
  misc_feature (388)..(388): n is a, c, g, or t
  modified_base (422)..(422): a, c, t, g, unknown or other
  misc_feature (422)..(422): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggccacaacttgcctggtaccagcagagacctggcttggcctcccgagggtccctnactcgtacggtcgcgtccagcgacgggccacgtggtactcccggccgtaggttcaggtcggtaggtggggtctggggactaggtacgttcgttcncacgatcgagtcagtcctgctagtctagaagttntttagacttagttttacttacgttcgttacagtacctaacgttaataaacgtttaggttacgggtcccgttacgtttaccgttaaccgttttacccgggggaccgggtaaacggggtaacccgtaaagggggtttacggacggttacccgttaacgtaaaccgggtaaccggttggtaccgggtacgttaccggacccgttaacccgtaacggtttccgtttaccggtttaccgtttacccgtaccgttttaccccgg

SEQ ID NO: 160621 - DNA, 509 bp, Homo sapiens
  misc_feature: GYAE6OF02I94PT.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctgggacagagttcgtctcaccatcagcagcctgcagtctgaagtattttgctagtttattactgtcagcactatatagttggccgtctctacgtttcggcggtagggaccgaaggtgagctacgaacgtactgtggctgcacatctgtcttcattcccg

SEQ ID NO: 160622 - DNA, 556 bp, Homo sapiens
  misc_feature: GYAE6OF02JLHAX.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatcgtacggtgcgtccagcagggccacgtcggtactcccggcaggttcagtggtagtcgggtctgggacagtagttcgtctcacctatcgagcagcctgctagtctgaagtatttgactagtttactactgtacagtctacttataattgttacggcctctactacgtttcggacgggtacggtaccgtaagggtagacgtactacgaacgtacgtaggtacggtctacgacgtaccgtagttcctagtcttacgtacttcccg

SEQ ID NO: 160623 - DNA, 570 bp, Homo sapiens
  misc_feature: GYAE6OF02HEET8.9.67.G01.1.454.CMB.1.raw
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctccagggtcctcatctacggtgcgtccagcagggccacgtggtactcccggcaggttcaggtggtagtggggtctgggacaggtagttcgttctcacctatcagcagcctgcagtctgaagtattttgctaagtttattactgtnacgtnacttataatagttcggaccgtctacgtacgtttcgggacgggtacggggaccctaaaggggtcggacgaccgtacgaaaccggtaacttggtaggccgtacgtccaaccgtacgttccgttagtacctttacagtttccccg

SEQ ID NO: 160624 - DNA, 523 bp, Homo sapiens
  misc_feature: GYAE6OF02H2V7W.9.67.G01.1.454.CMB.1.raw
  modified_base (394)..(394): a, c, t, g, unknown or other
  misc_feature (394)..(394): n is a, c, g, or t
  modified_base (420)..(420): a, c, t, g, unknown or other
  misc_feature (420)..(420): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcacaacttagcctggtaccagcagagacctggcttggctcccagggtcctcatctacggtgcgtccagcagggccactggatcccggcaggttcagtcggtagtgggtctgggacagagtttcgtctcgacatcagcagcctgcagtctgaagtnttttgctagttttattacgtgttcanctactataatagttgcgtctctacgtttcggcggtagggaccgaggttggacgtcgtacgaacggaactggtggcgtgcacctatccgtgtcttcacttcccg

SEQ ID NO: 160625 - DNA, 576 bp, Homo sapiens
  misc_feature: GYAE6OF02IPSCB.9.67.G01.1.454.CMB.1.raw
  modified_base (204)..(204): a, c, t, g, unknown or other
  misc_feature (204)..(204): n is a, c, g, or t
  modified_base (299)..(299): a, c, t, g, unknown or other
  misc_feature (299)..(299): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagatacccactggaataatagtgatgacgcagtctccagccaccctgtctgtgtttccaggagaaacngccactctcacctgcagggccagtcagagtcttggcacacttagcctggtaccagcagagacctggcttggcctccgaggtcctcatctacggtncgtccagcaggccacgtggtactccccggctaggttcaggtcggtagtggggtctaggggacaggtacgtttcgttcacctaaccgattcacgcgacgcctgcagtcctagtaagtagttttcgcgtagttttattacgttcgtctacgcctaacttataagttagtttcggaccgtctcgtacgtttcgggacggtacgggaccgaagggtgaacgtctacgaaacggtacttggtcggctcgacctacctagtccttcgtcttccagttaccccg

SEQ ID NO: 160626 - DNA, 381 bp, Homo sapiens
  misc_feature: GYAE6OF02GSM20.9.67.G01.1.454.CMB.1.raw
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (376)..(381): a, c, t, g, unknown or other
  misc_feature (376)..(381): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggaactgtggctgcacatctgtcttcatcttcccgcatctgaanacgtancactgagcgggctggcaaggcgacatagnnnnnn

SEQ ID NO: 160627 - DNA, 530 bp, Homo sapiens
  misc_feature: GYAE6OF02HGOQA.9.67.G01.1.454.CMB.1.raw
  modified_base (374)..(374): a, c, t, g, unknown or other
  misc_feature (374)..(374): n is a, c, g, or t
  modified_base (397)..(397): a, c, t, g, unknown or other
  misc_feature (397)..(397): n is a, c, g, or t
  modified_base (524)..(524): a, c, t, g, unknown or other
  misc_feature (524)..(524): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctccagggtcctcatctacggtgcgtccagcgagggccacgtggtactcccggcaggttcagtggtagtgggtctgggacagagttcgttctcaccntcagcagcctgcagtctgaagtntttgctagtttattactgtcagcactataattagttcggccgtctcgtacgtttcgggcggtaacgggaccgtaagggtgagctacgaacggtaacgtggtggctcgaccactacgtctcgtcttcnttcccg

SEQ ID NO: 160628 - DNA, 614 bp, Homo sapiens
  misc_feature: GYAE6OF02I64AH.9.67.G01.1.454.CMB.1.raw
  modified_base (203)..(203): a, c, t, g, unknown or other
  misc_feature (203)..(203): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccagcagagacctggcttggcctcccgaggtcctcatccgtacggtgcgtccagcgacgggcccacgtggtaccgtccccggccgtaggttccaggttcggtaggtgggtcgtaggggacagtacgttcgttctacgactatcagccagcctgctagtctaggtaagtagttttgtcttagttttattacgttgtactacgtactaactattaagttgttcggccgtcctaccgttccgtttacgggcgggtacgggaaccggtaagggtacggacgtcgtaaccgaaaccggtaacgttagggtcggtacgttacgaccgacctacgttccgttggttacctttccgtacttccccg

SEQ ID NO: 160629 - DNA, 714 bp, Homo sapiens
  misc_feature: GYAE6OF02GNRMM.9.67.G01.1.454.CMB.1.raw
  modified_base (239)..(239): a, c, t, g, unknown or other
  misc_feature (239)..(239): n is a, c, g, or t
  modified_base (360)..(360): a, c, t, g, unknown or other
  misc_feature (360)..(360): n is a, c, g, or t
  modified_base (449)..(449): a, c, t, g, unknown or other
  misc_feature (449)..(449): n is a, c, g, or t
  modified_base (464)..(464): a, c, t, g, unknown or other
  misc_feature (464)..(464): n is a, c, g, or t
tcagtgatacgtctcacgaccggtgctcgattttagagtatacatatttggggttttggggggaggaacgtgcctcagttaaggacccgagtaccggaaccgtattcggaagtccccgagcgcagcttctcttacctcctgcgtactctggctcccgagtagtaccactggaacttaagttagtcgtagttgacgttacgagtcctcctagccaccgtgtcgtgtgtttcaggagaacngccacgtctcacctaggccgaggggccaggtcacgacgttcttggcaccaacttacgccttgggtaccagcagagaccctggccttaggcctaccgagggtcctcgactccgtacgggtcnccggtaccgagggcgtaggggccaggtcggttacgtcccggactaaggttaaccaggttggtacgtggtcttaggacaggagttcgtcncgacctgtcgagacncgctagtccacgtctagaagtattttcgacttagtttacttaacgtcgttactagtcctaacgttactaagttacggttacggccgtacgttaacccgtacgtttaacgggacggtaacggaacccggtaaggttacggtacgtaccgttacgtaaaccggttacggtttcggttacggttaccgttacggtaccctaaccggttactttaccggtccgtttacccgtttacggtaccgtttacccccgg

SEQ ID NO: 160630 - DNA, 650 bp, Homo sapiens
  misc_feature: GYAE6OF02G5FHG.9.67.G01.1.454.CMB.1.raw
  modified_base (203)..(203): a, c, t, g, unknown or other
  misc_feature (203)..(203): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacngccactctcacctgcacgggccagtcagtagtcttggcaccaacttcgcctggtaccagcagacgacctggcttggcctccgaggtcctcatcgtacggtgccgtccagcgagggccagtggtactcccgggctaggttcaggtggtagtcggggtctgggacaggtacgtttcgtctcacctagtcagcagcctgctcggtctaggaagttagtttgacttaagttttacttacgttcgtactagtactaacttaagttaaacttacggttacggcccgtacgttaccgttaaccggttttaccggggacgggtaaacgggtaaccgtaaggggtacgggtaccgtacgttaaccggaaaccggttaacgtcgggttacgggtaccgtacggaccgtaacccgtacgttaccgttacggtttccttacgtaccgttttacccccgg

SEQ ID NO: 160631 - DNA, 594 bp, Homo sapiens
  misc_feature: GYAE6OF02HVCD6.9.67.G01.1.454.CMB.1.raw
  modified_base (293)..(293): a, c, t, g, unknown or other
  misc_feature (293)..(293): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccacctgtctgtgtttccaggagaaacagccactctcacctgcagggccagtcagagtcttggcaccaacttagcctggtaccagcagagacctggcttggcctcccgagggtccctnatctacggtgcgtccagcagggcccacgtggtactcccggcaggttcaggtggtagtgggtctagggacagtagttcgtctcacatcagcacgctgcagtctaggaagtatttgactagtttattacgttgtacagctactataattaggttcggaccgtcgtacgtacgtttcgggacggtacgggaaccgtaaggggtcggaacggtaccgtaacggtaaaccggtaacggttcggtacgggtcctaggtaccgaacccgtacgttccgttacggttcctttacctaacgtttcccccg

SEQ ID NO: 160632 - DNA, 540 bp, Homo sapiens
  misc_feature: GYAE6OF02HL1CL.9.67.G01.1.454.CMB.1.raw
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccaggtcctcatcacggtgcgtccagcagggccacgtggtactcccgggcagggttcaggtggtagtggggtctggggacaggtagtttcgttctcaccctatcagcagcctgcagtctagagtatttgctagtttattacttgtcagtcatataattagttcggtccgtcgtctacgtttcggcgggtaagggaccgaagggtggagtactacgaaacggtaacgtaggtggctcgcactacgtcttgtctctacttccg

SEQ ID NO: 160633 - DNA, 534 bp, Homo sapiens
  misc_feature: GYAE6OF02HPV47.9.67.G01.1.454.CMB.1.raw
  modified_base (360)..(360): a, c, t, g, unknown or other
  misc_feature (360)..(360): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtacccagcagagacctggcttggctcccagggtcctcatctacggtgcgtccagcagggccactggtactcccggccaggttccaggtggtagtgggtctgggacngtagttcgtctcacatcagcagcctgcagtctagtaatatttgctagtttattacgtgtcagtctaatataattgtcggccgtctctacgtttcggacggacgggacgaagggtcgagtcgtacgaaacgtactaggtcggactgaccacgactcttacgtctctacttacccg

SEQ ID NO: 160634 - DNA, 574 bp, Homo sapiens
  misc_feature: GYAE6OF02JXLTV.9.67.G01.1.454.CMB.1.raw
  modified_base (376)..(376): a, c, t, g, unknown or other
  misc_feature (376)..(376): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatcgtacggtcgcgtccgagccgacgggccacgtcggtactccccggcgacggttcgaaggtggtaagtggggtctggggaacnggtacgtttcgttctcaccgtagtcgagcgacgtcctagcaagtctagaaagttgttttgactagttttatacgttgtcagtcaagtataagttagtgccgctctacggttcggacgaggacctaaggtgacgtcgtaacgaacgtacgtggtcggacttacggactaccgtagtacgtgttaccttcgactttcccg

SEQ ID NO: 160635 - DNA, 878 bp, Homo sapiens
  misc_feature: GYAE6OF02JYL10.9.67.G01.1.454.CMB.1.raw
  modified_base (138)..(138): a, c, t, g, unknown or other
  misc_feature (138)..(138): n is a, c, g, or t
  modified_base (212)..(212): a, c, t, g, unknown or other
  misc_feature (212)..(212): n is a, c, g, or t
  modified_base (540)..(540): a, c, t, g, unknown or other
  misc_feature (540)..(540): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctccagntaccactgaataatagtgatgacgcagtctccagccaccctgtctggttcgtttccaggagaaacagccactcncacctgcagggccaggtcaaggtctctttggacaccaatttcgccgtggtaccagcgacgacggtacctcggacttcggacccttccgtacgggtccctaccgtagtaccgtacggtacggtccgtccgaaggccgtagggcccacggtacgtaccgtaccccgggacctaacggggttcctagggttaggtacgggttacgggttcgttacggggaacgacggttacggttcccggtttacgtacgtaacccgtacgttaccggtacgaaccgtaccggtaacccgtcggtacgtttaaccggttccgtaacgggtaaaccggtttntttttaaccggacgtttaaccggtttttaaattccggtttaaggtacccgttaacgggtaccctttaaagttaaacgtttaaacgttaacgggttcggttacccgggtttaaccttccggtttaaccgggtttttacccgggaaacgggggtaaaccccgggttaaaccgggtaaacgggggtttaccggggtaaacggtttccccggttaaaacgttaaaaaccggggttccgggtttaaacggttttcggggtaaacccgttttcggggacctttaaacccggttaagttccccgtttttacgggttaaccttttcccgggtaacttttcccccgg

SEQ ID NO: 160636 - DNA, 680 bp, Homo sapiens
  misc_feature: GYAE6OF02I8D74.9.67.G01.1.454.CMB.1.raw
  modified_base (305)..(305): a, c, t, g, unknown or other
  misc_feature (305)..(305): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccacctgtctgtgttccaggagaaacagccactctcacctgcagggccagtcagagtcttggccaccaacttagcctggtaccagcagagacctggcttggccttcccgagggtcctcactcgtacggtnccgtccagccgagggccctacgtggtaccgtccccggccgtaaggttcgaaggtcggttaaggtcggggttactaggggacgtaggtacggttttcccgttcaccgtaacccagtccaaggtcctacgcccgtggtccagtccgtaggtaacgttgttttagcttaagttttactttacgtgttaccacgtacctaacttaattaacttaggttccgtaccgtaccgttccgttaaccgttttccgggaccggggtaacggtaaccggaagggttcggtaacgtccgtaaaccgtaaaccggtaacgttacggtacgggtccgtcggacctaaccgttacgttaccgttacgttaccctttacgtaccttccccg

SEQ ID NO: 160637 - DNA, 507 bp, Homo sapiens
  misc_feature: GYAE6OF02JCQ8F.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggcaggttcaggtggtagtgggtctgggacagagttcgttctcaccatcagcagcctgcagtctgaagtattttgctagtttattacttgtcagcactataatagttggccgtctcacgtttcggcgagggaccgaaggtgagctacaacgactgtggctgcactatctgtcttctattcc

SEQ ID NO: 160638 - DNA, 559 bp, Homo sapiens
  misc_feature: GYAE6OF02HHQZX.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggccaccaacttagcctggtaccagcagagacctggcttggctccgagggtcctcatctacggtcgcgtccagcagggccactggtactcccggcaggttcagtggtagtgggtctgggacaggagtttcgtctcaccatcagcagcctgcagtctagaatatttgctagtttattactgtacagcactataatagttcgaccgtctctacgtttcgggacggtacgggacctaagggtacggagaccgtacgaaaccggtaactaggtcggacgttaggacctaaccgtagttccttaggttcctttacgtactttccccg

SEQ ID NO: 160639 - DNA, 504 bp, Homo sapiens
  misc_feature: GYAE6OF02I3RRU.9.67.G01.1.454.CMB.1.raw
  modified_base (204)..(204): a, c, t, g, unknown or other
  misc_feature (204)..(204): n is a, c, g, or t
  modified_base (362)..(362): a, c, t, g, unknown or other
  misc_feature (362)..(362): n is a, c, g, or t
  modified_base (404)..(404): a, c, t, g, unknown or other
  misc_feature (404)..(404): n is a, c, g, or t
  modified_base (444)..(444): a, c, t, g, unknown or other
  misc_feature (444)..(444): n is a, c, g, or t
  modified_base (474)..(474): a, c, t, g, unknown or other
  misc_feature (474)..(474): n is a, c, g, or t
  modified_base (482)..(482): a, c, t, g, unknown or other
  misc_feature (482)..(482): n is a, c, g, or t
  modified_base (490)..(490): a, c, t, g, unknown or other
  misc_feature (490)..(490): n is a, c, g, or t
  modified_base (499)..(499): a, c, t, g, unknown or other
  misc_feature (499)..(499): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccagcagagacctggcttggctcccgagggtcctcatctacggtgcgtccagcagggccactggtactcccggccaggttcaggtggtagtgggtctccgggganaggtagttcgttctcaccatcagcagcctgcagtctgaagtntttgctagtttatacttgtcagcactataatagtggcctntctcgttcggcgacggacgaggtgagctanaacgctgngctgcacntctgtcttnatccg

SEQ ID NO: 160640 - DNA, 523 bp, Homo sapiens
  misc_feature: GYAE6OF02HVZQT.9.67.G01.1.454.CMB.1.raw
  modified_base (366)..(366): a, c, t, g, unknown or other
  misc_feature (366)..(366): n is a, c, g, or t
  modified_base (506)..(506): a, c, t, g, unknown or other
  misc_feature (506)..(506): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccacgtggtactcccgggcaggttcaggttggtaggtgggtctggggacaggngttcgttctcaccatcagcagcctgcagtctgaagtattttgctagtttattactgtcagtcactataattagttggccgtctctacgtttcggcggtacgggacgagggtgagtctacgaaacgactggtggctgcacnctctgtcttcattcccg

SEQ ID NO: 160641 - DNA, 529 bp, Homo sapiens
  misc_feature: GYAE6OF02IOE34.9.67.G01.1.454.CMB.1.raw
  modified_base (405)..(405): a, c, t, g, unknown or other
  misc_feature (405)..(405): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (434)..(434): a, c, t, g, unknown or other
  misc_feature (434)..(434): n is a, c, g, or t
  modified_base (436)..(437): a, c, t, g, unknown or other
  misc_feature (436)..(437): n is a, c, g, or t
tcagtgatacgtctcacgaccggtgctcgatttagagtatacatatttgggtttggggaggaactgctcagttaggacccagacggaaccatggaagccccagcgcagcttctcttcctcctgctactctggctccagataccactggaataatagtgatgacgcagtctccagccaccctgtctgtcgtttccaggagaaacagccactctcacctgcagggccagtcagagtcttggcaaccaacttagccgtggtaccagcaggagacctggcttgggcctcccgagggtcctcatcgtacggtcgcgtccacgccgacgggccacgtcggtactcccggcaggttcaggttggtaggtgggtctgggactagtacgtttcgttctcacatcagcagctgcngtctgaagtntttgntagttattctgtanannatatatgtgcgtctctcgttcggcggacggacgaaggtcgacgctacgaacgtacgtcgcggcgtcgacacctactcgtcgtcttcactccg

SEQ ID NO: 160642 - DNA, 543 bp, Homo sapiens
  misc_feature: GYAE6OF02JCS6V.9.67.G01.1.454.CMB.1.raw
  modified_base (205)..(205): a, c, t, g, unknown or other
  misc_feature (205)..(205): n is a, c, g, or t
  modified_base (372)..(372): a, c, t, g, unknown or other
  misc_feature (372)..(372): n is a, c, g, or t
  modified_base (393)..(393): a, c, t, g, unknown or other
  misc_feature (393)..(393): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaaacngccactctcacctgcagggccagtcagagtcttggcaccaacttagcctggtaccagcagagacctggcttggctcccagggtcctcatctacggtgcgtccagcagggccacgtggtactcccggctaggttcaggtggtagtgggtctgggacagtagttcgttncgaccatcagtcacgcctgcngtctgaagtcgtttgctagtttattacttgtcagtctactatatagttgcctctctacgtttcggcggtacgggacaagggtggacgcgtacgaacggtaactggtacggtctagaccgtaccgattccgtcgttccttacctattcccg

SEQ ID NO: 160643 - DNA, 538 bp, Homo sapiens
  misc_feature: GYAE6OF02IJ44Z.9.67.G01.1.454.CMB.1.raw
  modified_base (417)..(417): a, c, t, g, unknown or other
  misc_feature (417)..(417): n is a, c, g, or t
  modified_base (519)..(519): a, c, t, g, unknown or other
  misc_feature (519)..(519): n is a, c, g, or t
tcagtgatacgtctcacgaccggtgctcgatttagagtatacatattggggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtccctcatcctacggtgccgtccagcagggccacgtggtactcccggccaggttccaggttcggtaggtggggttctggggaccaggtacgttcggttctcacccatccagcagcctgcagtctagaagtntttgctagtttattacttgtacagctactataatgttggccgtctctacgttcggcgggtaggaccgaagggtgagctacgaagtagttggtaggtctcganccatcgtgtcttcatcccg

SEQ ID NO: 160644 - DNA, 593 bp, Homo sapiens
  misc_feature: GYAE6OF02IE3ML.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagactggcttggctcccagggtcctcatctacgggtgcgtccagcgagggccacgtggtactcccggcaggttcaggtggtagtgggtctgggacagtagttcgtctcacatcagcagcctgcagtctagtagtatttgactagtttattactgtcagactaactaataagttaggttggtacccgcttacgtaccgttttcgggaccgggtaacggggaacgtaaggggtacggaggtaccgtaaccgtaaacggtaacgttacggtacggaccgtacggaccgacccgtaacgttccgttacggtttcctttaccgatttacccccg

SEQ ID NO: 160645 - DNA, 562 bp, Homo sapiens
  misc_feature: GYAE6OF02IZFI9.9.67.G01.1.454.CMB.1.raw
  modified_base (204)..(204): a, c, t, g, unknown or other
  misc_feature (204)..(204): n is a, c, g, or t
  modified_base (343)..(343): a, c, t, g, unknown or other
  misc_feature (343)..(343): n is a, c, g, or t
  modified_base (369)..(369): a, c, t, g, unknown or other
  misc_feature (369)..(369): n is a, c, g, or t
  modified_base (419)..(419): a, c, t, g, unknown or other
  misc_feature (419)..(419): n is a, c, g, or t
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
  modified_base (534)..(534): a, c, t, g, unknown or other
  misc_feature (534)..(534): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccagcaggagacctggcttggctcccagggtcctcgatcgtacggtgccgtccagcacgggccactggtactccccgcgacggttnacggtggtacgtgggtctggggtacnggtacgtttcgtcgtactaccatcacgacacgcctgccagtcgtagagtnttttggcttagtttattcgtgtactagtcaacgtataagttagtcggtcctactacgtcgtttacggcggtaagggacgtaaggtcggancgtanaaccggtactggtagtccgngactactctcgttagtcttactcgtccg

SEQ ID NO: 160646 - DNA, 679 bp, Homo sapiens
  misc_feature: GYAE6OF02IXU58.9.67.G01.1.454.CMB.1.raw
  modified_base (198)..(198): a, c, t, g, unknown or other
  misc_feature (198)..(198): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccacctgtctgtgtttccagganaaacagccactctcacctgcaggccagtcagagtctggcacaacttgcctggtaccagcagacgaccgtggcttggcctccgaggtccctcacttcgacggtcgccgtccgagccgacgggccaacgttggtactcccggctacgggttcaggttggtacggtcgggtcgtaggggaactacggttacggtttccggttctaccgaacctacgttcgaacggtcaacggtcctggacgtacggttcgtagtaagttacgttttcggtacgttaggttttaacttacgttgttacgtagtaccgtaacttagttaacgttaggttcggtaccgtacgttacgtaaccgtttccgggacgggtaaccgggtaaccgtaagggtacggtacgtaccgtaacgtaaaccggtaacgttaggtacggtacgtacgtaccgtaaccgttacgttaccgttcgttacgtttaccgtaaccgtttcccg

SEQ ID NO: 160647 - DNA, 589 bp, Homo sapiens
  misc_feature: GYAE6OF02G0LX2.9.67.G01.1.454.CMB.1.raw
  modified_base (371)..(371): a, c, t, g, unknown or other
  misc_feature (371)..(371): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccacgtggtactcccggcaggttcaggtggtagtgggtctgggactagagttcgttcncacatcagcagcctgcagtctagaagtatttgacttaagtttacttactgttacagtctaactagtaattagttcggcccgtacttaccgtaccgttttacggggacgggtaacgggtaacccgtaagggtggaacgtacgtaacgaaaccggtaagtcggtaggtaccgtagacccgtaactacgttaccgttacgttaccttaccagttacccccg

SEQ ID NO: 160648 - DNA, 572 bp, Homo sapiens
  misc_feature: GYAE6OF02IZK69.9.67.G01.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (390)..(390): a, c, t, g, unknown or other
  misc_feature (390)..(390): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccagganaaacngccactctcacctgcagggccagtcagagtcttggcaccaacttgcctggtaccagcagagacctggcttggctcccagggtcctcatctacggtgcgtccagcgacgggccagtcggtactcccggctaggttcaggtggtagtgggtcgtgggactagagtttcgttctcaccatcagcagccngcagtctgtaagtgtttcgacttagtttattactgtcagctaactataagttagttcggtaccgtctctacgtttccgggacgggtaacgggacgtaagggtggacgtccgtaacgaaccggtaacggtggtacggacttcggacctaccgtacttccgttggttaccttactacttccccg

SEQ ID NO: 160649 - DNA, 570 bp, Homo sapiens
  misc_feature: GYAE6OF02JLF6B.9.67.G01.1.454.CMB.1.raw
  modified_base (205)..(205): a, c, t, g, unknown or other
  misc_feature (205)..(205): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggtagaaacngccactctcactgcagggccagtcagagtcttggccacacttagcctggtaccagcagagacctggactttggctcccgagggtccctcatctacggtgccgtccagcacgggccactgggtactcccggctaggttccaggttcggagtggggtctggggacaggtacgttcgttctcaccatccagcacgccgtgacagttcgtagaagttatttgacttagtttacttacgtgtacagtcctaattatatacgttggcccgtctaccgtactttcgggccggtaaggaccgtaggtcggacgtcctagtaacgtaacgtaggtcggtctcgtacacctagttcgtggtcttagacttccccg

SEQ ID NO: 160650 - DNA, 674 bp, Homo sapiens
  misc_feature: GYAE6OF02IOU6K.9.67.G01.1.454.CMB.1.raw
  modified_base (203)..(203): a, c, t, g, unknown or other
  misc_feature (203)..(203): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttcaggagaaacngccactctcacctgcagggccagtcagagtcttggcaccaacttgcctggtaccagcagagacctggcttggctccgagggtcctcacgtcgtacggtgcgtccgagcgacgggccacgtcggtacgtcccggctacggttcaggttggtaggtggggtcgtggggactaggtacggttttcgttactcgacctagtcgaacgtcacgtccgtcgaccgtagtccgtaggtaagttacgttttgacgttaagttttattacgttagtacgagtctaacttagttaaagttcggttacggtccgtcgttaccgttaccgttttccggggaacggggtaaccggggtaaccgtaaaggggtcgggaacgtaccgtaaccggtaaacgggtaaccgttacgggtacgggtaccgttaccggaaccgtaaccgtacgtttccgttaccggtttacctttacccgtactttccccg

SEQ ID NO: 160651 - DNA, 571 bp, Homo sapiens
  misc_feature: GYAE6OF02JOTKL.9.67.G01.1.454.CMB.1.raw
  modified_base (204)..(204): a, c, t, g, unknown or other
  misc_feature (204)..(204): n is a, c, g, or t
  modified_base (416)..(416): a, c, t, g, unknown or other
  misc_feature (416)..(416): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccagcagacgacctggcttggcctcccgagggtcctcatcgtacggtcgccgtccagcgacgggccacgtcggtactcccggcgtaggttcaggtggtagtgggtctgggactggtacgttcgtctcaccgatcagcacgtcctgctgtctagtaagtntttgacttagtttactacgtgtcagctatatacgttgtcgctctcgtacgttcgggacggtacggacgtaagggtcgtagtacgtaacgtaacggtacggttgtacggtcgtacgcgtaaccgtagttccgttgttaccttacgacgtttccccg

SEQ ID NO: 160652 - DNA, 757 bp, Homo sapiens
  misc_feature: GYAE6OF02IEY9Q.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctcagccacctgtctgtgttccaggagaaacagccactctcaccgtgcaggccagtccagagtcgttggcaaccgtaacttcgcctggtaccagccgagagaccctggccttagggcctacccgagggtccctacgacgttccgacgggtgccgtaccaggccgacggggccctaacgtgggtaccttccccgggccgtaaggttccgaaggtgggttaagttcgggggtcctcgggggtaacgacggtacggttttaccgttcgttaccaacccgttacgttaccggaacgtccgaacggtcccgttaggaccctacggttacccgtagttaaacggtcttttcggaaccttaagggttttaaccttaccggttacgtagacggtaccttaacgtagtttaaacgttagtccgggttaccgtccgttactaacccgggttttcggacccgggtaaacggggtacccgtaaggggtacggtaccggtacgttaaccggaaaacggtacggttcggttaacgggtcctaaccggggttaccaaacctacggttcccgtttagtttaccgttaacttcccgttaaccccgg

SEQ ID NO: 160653 - DNA, 606 bp, Homo sapiens
  misc_feature: GYAE6OF02FVPQP.9.67.G01.1.454.CMB.1.raw
  modified_base (204)..(204): a, c, t, g, unknown or other
  misc_feature (204)..(204): n is a, c, g, or t
  modified_base (392)..(392): a, c, t, g, unknown or other
  misc_feature (392)..(392): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcacctaacttacgcctaggtaccagcagacgaccgtggcttggcctcccgagggtcctcatccgtacggtgccgtccaggcgacgggccacgtggtacgtcccggctaggttcaggtggtaggtgggtctgggacaggtcgttcgtctcactntcagcagcctcgcgtagtctagaagttagttttgacgttagtttacttacgttgtactagacctacttaattaagttaggttcggccgttactccgttacggtttccgggacgggtaacgggtaccgtaagggtcggacgtccgtaacgaaacggtaacgtcggtacgggtctcgacctaccgtagttccgttgttccttactacctttccccg

SEQ ID NO: 160654 - DNA, 608 bp, Homo sapiens
  misc_feature: GYAE6OF02HI21R.9.67.G01.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccagcagagacctggcttggctcccgagggtcctcatcgtacggtcgacgtccagcagggcccacgtggtactccccggacgtaggttcaggtggtaggtgggtctggggacaggtagttcgttcacgacatcacgcacgccgtgcgtacgtcgtagaacgttattttgacttagttttaacttacgttgtacagtcaacgtataagttagtcggacctctactacggtttacgggacggtaacgggtaaccgtaagggttcgacgtccgtaaacgtaaccggtaacgttcggtacggtaccgtacgtacctacgtacttccgttacggttcctttaccgactttaccccg

SEQ ID NO: 160655 - DNA, 577 bp, Homo sapiens
  misc_feature: GYAE6OF02IY419.9.67.G01.1.454.CMB.1.raw
  modified_base (198)..(198): a, c, t, g, unknown or other
  misc_feature (198)..(198): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccagganaaacagccactctcacctgcagggccagtcagacgtcgttggccaccaacttagcctggtaccagcgagagaccctggcttggctcccgagggtcccttgactcttacggtgccgtccagcgagggcccagtggtactcccggcaggttccaggttggtaggtgggtcgtgggtacagtaggtttcgttctactaccatccgagcagcctgcagtctgaagttntttgnttaagtttattactgtcacgtactaactataagtggttacgtccgtctctacgtttcggcggaagggaccaaggtcgagcgtaacgaacgtaacgtggtacggtcgtacgtaccgtacgtacgttaccgtcgttacttcgtcttaccccg

SEQ ID NO: 160656 - DNA, 614 bp, Homo sapiens
  misc_feature: GYAE6OF02GFTVD.9.67.G01.1.454.CMB.1.raw
  modified_base (205)..(205): a, c, t, g, unknown or other
  misc_feature (205)..(205): n is a, c, g, or t
  modified_base (304)..(304): a, c, t, g, unknown or other
  misc_feature (304)..(304): n is a, c, g, or t
  modified_base (421)..(421): a, c, t, g, unknown or other
  misc_feature (421)..(421): n is a, c, g, or t
tcagtgatacgtctcacgaccggtgctcgatttagagtatacatattggggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttcgcctggtaccagcagagactggcttggctcccgagggtcctcatcgtacggtcncgtccaggcagggcccacgtggtactcccggcgtaggttcgaggtcggtaggtgggtcgtgggactaggtagtttccgttctcctacatcagcacgcctgctagtctaggtaagttntttgacttagtttattacttcgtactagacctaacttaacgtaagttacgttcggtacccgtacttaccgttaccggttttcggggacgggtaacgggtaccggtaagggttgggacgtaccgtaacgaaacggtaacgtggttacggcgtcggaccgtactacgttccgtacggttccttacgtcttccccg

SEQ ID NO: 160657 - DNA, 552 bp, Homo sapiens
  misc_feature: GYAE6OF02GSSH0.9.67.G01.1.454.CMB.1.raw
  modified_base (204)..(204): a, c, t, g, unknown or other
  misc_feature (204)..(204): n is a, c, g, or t
  modified_base (378)..(378): a, c, t, g, unknown or other
  misc_feature (378)..(378): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttgcctggtaccagcagagacctggcttggctcccgagggtccctcatcgtacggtgccgtccagcagggccacgtggtactcccggcaggttcaggttcggtagtcgggtctgggacagtagtttcgttcncacctatccagcagcctgcagttcgtgtaagtatttgcttagtttacttacttgtcagtactactataagtgtggcctctacgtcgttcggcggtacggtacgaagggtcgagtcgtacgaacggtatcggtacggcttcgaccgtactcgtccgtcgtacttcgtattccccg

SEQ ID NO: 160658 - DNA, 566 bp, Homo sapiens
  misc_feature: GYAE6OF02IM9OI.9.67.G01.1.454.CMB.1.raw
  modified_base (530)..(530): a, c, t, g, unknown or other
  misc_feature (530)..(530): n is a, c, g, or t
  modified_base (547)..(547): a, c, t, g, unknown or other
  misc_feature (547)..(547): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagccaccctgtctgtgtttccaggagaaacagccactctcacctgcagggccagtcagagtcttggcacacttagcctggtaccagcagacgacctggcttggctcccgagggtcctcatctacggtgcgtccagcacgggccacgtggtactcccgggctaggttcgaggttggtagtgggtcgtgggataggtacgtttcgtctccactatcgagcacgtccgtgactacgtctaggtaagttagtttgacttagtttattacgtgtacagtactaacttataagttaggttcggccgtctccgttacggtttcgggacggtacgggtacgaagggtggacgtacgtaacgaacgngtggcgcgtcgctactnttcgtcgtcttcacttccc

SEQ ID NO: 160659 - DNA, 671 bp, Homo sapiens
  misc_feature: GYAE6OF02JUCCH.9.67.G01.1.454.CMB.1.raw
  modified_base (228)..(228): a, c, t, g, unknown or other
  misc_feature (228)..(228): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggcctanggtacagtgtctacgactaacgacttgcctaggaccaggcagagcctggccttcggacgtccgtaggtcctcgacgtcgacggtcgacgtccacggccgacggtccgtacgtccggtaccgtcccgggtactacggttcgtaggttgggttacgtcgggtacgtagggtacgttaggttacgtttcgtaccgtaccaccgtacgtacgacgtcctacgtccgtggtacgtaaggtacgttagttaacgtactttacggtacttagtttacttacgtagtactacgtacttaacttaagttaacgttacgtacgtaccgttacgttacgttacgggttacgggaacggtacgggaccgtaggtacgtacgtaacgtaacggtaacgtacggtacgtacgacgtaacgtaccgtacgtacgttacgtacgttccttaccgtaccg

SEQ ID NO: 160660 - DNA, 579 bp, Homo sapiens
  misc_feature: GYAE6OF02GG76D.9.67.G01.1.454.CMB.1.raw
  modified_base (572)..(572): a, c, t, g, unknown or other
  misc_feature (572)..(572): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgttgtttccaggagaaacagccactctcacctgcagggccagtcagagtcttggcaccaacttagcctggtaccagcagacgacctggcttggcctcccgagggtccctcatcgtacggtcgccgtccaggcacgggccacgtggtactcccgggctacggttcaggtggtaggtgggtcgtgggacaggtagtttcgtctcaccatcagcacgcctgcgtagtctagtaacgttagtttcgacttaagttttacttacgttgtacgagacctaattataagttacggttcggccgtcttcgtacggtttcgggacgggtaacggaccgtaagggtgacgtctacgaacggtacgtggtcgtcgtgccacgtattcgtcgtcttcncttcccg

SEQ ID NO: 160661 - DNA, 670 bp, Homo sapiens
  misc_feature: GYAE6OF02IS3AU.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaacagccactctcacctgcaggccagtcagagtctggcacaacttgcctggtaccagcagagacctggcttggctcccgagggtcctcactctacggtgcgtccgagcgacgggcctaccgtcggtacgtcccggaccgtaggttacacggtggtagtcgggggtactggggacaggtacgtttcgttctacgaccctatcgacgcacggacctggactaggtcctaggtaaacgttagttttacgacgttaacgttttacttacgttacgtacctacgtactacgttaaattaacttaggttaccggtcccgttaccgtacgttaccggtttccggggacggggtaacggggaacccggtaaagggtcgggtaagtcccgtaacggaaaccggtacgttaacgggtcggtacccgtcggtaaccctaccctaacgttccttacgggtttaccttccgtaacgttcccccg

SEQ ID NO: 160662 - DNA, 578 bp, Homo sapiens
  misc_feature: GYAE6OF02HOYR7.9.67.G01.1.454.CMB.1.raw
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
tcagtgatacgtctcacgaccggtgctcgatttagagtatacatattggggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagcccactcctcacctgcagggccagtcagagtcttggcaccaacttagcctggtaccagcagacgacctggcttggcctcccgagggtcctcatccgtacggtgccgtccagcgacgggccagtcggtacgtcccggcctagggttccaggttcggtaggtggggtcgtggggacaggtaggtttcgttcgtacacctatcgagcagccgtgcaggtctaggtaagttntttgnttagtttattcgtgtcagtacattaatagtagtggcctctctacggttcggacgggtaggacgtagggtggacgtctaacgaaacggtacgtcggtacggtctcggactacgtcttccgttcgttccttcgacttcccg

SEQ ID NO: 160663 - DNA, 770 bp, Homo sapiens
  misc_feature: GYAE6OF02HL6G3.9.67.G01.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggccaccacttagcctggtaccagcagagaccgtggtcttggcctcccgacgggtccctcactctacggtcgtccgtccgagaccgacgggccctacgtcgggtacctccccgggaccgtaagggtttccgaaggttcgggttagggtcgggggttaccgttacgggggaactaggtacggttttccggtttactaccgtaaccgtagtccgaggtccgtacggtcccgtcggacctacggttaccgtaggtaaagttagtttttacgacgtttaacgttttattaaccgtttgttacctacgtacctaactttaaagttaacgtttaacggttccgggtacccgttccgttacccgtttaccggtttaccggggtaccggggtaacgggtaacccggtaaaggggtacgggtaccggtacccgttaaaccgtaaaccgggtaaaccggttcggggtaacgttccgtaccgggttaaccctacccgtacgtttaccgttaccgtttccgtttaccgttaaccctttcccccgg

SEQ ID NO: 160664 - DNA, 383 bp, Homo sapiens
  misc_feature: GYAE6OF02IKJZP.9.67.G01.1.454.CMB.1.raw
  modified_base (305)..(305): a, c, t, g, unknown or other
  misc_feature (305)..(305): n is a, c, g, or t
  modified_base (377)..(383): a, c, t, g, unknown or other
  misc_feature (377)..(383): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcacaacttagcctggtaccagcaagagacctggcttggctcccagggtcctcatctacggaactgnggctgcaccatctgtcttcatctcccgcatctgaagacgtatcactgagcgggctggcaagggcacgatagnnnnnnn

SEQ ID NO: 160665 - DNA, 524 bp, Homo sapiens
  misc_feature: GYAE6OF02F0XSA.9.67.G01.1.454.CMB.1.raw
  modified_base (374)..(374): a, c, t, g, unknown or other
  misc_feature (374)..(374): n is a, c, g, or t
  modified_base (497)..(497): a, c, t, g, unknown or other
  misc_feature (497)..(497): n is a, c, g, or t
  modified_base (507)..(507): a, c, t, g, unknown or other
  misc_feature (507)..(507): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtactcccggccaggttcagtggtagtgggtctggggacaggagttcgtctcacntcagcagcctgcagtctgagtatttgctagttattactgtacagctactattaatagttacggccgtcgtactactttcgggccggagggtacgaagggtggagtacgtacgtaacgactggnggctgcgacncgtctgtctcattcccg

SEQ ID NO: 160666 - DNA, 563 bp, Homo sapiens
  misc_feature: GYAE6OF02G2DOI.9.67.G01.1.454.CMB.1.raw
  modified_base (203)..(203): a, c, t, g, unknown or other
  misc_feature (203)..(203): n is a, c, g, or t
  modified_base (389)..(389): a, c, t, g, unknown or other
  misc_feature (389)..(389): n is a, c, g, or t
  modified_base (502)..(502): a, c, t, g, unknown or other
  misc_feature (502)..(502): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccagcagagacctggcttggctcccagggtcctcatcgtacggtgccgtcagcgagggccactgggtactcccggcctaggttcaggttggtaggtgggtctggggacaggtgtttcgttctcaccatcagcngcctgctagtcgtagaagttatttgcttaagtttacttacttgttcagtctaacgtattaagttagttcggtacctcgtctacgtttcgggacgggtaacgggacgtaagggngacgtcgtacgaaacggtctgggtggcgtacgccactagtccttggtccttcgcttccccg

SEQ ID NO: 160667 - DNA, 550 bp, Homo sapiens
  misc_feature: GYAE6OF02GJM55.9.67.G01.1.454.CMB.1.raw
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
  modified_base (491)..(491): a, c, t, g, unknown or other
  misc_feature (491)..(491): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatccgtacggtgccgtccagcgagggcccacgtggtaccgtccccggccaaggtttcgaggttggtaggtcggggtctaggggactaggtagtttcgtctcacctatcagcagcctgcagtctgagtntttgntagtttatacgttntcancatatatgttcgcgtctctacgttcgggacgacggtaccgaggtggancgtacgaacgtacgtggtcggcgtacgctacctagttccgtacgtccttacacttcccg

SEQ ID NO: 160668 - DNA, 573 bp, Homo sapiens
  misc_feature: GYAE6OF02G82HQ.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtcctcatctacggtgccgtccaggcacgggccacgtggtactcccggcctaggttcaggtggtagtgggtcgtgggactaggtagttcgttctcaccatcagcagcctgctagtctagtagtagtttgcttagtttattacgttgtactacgtacacttaataagttacgttcggaccgtcttacgtccgtttacgggccggggtaacgggtaccgtaagggtcggacgtccgtacgaaacgtacgtggtcggcgtacgcacgtctcgtcgttcttctattcccg

SEQ ID NO: 160669 - DNA, 756 bp, Homo sapiens
  misc_feature: GYAE6OF02GFNX8.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcacacttagcctggtaccagcgagacgaccgtggtcttggcctcccgaggtccctgacttcgtacggtgccgtccagcgacggccacgtggtacgtccccggcgtaggttcacggttggtacggtggggtcctggggaactaggtacggtttccgttacgtccaacgtatccgaagtcgacggtcccgtagaccgtacggtacttacggtaaagtttagttttcggaacgtttaacgttttaacgttaacggttacgttaccgtacggtaacctaacgttaaagttaaacgttacggttttacgggacccgttcgttaccgttacgggttttaccgggaccgggtaaacgggtaacccggtaaaggggttacggggaacgttacccggtaaaccgtaaaaccggggtttaaaccgttacgggtacggggttacccgttaccgggtaaccctaaccgggtttaaccgttccggttttacccggttttaccctttacccggttacccgtttacccccgg

SEQ ID NO: 160670 - DNA, 682 bp, Homo sapiens
  misc_feature: GYAE6OF02HLEOF.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagccaccctgtctgtcgttccaggaagaaacagccactctcacctgcgagggccaaggtcaagacgttcttggccaaccaacgtttagccttacggtaccaggcagacgtaccgtggtcgttggcctcccgtaggggtccctacacttcgtacgggtcggctccgagccgagggcccaagttggtacgtccccgggacctagggttccaggtggtacggtgggtacgtgggaactggtacgtttcgttctacacctatcgaagccgacgcttgacgtagtacctaggtaagttatttagacttaagttttaacgtacgttggttacacgtactaacgttaataagttaacggttcggaccgttactccgttaacggtttccgggacgggttaaccgggtaaccggtaagggtacggtacgacgttaaacgtaaaccggtacgttaggtggaccgttacggacccttaccgacgttaccttccgggttaacttccgtacgtttacccccgg

SEQ ID NO: 160671 - DNA, 531 bp, Homo sapiens
  misc_feature: GYAE6OF02GZMED.9.67.G01.1.454.CMB.1.raw
  modified_base (392)..(392): a, c, t, g, unknown or other
  misc_feature (392)..(392): n is a, c, g, or t
  modified_base (402)..(402): a, c, t, g, unknown or other
  misc_feature (402)..(402): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtctggcaccaacttagcctggtaccagcagagacctggcttggcctcccagggtcctcatctacggtgcgtccagcagggccacgtggtactcccggctaggttcaggttggtagtgggtctggggactaggtagttcgtctcacatcagcagcctgcngtctgaagtntttagctagtttattctgtcagctactataatagttgccgctctacgttcggacggtaggaccgaaggtggatcgtacgaacgtacgtggtcgagtcgacaccgtatccgttgtcttactgttaccccg

SEQ ID NO: 160672 - DNA, 636 bp, Homo sapiens
  misc_feature: GYAE6OF02FNQJA.9.67.G01.1.454.CMB.1.raw
  modified_base (293)..(293): a, c, t, g, unknown or other
  misc_feature (293)..(293): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaagcagccactctcacctgcagggccagtcagagtcttggcaccaacttagcctggtaccagcagagacctggcttggctcccgagggtccctnactcgtacggtcgccgtccgagcgacgggccacgtggtactccccggctaggttcaggtgggtaggtgggtcgtgggacaggtcgttcgttctacaccatcgacgcgacgcctgcgtagtcgtaggaagttactttacgacttagttttacttacgttcgtactacgtactaacgttaagttaagttacggttcggtacccgtacgttaccgttacggttttccggggaccgggtaacgggtaaccgtaaggggtacggtacgtaccgtaacgtaaaccggtaacgttcggtacggtaccgtcggaccctaccgtacgttccgtacggttccttacgtacccg

SEQ ID NO: 160673 - DNA, 716 bp, Homo sapiens
  misc_feature: GYAE6OF02I8NQI.9.67.G01.1.454.CMB.1.raw
tcagtgatacgtctcacgaccggtgctcgatttagagtatacatattggggtttgggggaggaactgctcagttaggacccagacggaaccatggaagccccagcgcagcttctcttcctcctgctactctggcctccagataccactggaataatagtgatgacgcagtctccagccaccctgtctgtgttccaggacaaacagccactctcactgcgaggtccagtcagacgtcttggcaccgtaacttagcctaggtaccagcagacgtacctcgggcttcggcctaccgacgggttcctcgaatccgtacggttcgccgttaccgaaggccgtaacggggccctaacggttcgggtaactccccgggaccgtaacgggttcgtaaggtcgggttaacggtggggtccggtaggggaacgtaagggtacggtttcggttcctcggaaacccgtagttccgaacgtccgtacggtccctaggtacctacggtaccgttaggaaacgttacgttttagtacgttaagtttaacgtttaacgttcgttactacggtactaacgttaataaggttaacgtcggtacctccgtttacgtaccgggttttacgggaccggggttaacgggtaacggtaaacggggtcggtaagtaccgttagaaacgggtaacgtacggttacggacgtcgacacggtactcgtctctcgtcttacccg

SEQ ID NO: 160674 - DNA, 721 bp, Homo sapiens
  misc_feature: GYAE6OF02JEM7K.9.67.G01.1.454.CMB.1.raw
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
tcagtgatacgtctcacgaccggtgctcgatttagagtatacatattgggtttgggggaggaacgtgctcagttaggacccagacggaaccatggaagccccagcgcagcttctcttcctcctgctactctggctccagataccactggaataatagtaatgacgcagtctccagccacctgtctgtntttccaggagaaangccactctcacctgcaggccagtcagagtcttggcacctaacttagcctggtaccagacagacgaccgtggaccgttgcctcccgacggggttccctcgacgttacgtaacgggttcggccgtcccgtaggccgagggcccctacgtcggtacgtccccggacgtacggttccaagggttcggtacggtcggggttccgtaggggaacctagggtacgtttaccggttccgtaccgtacccgtacttaccgacggtcccgaagtcccgttcggaccgttacggttaccgttaggaaacgtttacgttttacgcttaaggtttttacctacgttcgtacgtacgtactacttaagttaacgtaggtttccgaccggttccttacgtttaccggtttaccgggacgggtaaccggggtaaccgtaagggtcgggacgtaccgttacgaaacggtaaccttgggttaccgtcgtacgacccgacgttacgttcgtccgttactccgtacttccgttaccccg

SEQ ID NO: 160675 - DNA, 544 bp, Homo sapiens
  misc_feature: GYAE6OF02FWIT4.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccatggtactcccggcaggttcaggtggtagtggggtctggggacagtagtttcgtctcacctatcacgcagcctgcagtctagaagtattttgacttagtttattacttgtctagctatataatagttggccgtctctacgtttcggacggtaacggacgaagggtggagcgtacgaaacgtaacgtggtcggcgtcgtaccacctactcgttcgtcttactacttcccg

SEQ ID NO: 160676 - DNA, 761 bp, Homo sapiens
  misc_feature: GYAE6OF02G2M8F.9.67.G01.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccagcagacgacctggcttggcctcccgagggtcctcactcgtacggtgccgtccaggcgacgggcccacgtcggtacgtccccggtaccgacgggtttccaggttacgggttacggttcgggggttcgtacgggggaactagggtacggttttccggttaccgtaccgtaaacccgtagttacccgaacggaccctacggtcccgtacggaccgtacggttaccgttaaggtaaacggttagtttttcggaaccttttaacggtttttaactttaccgttacggttaccgtaacgtaccgttaactttaaagtttaaaccgttacgggtttccgggaccccgttacgttaccgttaacccggttttccgggggaaccgggttaacggggtaaccggtaaggggttacggaccggtacgtaaaccgtaaaccggtaacgttcgggtacggtccgtacgacccgtaacttccgttacgttcgttactttaccgactttaccccgg

SEQ ID NO: 160677 - DNA, 783 bp, Homo sapiens
  misc_feature: GYAE6OF02I2THJ.9.67.G01.1.454.CMB.1.raw
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagcccacctgtctgtcgtttcaggagaacngccactctcacctgcagggccngtcagngtctggcaccaacttgccgtggtaccagcaggacgaccgtggccgttcggcctcccggtacgggtccctctacgttccgtacggtcggtccgttacccgaggtaccggacggggtaccctaccggttacggggttaacccgtcccccgggtaccgtacggggttttccgaaggggtttacgggttacgggttcggggggtaccggtaggggggtaacttacgggttaacggtttttccgttaccgttaaccgtacccttaaagttccaacgggtcctaacggtcccgtaggtaccgtaacggttacgttacggtaaacgtttacgttttacgtacgtttaacgttttaacgttaccgttgttaccgtacgtaccttaaacgttaacttaacgttacggttacggccgttaccttcggttccggtttaccggggacggggttaaccggtacgggtaacgggttacggtacggtaccgtaacggtaaacgggtcgtagggtaccggtcgtacgtactaccgtacgttcgttcgtttaccttcctacgttccccg

SEQ ID NO: 160678 - DNA, 601 bp, Homo sapiens
  misc_feature: GYAE6OF02HRTUF.9.67.G01.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactcctcacctgcgagggccagtcagagtcttggaccaccaacttacgcctggtaaccagcagacgaccgtggcttggcctcccgagggtccctcactcgtacggtcgccgtccagccgacgggccctacgtacggtacgtccccggtccgtaggtttcgaggttcggttaggtcgggtcgtgggactaggtacgtttcgttctaccaccgtatcgagcacgtcctgcagtctagtagttatttcgactttagtttattacgtgtacagtctaagttataagttcgtcggtccgtctaccgtacggttacgggcggtaacgggtacgtaagggtgacgtcgtaacgaacggtacgtggtcgctacgactactagtcttgtcttcgacttccccg

SEQ ID NO: 160679 - DNA, 882 bp, Homo sapiens
  misc_feature: GYAE6OF02JH3AL.9.67.G01.1.454.CMB.1.raw
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcaggccagtcagagtcttggcacctaacttacgcctggtaccagcagagacctggcttggcctcccgagggtccctcattccgtacggtcgccgtccaggccgagggccctacgtgggttaccgtccccggcgtacgggttacacggggttagggttacggtgggggttcctagggggaacctagggttacggttttaccgtttccgtaccgaaacccgtacgttaccggacggtaccgtaacgggcccgttacggtaccgttaaccgggttacgtacgggtaaaacggtttaggtttttacggtaaccgtttaaggttttttaacgttttaaccgttcggtttaacccgtaagttaacccgttaaacttttaaacggttaaacgttttaacggggtttcccgggtaccccgtaccgttttacccggtttaaaccggggtttttcccggggggaaccgggggtttaaaccggggtaaacccccgggttaaaaggggggttacggggtaacccggttaacccggttaaacccggtaaaacgggttaaacccgggtttaggggtacccggggttaacccgttaacccggtaacctaaccccggtaacgggttttccgtttaccgggttttaacccgtttaccccttaacccgggtttttaccccccg

SEQ ID NO: 160680 - DNA, 511 bp, Homo sapiens
  misc_feature: GYAE6OF02F9R5X.9.67.G01.1.454.CMB.1.raw
  modified_base (491)..(491): a, c, t, g, unknown or other
  misc_feature (491)..(491): n is a, c, g, or t
  modified_base (497)..(497): a, c, t, g, unknown or other
  misc_feature (497)..(497): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccatctcacctgcagggccagtcagagtcttggcaccaacttagcctggtaccagcagagacctggcttggctcccagggtcctcatctacggtgcgtccagcagggccactggtatcccggccaggttcagtggtagtggggtctggggacagagttcgttctcaccatcagcagcctgcagtctgaagtattttgctaggtttattacttgtcagtcactataatagttggccgtctcacgtttcggcgggtaggaccgaaggtgagctacaacgaactgtggntgcacntctgtctcatcccg

SEQ ID NO: 160681 - DNA, 678 bp, Homo sapiens
  misc_feature: GYAE6OF02G3CBJ.9.67.G01.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccagcagagaccgtggcttcggctccgagggtcctcatcgtacggtgcgtccaggcgagggcctagtcggtacgcccggcaggttcgaggttggtaggtcggggtcgtaggggaactaggtagtttccggttctccgaacctactcgaacgccgacgtccgtgacgtagttctaggtaagttattttcgactttagtttatttacgttgtactagtactaacttaagttattaggttaccggtcccgtacgttaccgttaccgggttttaccggggaccggggtaacggggtaaccgtaaaggggtacgggtaacggtacccgtaaaccggtaaaaccggtaacggttacgggtaaggtcctacggtaccctaaccgttacttccgttccggtttacctttacccgtacccgttaccccgg

SEQ ID NO: 160682 - DNA, 725 bp, Homo sapiens
  misc_feature: GYAE6OF02H9TEH.9.67.G01.1.454.CMB.1.raw
  modified_base (203)..(203): a, c, t, g, unknown or other
  misc_feature (203)..(203): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacngccactctcacctgcagggccagtcagacgtcgttggccaaccaacgttagccgtggtaccagcaggaggacctcggcgtttggcctccgaggtcctcgactcgtacggtcgcgtccgagcgacgggcctacgtcggtacctccccgggacctagggttcctaggttacgggttacggttcggggtcgtaggggactacggtacggtttccgtttcgtaccgtaccgtagtaccgacgtccgtacgtccgtacggacctacggttcgtacggtaagttacgttttcgaaccgtttaggtttttaacttacgttacggttccgtaagttacctaaacgttaattaacgtttagggttccggtacccgtccgtttacgttaccggtttacggggtacgggtaacggggtaaccgtaaggggttacggtacgtaccgttaacggtaaaccggtaacggttcggtacggtccggtacgaccgtaccgttaacgttccgttacggttcctttactaccgtttccccg

SEQ ID NO: 160683 - DNA, 705 bp, Homo sapiens
  misc_feature: GYAE6OF02HN721.9.67.G01.1.454.CMB.1.raw
  modified_base (203)..(203): a, c, t, g, unknown or other
  misc_feature (203)..(203): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccacctgtctgtgtttccaggagaaacngccactctcacctgcacgggccagtcagagtcgttggacaccaacttacgcctggtaccagcaagagaccgtggcttggcctcccgagggtccctcacgttccgtacggtcgccggtccaggcgacgggcctaacgttcggtaccgtccccgggacgtagggttccgtaggtggttagggtcggggtcgtaggggacgtaggtacgtttccgttactacctaccgattacgacgtacgtacgtccgtcgacgtacggttctaggttaagttcgttttggacgtttaagttttacttacgttcgtacgacgtactaaacgttattaaggttacggttccgggaccgttaccttaccgttaaccgggtttccgggacggggtaacgggaaacccggtaagggtacgggacgttaccgtaaccgtaaaccggttacgtacgggttacgggtactaccgaccgtaccttacgttccgttacgtttccgttaccttccgttccccgg

SEQ ID NO: 160684 - DNA, 544 bp, Homo sapiens
  misc_feature: GYAE6OF02GVHK4.9.67.G01.1.454.CMB.1.raw
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (390)..(390): a, c, t, g, unknown or other
  misc_feature (390)..(390): n is a, c, g, or t
  modified_base (400)..(400): a, c, t, g, unknown or other
  misc_feature (400)..(400): n is a, c, g, or t
  modified_base (523)..(523): a, c, t, g, unknown or other
  misc_feature (523)..(523): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggccaccaacttagcctggtaccagcagagacctggcttggctcccagggtcctcatctacggtgcgtccagcagggccacgtggtactcccggctaggttcaggtggtagtgggtctgggacngagttcgtcncaccatcagcacgcctgcngtctgaagtntttgctagtttattacttgtcagtctatattaaataggttcggccgtctcgtacgtttcgggacgggtacgggaccgtaagggtggacgtctacgaacggtacgtaggtggcttgacgtaccnttccgtgttcttctagttccc

SEQ ID NO: 160685 - DNA, 772 bp, Homo sapiens
  misc_feature: GYAE6OF02GJEOU.9.67.G01.1.454.CMB.1.raw
tcagtgatacgtctcacgaccggtgctcgatttagagtatacatattgggtttggggaggaactgctcagttaggacccagacggaaccatggaagccccagcgcagcttctcttcctcctgctactctggcctcccagataccactggaataatagtgatgacgcagtctccagcccaccctgtctgtgtttccaggagaaacagccactctcaccgtgcgacggccagtcagagtcttggccaccaacttagccgtggtaccagcagacgaccgtggcgttcggcctcccgtacgggtcctcacgttcgtacggtcgccgtccgagccggacggccctaggttcggtaccgtccccgggtcgtacggttcgaaggtttcgggtaggtcggggttcgacggggtacgtaggttacggttttcggttcctacgtaacccgtataccgacgtaccgtacgccgttcggaccgtacggttacgttacggtaacggtttagtttcggtaacgtttacgttttaacgtttacgttacgttacgtacgtaccttaacgttaagttaaggtttacggttcggtacccgttaccgtttacgttacccgggttttccggggaccggggttaaccgggtaaccggtaacggggttacggaaccgttacggttaaccggtaaacggttaccggttagggttccgggtaacccgttacggacccgttaacccgtacgttccggtttacccgtttacccgtttaccgtacccgttttcccccgg

SEQ ID NO: 160686 - DNA, 621 bp, Homo sapiens
  misc_feature: GYAE6OF02FQ44I.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaacagccactctcacctgcagggccagtcagagtcttggcacccaacttacgcctggtaccagcagagacctggcttggcctcccgagggtcctcatcgtacggtgccgtccaggcagggccactggtactcccggccgtaggttcagttggtaggtggggtcgtgggacaggtagtttcgttctcacctatcagcagcctgctagtctagtaagtattttgctagttttattacgttgttctaacgcctaacttattaagttggtttggccctcgttcttaccggtttccggggccgggtaacggggaacccgtaaggggtaggacggtaccgtaaccgtaaacggtaaccgttagggtacgggtacgttaccggacccgttacctcggtttccgttacggttctttaccactttcccccg

SEQ ID NO: 160687 - DNA, 622 bp, Homo sapiens
  misc_feature: GYAE6OF02F2F25.9.67.G01.1.454.CMB.1.raw
  modified_base (204)..(204): a, c, t, g, unknown or other
  misc_feature (204)..(204): n is a, c, g, or t
  modified_base (334)..(334): a, c, t, g, unknown or other
  misc_feature (334)..(334): n is a, c, g, or t
  modified_base (402)..(402): a, c, t, g, unknown or other
  misc_feature (402)..(402): n is a, c, g, or t
  modified_base (421)..(421): a, c, t, g, unknown or other
  misc_feature (421)..(421): n is a, c, g, or t
  modified_base (445)..(445): a, c, t, g, unknown or other
  misc_feature (445)..(445): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagcccaccctgtctgtgttccaggagaaacngccactctcacctgcagggccagtcagagtctggaccaccaacttagcctggtacccagcagagacctggcttggcctcccgagggtccctcatcgtacggtcgcgtccagcgtacggccacgtggtccncccggctaggttcaggtggtagtcggggtcgtagggactaggtcgtttcgttctcactatccgacgcngcctgactgtctgaagttntttcgacttagtttattaccgttntcgtagtcctaacgtagtttaacgtacggtttcgaccttcgttccgtacggtttccgggacgggtaccgggaacgtaggggtacgtacgtcgttaaccgaaacggtaccggttgggtaccgtcgttaacggaccctaacgttacgttcgtttcgttaccgttactcccgtttacccg

SEQ ID NO: 160688 - DNA, 643 bp, Homo sapiens
  misc_feature: GYAE6OF02G1K6M.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggccaccaacttcgccgtggtaccagcagacgacctggcttggcctcccgagggtcctcagtcgtacggtgccgtccaggccgacgggcctagtcggtacgtccccgggctaggttcaggttggtaggtcgggtcgtgggactaggtacgtttcgttctccgacgtatccgagcacgcctggctagtactaggtaagttcgtttgactttagttttacgttacgttgtacgacgtacgtaacttaagtaacgttacggttcggacccgttcttaccggttaccggtttccggggacgggtaacgggtaccgtaagggtcggacgtaccgtaacgaaaccggtacgtcggtcggtacctcgtacctaccgtacgttccgttacgtttccttaccgtccgttaccccg

SEQ ID NO: 160689 - DNA, 853 bp, Homo sapiens
  misc_feature: GYAE6OF02F2UQF.9.67.G01.1.454.CMB.1.raw
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtcgtttccaggagaaacagccactctcacctcgcagggccagtcagtagtcgttggccaaccgtaactttacgaccgttggttaacccacggacctaacggaacggtacccccgttaggggccttttcggggcccttaccccccggaacgggggttccccttaccgaagtttccccgttaaccgggggttcggtcccggttcccgaacggtacccgtaacgggggtcccctaaccgggttacccgggttaacgggttcccccccgggggtaccccttaagggggttttaccccaagggggttttacgggtaacgggggttttcggggggttaccgttagggggggtaccttaaaggggtcgggtttttaccggttaccgttaccgaacccgtaacgttccaacgggtcctacggacccgttacggacgtagggtactacgggtaagttacgtttttcggatttaacgttttaagttacttggtacctaacgggtcctaagttacttaaaggttcggttacggtccgtcgtaccgttccgtttacggggaccgggtacggtaacccggtagggttagggacgggtaccaaccggtaaacggttacgtgggttccggacttcggacccgtaccgtacgttccttacggttccttacgactttaccccgg

SEQ ID NO: 160690 - DNA, 659 bp, Homo sapiens
  misc_feature: GYAE6OF02IE3X6.9.67.G01.1.454.CMB.1.raw
  modified_base (472)..(472): a, c, t, g, unknown or other
  misc_feature (472)..(472): n is a, c, g, or t
tcagtgatacgtctcacgaccggtgctcgatttagagtatacatattggggtttgggggaggaactgctcagttaggacccagacggaaccatggaagccccagcgcagcttctcttcctcctgctactctggcctcccagataccactaggaataataggtgatgacgcagtctccagcccaccctgttctgttcttccaggacaacagccactctcacctgcacgggccagtcagtattcgtggaccaacctaacttcgcccgttaggtaaccgaccagacgacctggcttggcctcccgagggttcctactacgttccggtaccgggtcgtaccgtaccgagccgacgggacctagtccgggtactcccgggactagggttcaggttacggtcggttcggggtactaggggactagggtttcgttacgtctaccactagtcagtcacgtctgactgtcgtagtagtttnttacgtagttaagtttattacgttcgtatacgtacttaatattaagtaggttccgtacgtcctaccgttcggttaccggacgggtaaccgggtacggtaagggtacgacgtaccgtaacgtaaacggtcgtacggtacggccgttaccgactaccgtcgttccgttcgttaccttccacgtttcccg

SEQ ID NO: 160691 - DNA, 719 bp, Homo sapiens
  misc_feature: GYAE6OF02I8EPJ.9.67.G01.1.454.CMB.1.raw
  modified_base (235)..(235): a, c, t, g, unknown or other
  misc_feature (235)..(235): n is a, c, g, or t
tcagtgatacgtctcacgaccggtgctcgatttagagtatacatattgggtttgggggtaggaacgtgctcagttaggacccagacggaaccatggaagccccagcgcagcttctcttcctcctgctactctggctcccagataccactggaataatagtgatgacgcagtctccagccaccctgtctgtcgtttccaggagaaacagccactctcacctgcagggccagtcagngtcttggcaccaattacgcctggtaccagcgacgtagaccgtggactttggcgtcccagggtccgtcacgtcgtacggtgccgttccagtcgaacgggccacgtcggtactcccggacctacgggttccacggtggttacggtcgggtcgtcggggaacgtaggtacggttcggttcgtccaaccgtacgttccgacgcgtacggtacccgtacggtcaacgggttcctaggttaacggttaacgtttttcggaccgttaacgggtttttacttaaccgttagggtttaaacaccggttaaccttaaacgtttagtttaacggtttccgggtccgtacgttaccgtttaccgtttccggggtaacgggtacgggtaacccggtaaaggtcgggacggtcctacgaaacggtaacgtccgggtaggtccgtacggaccgtaccgttacgtcgttaccggtctttacgtacgttccgttaccccgg

SEQ ID NO: 160692 - DNA, 720 bp, Homo sapiens
  misc_feature: GYAE6OF02IM8LC.9.67.G01.1.454.CMB.1.raw
  modified_base (189)..(189): a, c, t, g, unknown or other
  misc_feature (189)..(189): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (553)..(553): a, c, t, g, unknown or other
  misc_feature (553)..(553): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtnttccagganaaacngccactctcaccgtgcgagggccagtcagagtcgttggccacctaacgttagccgttagggtaaccaggacctaagacgtaccgtggtccgttacgggccctaccccggagggtcccctacgacttaccgtacggtcgccgttacccgaggccgtacgggcccctaagtcgggtaacctccccgggaaccgtagggttcaacgggttgggtaacggttcggggttacgacgggggtaaccagggttacggtttcgttccctaccgtaacccggtattcccgaacggtcgaccgtccggttacgacgtagtccgtaggaaagttagtttgaaccgtttagttactttacgngtactacgacgtattaaagtaacttgggttacctccgtacctgtaccgttcgggacgggtaacggacgtaaagggcgtagtacgtaacgtaaacggtacgttaggtggtacctacggtcgtaacccggtactttccgggttccttacggttacgtacccgttccccg

SEQ ID NO: 160693 - DNA, 607 bp, Homo sapiens
  misc_feature: GYAE6OF02FW68B.9.67.G01.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
  modified_base (551)..(551): a, c, t, g, unknown or other
  misc_feature (551)..(551): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcactgcagggccagtcagagtctggcaccattacgcctggtaccagcagacgacctggtcttggcttcccgagggtccctcaatccgtacggtncgtccaggcagggccacgtggtactcccggacaggttcaggtcggtaggtcggggtctacggggactaggtacggtttcgtctcgaaccacgttcaggacacggcctgacctaggttcctaggaaagttgtttcgacttaagtttacttaactggttacagtactattaattaagtcgttcggcctcgttcgtaacgttcgggacgggtaacggaccgtaagggtgacgtacgtaacgaaacgttnacgggtcggcctaggaccaacccgtgttaccgttcttaccttacgaccttaccccg

SEQ ID NO: 160694 - DNA, 562 bp, Homo sapiens
  misc_feature: GYAE6OF02FRVKN.9.67.G01.1.454.CMB.1.raw
  modified_base (199)..(199): a, c, t, g, unknown or other
  misc_feature (199)..(199): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccagganaaacagccactctcacctgcagggccagtcagagtcttggcaccaacttagcctggtaccagcagagacctggcttggctcccagggtccctcatctacggtgcgtccagcgaggccatggactcccggcaggttcaggtggtacgtgggtctagggacaggtacgtttcgttctaccacactcgacgcacgtcctgcacgtctagaagtagttttcgcttagttttattactgttcagctaactataagtagttcgcgtctctacggtttcggacgggtaacgggacgtaagggtgacgtactaacgaaacgtaacgtggtacggtcgtacgacctactacttcgttagtcttcgtattccc

SEQ ID NO: 160695 - DNA, 634 bp, Homo sapiens
  misc_feature: GYAE6OF02F1ECN.9.67.G01.1.454.CMB.1.raw
  modified_base (204)..(204): a, c, t, g, unknown or other
  misc_feature (204)..(204): n is a, c, g, or t
  modified_base (418)..(418): a, c, t, g, unknown or other
  misc_feature (418)..(418): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttacgcctggtaccagcagagacctggcttggctcccgagggtcctcatcgtacggtgccgtccaggcacgggccacgtggtactcccggccaggttcaggtggtaggtggggtctggggactaggtagttcggttctccacctatcagcagcctgcagtcgtagtaagttnttttagacttagttttatttacgttgtactagtactaacttaataagtttagttcgggtccgtcttaccgttaccgtttcggggaccgggtaacgggtaccgtaacgggtcgacggtaccgtaaccgaaaccggtaacgtacggttaccgggtaccgttacggtacccgtaaccgtacgtttccgttcgtttacccgtttcctacgtttcccccgg

SEQ ID NO: 160696 - DNA, 457 bp, Homo sapiens
  misc_feature: GYAE6OF02FSGIQ.9.67.G01.1.454.CMB.1.raw
  modified_base (410)..(411): a, c, t, g, unknown or other
  misc_feature (410)..(411): n is a, c, g, or t
  modified_base (414)..(414): a, c, t, g, unknown or other
  misc_feature (414)..(414): n is a, c, g, or t
  modified_base (417)..(457): a, c, t, g, unknown or other
  misc_feature (417)..(457): n is a, c, g, or t
tcagtgatacgtctcacgaccggtgctcgatttagagtatacatattgggtttgggggaggaactgctcagttaggacccagacggaaccatggaagcccccagcgcagcttctcttcctcctgctactctggctcccagataccactggaataatagtgatgacgcagtctccagcccacctgtctgtgtttccaggagaaacagccactctcactgcaggccagtcagagtcttggcaccaacttacgcctggtaccagcagagacctggcttggcctcccgacgggttcctcatacgtacggactggtggcctgaccacatctgttctctactccttcccgctatcgtagaacgtacgtactcacgtaggacggtcgggcgtggacgacgggccacgtaagtcggannatnatnnnnnnnnnnnnnnnnnnnnnnnnnnnnnnnnnnnnnnnnn

SEQ ID NO: 160697 - DNA, 866 bp, Homo sapiens
  misc_feature: GYAE6OF02FS6O3.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtcgtttccgaggaagaaacgacgcctactctcacctggccagggccagtcagtacgtcttggcacctaacgttacgaccgtaggtaaccctaggccgaagacgacctggccttggcctccgtacggtcctcgtacgtccgtacggtcgccgtaccgaggccgaacgggtcccaaccgttcgggtaacccgtccccggggtacctaacggggttttccaaggggtttcgggttacgggttacgggggttccggttacgggggaaccgtaacgggtaacggttttcccggtttacccgtacccgtaaccccgtaacgtttcccgaaacgggtacccgtaccgggtccccgttacggtacccgtacggtttaccgtagggtaaacgggtttactttttcgggtaacctttaacgggtttttactttaaccggtttaggttacccgttaacgggtacctttaacggttaactttaaacggttacgggtttccgggacccgttccgttaccgttttaccgggtttccggggaaccgggggttaaccgggtaaacccggtaaggggttaccgggtaaccgggtaccgtaaccggtaaaaccggtcggttacggggtacggtccggttacgtaacccggtacctacggttccgttacggtttaccctttccgttaccgtttccccg

SEQ ID NO: 160698 - DNA, 822 bp, Homo sapiens
  misc_feature: GYAE6OF02JRLXO.9.67.G01.1.454.CMB.1.raw
  modified_base (131)..(131): a, c, t, g, unknown or other
  misc_feature (131)..(131): n is a, c, g, or t
  modified_base (452)..(452): a, c, t, g, unknown or other
  misc_feature (452)..(452): n is a, c, g, or t
tcagtgatacgtctcacgaccggtgctcgatttagagtatacatattgggtttgggggagggaacgtggctcagttaggacccagacggaaccatggaagccccagcgcagctctcttctcctgctactcnggctcccagataccactggaactaatagtgtagtgacgcagtctccacgccacctcgtctgtcgtttaccagggagaaaccacgccgtactcctcaaccttcggccgacgggtacccagttccgaacggtacgtcgttcgggcctaaccgtaaccgttacgccgtacggtacccaagtccgaaggtaccggtaccgtaccgggtacgtttccgggcccgtacccggtaacggggttcccttaaccgacgttacccggttaccggttccggtaccgtaccggtacggaccgtaacggggtccctaaccggttcgggtaaccnccccgggtacgtacggtttcgaaggttcgggtaggttccggggtacgtcggggtacgtacggttacggtttccgttaccgaccctacgtaacttccgacggtcccgtacgtaccgtacggtacctaggtaccgtacggtaagttcgttttacgagtttaacgtttacgtttacgtcggtacctggtacctaacgtttagaaccgttttaggaccggtaccgttacccgttagttcccggttaacggggtccggtaacgggaccgtaagggggtacgacgtacccgttaaccgaacgggtcttgggaaccggcgttaaccggcccgtaccgtaggtttacccgtcggtttaccttacgttacctaccccgg

SEQ ID NO: 160699 - DNA, 622 bp, Homo sapiens
  misc_feature: GYAE6OF02HPBKA.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagtacgtcttggcaccaacttagcctggtaccagcagagacctggcttcggctcccgagggtccctcactcgtacggtcgcgtccagcgaacgggccacgtggtactccccggccgaagggttcagttggtaggtcggggtcgtggggactaggtagtttccgttctccgaccattccgagccaacgcccttgaccagttctaggaagtatttttgctagttttactacgttgtacagtcaacttaataagttacgttcggacccgtcttactaccgtttacgggccgggtaacgggaaccgaagggttggacgtccgtaacgaaacggttaacgtacggtcggtactcggcctaaccgtacgttccttaggtccctttcgacctttaccccg

SEQ ID NO: 160700 - DNA, 732 bp, Homo sapiens
  misc_feature: GYAE6OF02JOIWC.9.67.G01.1.454.CMB.1.raw
  modified_base (204)..(204): a, c, t, g, unknown or other
  misc_feature (204)..(204): n is a, c, g, or t
  modified_base (375)..(375): a, c, t, g, unknown or other
  misc_feature (375)..(375): n is a, c, g, or t
  modified_base (444)..(444): a, c, t, g, unknown or other
  misc_feature (444)..(444): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtacctgttgtttccagggtanaaacctagcccactctccaccttgccgaggggtcccaagtccaagtagtccttgggcctaaccgaactttacgccgtggttaccagcaaggacgtaccgtggcttaggcctaccgacgggtcctcgacgtcgacggttgccgtccagtccgagggtccctaagtggtaccncccggaccgtaggttcaaggttcggtagtcggggttactggggaacctgtacggtttctacgctaaccngtacgagccacgtctcggtacacgtcgtagtaggttactttagtaccggtttatttaaccgttcgttaacgttcgaaacgtctaaccgttaaatacgttacggttaggtaccccgttattacccggttacgggtttccgggaaccgggtaccgggtaaacccgtaagggggttaccgttaagtacccgttaaaccggtaacggtaacccggttgggttaccgccgttaacggtacccgaaccgtttacgttccgttacggttacccggttactcccggtttaacccgg

SEQ ID NO: 160701 - DNA, 771 bp, Homo sapiens
  misc_feature: GYAE6OF02GGW8I.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggcctccagataccactggaataactagtgatgacgcagtctccagccaccctgtctgtcgttccaggagaaacagccactctcacctgcagggcccagtccagtacgtcgttggccaaccaacttagcctggtaccagcagacgacctggtccttagggcctcccgacgggtccctacattccgtacggtgtcggtcccagtaccgacgggtccctacgtcggtaaccgtcccccggaccgtaggttaccgagggttcggttaaggttcggggtctaggggactaggtacggtttccgttactccgaaccgtatacgtacgcctacgggtcccttacggcctacggttccgtaggtaaacggttctttttacgggaccttaagttttacgttaaccgttaggttaccaacgggtacctaacgttaagttaacgtttagggttaccggaccgttaccgtttacccgtaacggttttccggggaaccggggtaaacggggttaacccggtaagggttacggggtacctacgttaacccggtaaaaccggttaccggttagggtaccggtacccggttaccggaaccgtaacccggtttcgttacggttaccgtttacccgtttaacgtcccgtttacccccg

SEQ ID NO: 160702 - DNA, 780 bp, Homo sapiens
  misc_feature: GYAE6OF02H7C3M.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgcctactctggctccagataccactggaataactagtgatgacgcacgtctccagccaccctgtctgtgttccgaggacgaaacagccactctcacctgacgagggccagtcgaggtacgttcgttgggaccctaacgtaaccgtttacgcccgttcggtaacccgtagtacaggaacgtaccgtcggtcgttacggaccgtacccggtacgggttccctacgtacgttccgtaccgggtcggtccgtaccgacggccgacgggaccctacggttcgggtaaccgtccccggtacgtaacgggttacgtacgggttagggttacgggttcggggttacggtacggggacgtacggttacggttaccgttcggtaacctaccgtacgccgtacgtaccgtacggtccgtacggtacgtagttcgtaacggttaaagtttacgttttacgtacgttttaagttttacgttacgttcggttaactaacggtctaaacgtttaacgtaagttcggttcggaccgtccttacgttacccggttacgggcgggtaacggtaacggtaaggtcggtacgtaccgtaacgtaaccgtacgggttcgtacggtcgtacggacctacggtacgttcggtttaccgttacgttaccgttaccgttcccg

SEQ ID NO: 160703 - DNA, 758 bp, Homo sapiens
  misc_feature: GYAE6OF02GHJMN.9.67.G01.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagccacctgtctgtcgttcagganaaacngccactctcactgcgagggccagtacagtacgttcgttggacctaacccgtaacttacggtccgttagggtacccaaggtccaacggtaacgtacccgttgggtccgtttacggggacccttacccggtacgggttccctactacgttaccgttacgggtcgtaccgtaccgaagtccgaacgggtaccctacgggtcggttacccgtcccgggacgtacggttccgaggtcggttaggtccggggtcgtaggggacctaggttacggtttcttaccgtaccaaccgttacttacgaaccggtcgacggtacccgttggaccgtacggttacgtaggttaacgttacgttttacgacgttaacgttttataacgttcggtactacgtattaacgttatttaacggttggtccgacccgttaccgttcttaccgggttacggggacgtaaacgggacgttagggttaggaccgtacttaacggaaccggttaacggtcggtacggtacctaggaccaccggttaacttccggttatttaccgttctaccgttccccgg

SEQ ID NO: 160704 - DNA, 813 bp, Homo sapiens
  misc_feature: GYAE6OF02ID8ZJ.9.67.G01.1.454.CMB.1.raw
  modified_base (205)..(205): a, c, t, g, unknown or other
  misc_feature (205)..(205): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtcgtttccaggagaaacngccactctcacctgcagggccagtcagagtcttggccaaccaacttgcctggtaccagcagacgacctaggcttcggcctccgacgggtcctcactcgttacgggtcgtccgtccgaggaccgagggccctaacggttcggtaccgtccccgggtaccgtacgggtttcgaacgggttcgggttacgggttcgggggttacggtacggggtacctaagggttacggtttccggtttaccgtacctaacccgtattaccgacggaccgtacggtccgttacggtccgtacgttacggtaacggttaaaggtttagttttacggtaactttaaggttttttaacttaacgtttacgttaaccttaacgttaaccgttaccgggtaaccggtacgggttccgggtaacccggggttcccggggggttacccttacccgggttttacccgggtaccccggttaaccgggtaaaaccgttaaaaccggtttcggaaaccgttaaccgtaacccgtaaaacggtaaccgttaagggtaccggaccgttaacggtaccctaaccgttactttaccgttccgttaccgtttaccgttaccgtttccccgtaccccg

SEQ ID NO: 160705 - DNA, 892 bp, Homo sapiens
  misc_feature: GYAE6OF02FRCC0.9.67.G01.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaacctaacttgcctggtaccagcagacgacctggcgttggctcccgagggtccctcacttcgtacggtcgccgtccgaggcgaacggggcccaacgttcggtaccgttccccgggaccgtacgggtttccgaaggggttcgggttaagggttcgggggtttacgtacggggggtaacgtacgggttaacggtttttcccgggtttacctacccgtaacccgtacgttaccgaaccgggtaccgaacggtccccgtttacgggacccgtacggttaccgttaaggggtaaaacgttacgtttttttacggaaccgttttaaggtttttaacgttttaaccgtttaccgggttaaccttaacgggttacctttaaaccgtttaaacgttttaaaacggtttaacgggtttaccggggtaccccggttaccgtttaacccgggtttaaccggttttttacccggggggaacccggggttaaacggggtaaacccggttaacgggggttacgggtaacccggtaccgggttaaacccggtaaaaacccggggtaaccgtttacggggttaccgggtacccggttacggtaccccgttaaccgttacggtttacccgttaccggtttacccttttaccgtacccgttttaccccccg

SEQ ID NO: 160706 - DNA, 617 bp, Homo sapiens
  misc_feature: GYAE6OF02FQ7MQ.9.67.G01.1.454.CMB.1.raw
  modified_base (202)..(202): a, c, t, g, unknown or other
  misc_feature (202)..(202): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (434)..(434): a, c, t, g, unknown or other
  misc_feature (434)..(434): n is a, c, g, or t
tcagtgatacgtctcacgaccggtgctcgatttagagtatacatattgggtttggggaggaactgctcagttaggacccagacggaaccatggaagccccagcgcagcttctcttcctcctgctactctggctccagataccactggaataatagtgatgacgcagtctccagccaccctgtctgtgtttccaggagaaacngccactctcacctgcgaggccagtcagagtcttggcaccaacttagcctggtaccagcacgagacctggctggcctcccgagggtcctcatcgtacggtgcgtcagcgaggcacgtggtactcccggcgtaggttacaggtggtacggtgggtcgtgggactaggtacggttctcgtcaccatacgagcgtagcctgcngtntagacgttatttcgatacgtttattacgtntacgacgtataacttaacgtaagtacggttacggtccgtcttacgtaaccgtttacggggacgggtaaccgggtaacgtaaggggtacgggaagtaccgtaacgtaaacggtaccgtagggttacggccgtttagacccgtacctacgttccgttacgtttccgttacgttacgttacccccg

SEQ ID NO: 160707 - DNA, 745 bp, Homo sapiens
  misc_feature: GYAE6OF02GPQ2T.9.67.G01.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
tcagtgatacgtctcacgaccggtgctcgatttagagtatacatattggggtttgggggaggaactgctcagttaggacccagacggaaccatggaagccccagcgcagcttctcttcctcctgctactctggctcccagataccactggaataatagtgatgacgcagtctccagcccacctgtctgttcgttccagganaaacncgcctactctcacctgacgacgggcctagtcagtagtcgttcggccaacctaacgttcgccgtacggtaccagacaaggacgtaccgtggcttcggccctcccggagggtccctcgtagtccgtacggtcgccgtaccgacgccgacgggcctaacggttcggtaccgtccccgggtaccgtacggtttacgagggttcgggttaacgggtcggggttcgtacggggtacgtaggttacggttttccgttacctaccgtacctagtcccgaagtaccgacgtcccgtcgacgtagttacgtaggtaaacgtttgtttacggtactttaaggttttactacgttgtacacgtacttaacgtaagttaggttaccgtcgggtaccgtacttacccggttacggttaccggggaaccggggtaacggaacggtaacggggtcgtaacggtacccgtaaacgtaacggtcgggttggtacggtccgttaccggaccttacgtacggttaccggttcgttaccttacccgttacggttcccccg

SEQ ID NO: 160708 - DNA, 730 bp, Homo sapiens
  misc_feature: GYAE6OF02J2R3E.9.67.G01.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggcctcccagataccactggaatatagtgatgacgcagtctccagccacctggtctgtgttccagganaacagccatccncacctgccagggccagtcaggactctggccacacgttcgcctcgtaccagcagacgacgtggccttggccgtccctacgggtcctcgtactcgtacggtcgtcgtccgagaccgacgggtccacgtggtaccgtccggaccgtagggttcgacggttacggtacggtcggggttaccgtaggggaacgtacggtacggtttccgttccgtacgtacccgtagtacgtacgtacgacgtccgtacgggctacggtacttacggtaagttaacgttttcgtagttacggttttacgtacgttaccggttacacggttacctacgttaaacgtttaacgttacgggttacgtacccgttccgttaaccgtttacccggtttaccggggggtaccggtaacccggggtttaaaccggtaaaccggggtgggttaacccgtaccgttaacggaaaccggttaccgtggttacggcttaccggtaccacgtacgttcgttacgttccttacgtacccgtttcccgg

SEQ ID NO: 160709 - DNA, 799 bp, Homo sapiens
  misc_feature: GYAE6OF02H93S9.9.67.G01.1.454.CMB.1.raw
  modified_base (368)..(368): a, c, t, g, unknown or other
  misc_feature (368)..(368): n is a, c, g, or t
tcagtgatacgtctcacgaccggtgctcgatttagagtatacatattgggtttgggggaggaactgctcagttaggacccagacggaacatggaagccccagcgcagcttctcttcctcctgctactctggcctcccagactacccacgtggaaataagtagtgatagacgcacgtcctccacgcccacccttgtcttagttcgttaccgaaggaacaaacgtcgaccctactccttccgaaccctgccgtaacgggcccaagtcgaagtacgtccgtaggaccctaacctaaccgtacgtccgtacgtaaccgagacgtagacggtaccgtggccgtttcggacccttaccgtacggttccccttanaccggtttaccggaacggttcggacccgtcgacgtccggaaccgggtcccgtaaccggtacggttacccggtccccggtacggtacggttaccggtaggttacggtggggttcgtacgggtggtaccggtacgttcgttaccgtctaaccacgtgtacgacgccgtacgtcgtacgtctacgtttagtacgttaagttagttacgttagttacgttttaacgttaccgtacgttaacacggttaaccttaagttacgtaagtttcggttccggtaccttcccgttacgttacgggttccccgggaaacgggttacggggaaccgttaaggggtcgtaccggttaccgaaacggtaaccggtcgtccgggtaacgccgtacgtacccgtacgttccgtaccgttccgttacctttacccggcctttaccccg

SEQ ID NO: 160710 - DNA, 775 bp, Homo sapiens
  misc_feature: GYAE6OF02JMGGE.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtcgtttccaggagaaacagccactctcacctgcgacgggccagtccaggtacgtcttcgggccaaccgtaacttacgacccgtaggtaacccaggaccaacggtacgtaaccgttcggtaccgttcgggcccgttaccccggaggggttccctacgtacttccggttacgggtcgtacccggtccgaggcccgtaacggggccctaacgttcggtaccgtccccgggcgttacggttccgtaggtcggttaggtcgggtcgtacggggacgtaggttacggtttccggttactacccgtaacctacgttaccggacgtaccggtaccgtccgtacgtaccgtacggtacgtacggtaaacgttcgtttttcgggaacctttaaggtttacttaccgttcgtacgtacgttacgtacttaaggtaacgttacgttccggtaccgtccgttacgttaccggtttacgggggaaccgtacgggtaccgtaaaggggtcgtaacgtccgtaaccgtaaacggttacgtggttacggcgttaccgtaccgtaaccgtcgttacggttcctttccgttacgtaccttaccccgg

SEQ ID NO: 160711 - DNA, 766 bp, Homo sapiens
  misc_feature: GYAE6OF02FKWSX.9.67.G01.1.454.CMB.1.raw
  modified_base (205)..(205): a, c, t, g, unknown or other
  misc_feature (205)..(205): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagcccaccctgtctgtgtttccaggagaaacngccactctcacctgcgacgggccagtacagagtcgttggccaacctaacttgccttggaccagcagacgacctggcttggctcccgagggtcctcgtatccgtaacggtcgccgtaccaggcgagggccctacgtacggtaccgtccccgggaccgtacggttcgaaggttcgggttaacgggttcggggtccggttcggggtaacgagggttaacggttttcccggttacgtaccgtaaaccgtagttacgaccgggtacctaccgtccgtacgtaccggtacggttcgtaaggtaaggttaacgtttttacggtacttaaggttttaacgtttaccgtttacggtacgtacgtacctaacgttaaacttaaggtttacgggttcggtacccgtcgttaccgttaacgggtttccggggaaccggggttaaacgggaccggttaaaggggtaccgggtaaccggtaccgtaaaccggtaaaccggtaaccggtgggttacggtaccggtacggtaccaaccgttacggttacgttcgttacggttcctacgttttccccg

SEQ ID NO: 160712 - DNA, 673 bp, Homo sapiens
  misc_feature: GYAE6OF02I4DMV.9.67.G01.1.454.CMB.1.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccacctgtctgtgtttccaggagaaacagccactctcacctgcagggccagtcagagtcttggcaccaacttagcctggtaccagcagagacctggcttggcctcccgagggtccctcactcgtacggtcgccgtccaggcgacgggcccacgtacggtacctcccgggcctagggttcaggtgggttaggtcggggtcgtaggggaacgtaggtacgtttccgttcctctacctattccgacgcgacgcctacgctacggttactaggtaagttagttttcggtacttaggttttaacttacgttcgtacgtagtacctaacttaattaacggttaggtttccggaccgtacctttccgtaacgttttaccggggacgggtaacgggtaaccgtaaaggggtcggtaacgtaccgtaacggtaaaccggaacgttacggtacgggtacgttcgaaccgacgttacgttccgttcgtttacttaccgtactttccccg

SEQ ID NO: 160713 - DNA, 763 bp, Homo sapiens
  misc_feature: GYAE6OF02IOCW7.9.67.G01.1.454.CMB.1.raw
  modified_base (721)..(721): a, c, t, g, unknown or other
  misc_feature (721)..(721): n is a, c, g, or t
  modified_base (727)..(727): a, c, t, g, unknown or other
  misc_feature (727)..(727): n is a, c, g, or t
  modified_base (736)..(736): a, c, t, g, unknown or other
  misc_feature (736)..(736): n is a, c, g, or t
  modified_base (738)..(738): a, c, t, g, unknown or other
  misc_feature (738)..(738): n is a, c, g, or t
  modified_base (742)..(742): a, c, t, g, unknown or other
  misc_feature (742)..(742): n is a, c, g, or t
  modified_base (750)..(750): a, c, t, g, unknown or other
  misc_feature (750)..(750): n is a, c, g, or t
  modified_base (754)..(754): a, c, t, g, unknown or other
  misc_feature (754)..(754): n is a, c, g, or t
  modified_base (758)..(758): a, c, t, g, unknown or other
  misc_feature (758)..(758): n is a, c, g, or t
  modified_base (761)..(761): a, c, t, g, unknown or other
  misc_feature (761)..(761): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagccacctgtctgtgtttccaggagaacagccactctcacctgcgagggccagtcagacgttcgttggaccaaccctaaacgtttacgcccgttacggttaacccgaacggtacctaacgggaccggaacccgttggggtaccgtttcggggccttaccccggacggggttaccccttaccgaacgttacccgttaacggggtacggtcccggttacccgaaggtccggaacggggacccctaaccggttcgggtaaccgttccccgggtacccgtaacggggttccgagggtttacgggttacggtacggggttccgtacggggggaacttacgggtaggttttccgttacctaccgtaaccgtacttaccgaacggtacgtacgtaccgtacggtaccgacggttaccgttacgtaaacgttaacgttttacgtacgttaacggtttttaacgtttaaccgttacgttaccgtacgtaccgtaacgttaacgttaacgtttaggttacggtacccggtaccgttaccgttaaccgtttaccggggancagtangactagacngngacnagcgagancganacancancg

SEQ ID NO: 160714 - DNA, 626 bp, Homo sapiens
  misc_feature: GYAE6OF02HBT3Q.9.67.G01.1.454.CMB.1.raw
  modified_base (203)..(203): a, c, t, g, unknown or other
  misc_feature (203)..(203): n is a, c, g, or t
  modified_base (465)..(465): a, c, t, g, unknown or other
  misc_feature (465)..(465): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagccacctgtctgtcgtttccaggagaaacngccactctcactgcagggccagtcagagtcgttggcaacctacttcgcctaggtaccgagcaagacgtaccgtcggtcttggcctccgagggtcctcgacgtcgtacggtcgtcgtccgagcgacggcctacgtggtacgtcccggactacggttcgacggtggtacggtcgggtcgtacgggacgtggtacgtttcgttctaccgactagtcgagcgtacgcctagaccgtaggtctagtaagttcgtttgcgttaatttntacgtgtacgagtacttaactagtacgttggttccggccttcgtaccgttacggttcggaggtaacggtacgagggtcggacaccgttaacgaacggtcgttcggacgtaccgtacgactaccgtagttccggttacgtactttccgacgtttacccccgg

SEQ ID NO: 160715 - DNA, 655 bp, Homo sapiens
  misc_feature: GYAE6OF02F2RJ8.9.67.G01.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggcctcccagataccactggaataatagtgatgacgcagtctccagccacctgtctgtgtttccagganaaacngccactctcacctgacagggccagcagagtcgttaggcaacctaacgttacgccttcggtaccagcagacgaccgtaggtcttcggcctcccggaacgggttcctacagtccgtacggtcgtccgtccacggcgacgggccagtcggtacgtcccggcgtaggtcaggtggttaggtgggtgtcggataggtacgtttcgtctccacatcgagcgacgccgtgcgtgtctaggtaaagttgttttacgcgttaagttttactaacgttcgtactgtacctaactaattaagtacggttaggcccgttacgtttaccgtacggtttccgggaaccgggtacgggaaccggttaagggtacgggacgtacgtaaccgtaaacggtcgtacgggtacggtacgttacgaccctacgtaccgttacgttaccgtttccttcgtaccgtttccccg

SEQ ID NO: 160716 - DNA, 642 bp, Homo sapiens
  misc_feature: GYAE6OF02IWA5M.9.67.G01.1.454.CMB.1.raw
  modified_base (497)..(497): a, c, t, g, unknown or other
  misc_feature (497)..(497): n is a, c, g, or t
tcagtgatacgtctcacgaccggtgctcgatttagagtatacatattggggtttgggggaggaactgctcagttaggacccagacggaaccatggaagccccagcgcagcttctcttcctcctgctactctggcctcccagatacccactggaataatagtgaatgacgcagtctccagccaccctgtctggtgtttccaggagaaacgcgccactctacaccgtgcgtacggggccaggtcaggtacgtcgttggaccacctaacgttacgcctaggtaccaaggtccagacgacccgtggccttcggaccgtcccgtagggtccctcgtatccgtacggtgaccgttcaagtcgacggccacgtcggtacctccgggactaggtcgaggtcggtagtgggtcgagggactagttacgtttcggtactacgacctatcgagcacgtccgtgactggtacgtagagttgtttcgacttgtttactacgttatcgtanactaatatacgttgtacgtcgcgttctacggtcggacggtagggaccgttagggacgtacgacgtaaccgaacgggttacgtcggtacggtcgtacgtaccgtacgtaccgttcgttaccgtttccgttactccgtttacccccg

SEQ ID NO: 160717 - DNA, 768 bp, Homo sapiens
  misc_feature: GYAE6OF02G8QDL.9.67.G01.1.454.CMB.1.raw
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctcagccacctgtctgtgttcaganaacngccactctcacctgcagggccagtcagngtctggcacctaattgcctgtaccagcagacgtaccgtggtcgttcggcctcccgaggttcctcgtagtccgtacggtcgcgtccgagcgacgggctacggtcggtaccgtcccggaccgtacgggttcgtacggttgggttacgtcgggggttcgtagggaacgtaggttacggtttcgttaccgtaccaacccgtacgtacgaacgtccgtacggtcccgtagaccgttacggttacgttaaggtaagtttacgttttacgtacgttttaagttttaacgttaccgttaggtaccgttaacggtacctttaaacgttaaacgtttaagtttacgggttcccgggtacccgttaccgtttaccgtttaacccgggtttacggggtaaccggggtaaacgggtaaacccgggtaaggggtaccggtaacggtacccgttaaacggtaaacccggtacgggttaccggttacggaccgttaccggaaccgttaccgttacgttttccgttacgtttccgtttacccgttaccgttaacccccg

SEQ ID NO: 160718 - DNA, 783 bp, Homo sapiens
  misc_feature: GYAE6OF02H5UPO.9.67.G01.1.454.CMB.1.raw
  modified_base (140)..(140): a, c, t, g, unknown or other
  misc_feature (140)..(140): n is a, c, g, or t
  modified_base (221)..(221): a, c, t, g, unknown or other
  misc_feature (221)..(221): n is a, c, g, or t
  modified_base (376)..(376): a, c, t, g, unknown or other
  misc_feature (376)..(376): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggcctccganataccacgtaggaataatagtgaatgacgctagtctccagcctaccgtgtcgttgttacgtttaccgaacggaagaaaccnggaccctaacttccaccgtaaccgtcggagaccgggtaccgaagttacgaaacggtcgtttccgtacggacctaaacctaacgtacgtcgtacggacaagcgagacgcgtcggtcgttcgctaccgtacgtcctacgatcggttacgcctacgtncggaccgagcctacggtacgttacccgccgacgttaacggttgtacggttaaggtcggttagggtccgaagggttaacctacggttcggtttacgttacccgaactaccgtagtacgacggtaacctcggtacgtgtaccgtagttaccgtaaggttacgttacgtttacggtacgtttaagtttacttacggtaacgttacgtactagtaaccgttatacggttacgttcgtaaccgtcgtacgtttaacggtaccgggtacgggtaaacggacggttaacgggtacgtacggtaacccgaacggttaaaacggtcccggtggttaaccggtaccgtttaccgaaccgtttaccggttacggttaccttaaccggtttaccgtttacccttaccgtttaccccggg

SEQ ID NO: 160719 - DNA, 774 bp, Homo sapiens
  misc_feature: GYAE6OF02IWS8M.9.67.G01.1.454.CMB.1.raw
  modified_base (204)..(204): a, c, t, g, unknown or other
  misc_feature (204)..(204): n is a, c, g, or t
  modified_base (745)..(745): a, c, t, g, unknown or other
  misc_feature (745)..(745): n is a, c, g, or t
tcagtgatacgtctcacgaccggtgctcgatttagagtatacatattggggtttggggggaggaactgctcagttaggacccagacggaaccatggaagccccagcgcagcttctcttcctcctgctactctggcctccagactaccactaggaataatagtgatcggacgcagtctcagccacctgtctgtcgttcgaggaanaacacgccactctacacctgcgacgggcagtcagacgttccttggaccaccgaacttcgaccgtaggtaccagccaaggacgtacctggtcgttacggtcctaccggtacggtcctactacgttacggttcggtcgtccggtccgaaggccgtacgggaccctacggttccggtaccgtaccccggtacggtaacgggtttcaacgggttgggttacgggttcgggggtacggtcggggaaaacctagggttacggtttccgttaccgctaaccgtaagtcggtactcgtaccgtccgttacgacgttacggtcggttacgtaagtttacttttcggtacgttaagtttttacgttaacgttcgtagtaaaccgtacttaagttaaagtaacggttacggttcgggtaccttccgttaaccgttaccggtttacggggaccggggaacgggttaaacggtaaccggggttgaaccgttaccgtaacggtaaaccgggttacggttccggttacggaccggttacaaccgttacctacgttnttaccggtcttttaccgacctttacccgg

SEQ ID NO: 160720 - DNA, 693 bp, Homo sapiens
  misc_feature: GYAE6OF02G0XY5.9.67.G01.1.454.CMB.1.raw
  modified_base (217)..(217): a, c, t, g, unknown or other
  misc_feature (217)..(217): n is a, c, g, or t
  modified_base (256)..(256): a, c, t, g, unknown or other
  misc_feature (256)..(256): n is a, c, g, or t
  modified_base (459)..(459): a, c, t, g, unknown or other
  misc_feature (459)..(459): n is a, c, g, or t
  modified_base (493)..(493): a, c, t, g, unknown or other
  misc_feature (493)..(493): n is a, c, g, or t
tcagtgatacgtctcacgaccggtgctcgatttagagtatacatattgggtttgggggaggaactgctcagttaggacccagacggaaccatggaacgccccagcgcagcttctcttcctcctgctctctggcctccagtactaccactggaataatgtgatgacgcgtagtcctccgacgcccaccgttgtcgtgtcgttccgaggaacaaaccgngccctactccgtccaccgtgcgacggtacacgtgacgtntcgtgccgaccttagtacgccgttcggaaccagcgaacgtcgccgtggttcgtgtcccgtcccgtaggtacctcgtacgttccgtcggtcgtccggttaccaacggccgtaacgggcctaacggtcggtaaccgtccgccggtagtaccggtgtcggttcgtcggggtacgttaggggacgtacgttacgttttccccgtaanacctaccgtgacgcgccgtacgctcgtacgtcgngtacgtagttacgtttcgtacgtttagttagttcgttacgtacgacgtactaagttagtacgttacggcgtaccgtccgtacgtaccggtacgggtaacgtacggtacggtaacgtacggacttaccgtaacgtacgtacgtcggtaccgagtaccgtacgttccgtacggttaccgttcgtaccgttactccgttaccg

SEQ ID NO: 160721 - DNA, 816 bp, Homo sapiens
  misc_feature: GYAE6OF02HTULV.9.67.G01.1.454.CMB.1.raw
  modified_base (202)..(202): a, c, t, g, unknown or other
  misc_feature (202)..(202): n is a, c, g, or t
tcagtgatacgtctcacgaccggtgctcgatttagagtatacatattgggtttgggggaggaactgctcagttaggacccagacggaaccatggaacgccccagcgcagcttctcttcctcctgctactctggctccagataccactaggaataatagtgatgacgcagtctccacgccaccctgtctgttgtttccagganaaacacgccactcctacacctgcgacgggccagtcagacgtcttcggaccacctaactacgaccttcggtaaccagcaaggacgtaccgtcgggtacgttcggccgttccccggtacggggttcccttaccgtacgtaccggttaccgggtcggtaccgttacccgacggtaccggaacggggaccctaccggttcggtacccggtaccccgggtaccggttacgggtttaccgaacggggtttgggttagggttcgggggtacggtacggggtacggtagggtttacggttccgttaccgttacctaacctctaccgtacgcgtacgtccgtcgaccgtacgttcgtaggtaactttgtttacgtacgtttagttttaacttccgttacgttacgaacgtaccttaaacgttaaagtaacggtttaggttacccggtaccgttacccgtttaccgttacccgggttttacgggggaccggggttaaacggggaccggttaaacgggggtcgaacgggttaccctaaacggtaacggttaacgtgggttccggtacgtaccgaccgtaccttacggttccgtttacgttaccctttaccggtccttacccccgg

SEQ ID NO: 160722 - DNA, 820 bp, Homo sapiens
  misc_feature: GYAE6OF02GLJ2L.9.67.G01.1.454.CMB.1.raw
  modified_base (376)..(376): a, c, t, g, unknown or other
  misc_feature (376)..(376): n is a, c, g, or t
  modified_base (809)..(809): a, c, t, g, unknown or other
  misc_feature (809)..(809): n is a, c, g, or t
tcagtgatacgtctcacgaccggtgctcgatttagagtatacatattgggtttgggggaggaactgctcagttaggcccagacggaaccatggaaggccccagcgcagcttctcgtcctcctgctactctggctcccagataccactaggaataatacgtgatgacgcagtctccagcccacccgtgtcgtgttcgtttccgacggaacgaacacgtccaactctccgacctgccgagggccctagtccgaggtacgtccgttcggaccgtaacctaacggtttacgccgttaggtacccgaacgccgaagccggtaccgttcgggtacgttcggcctacccgacgggttacctcgtacgtaccgttacgggtacnccggttaccaacggccgtacggggtacctacggtaccggttaccggttacccccggtacccggttaacggtttccggtaaccggggtttacgggtttaacggggttaccggggtttaccggttacggggggaaccgtaacgggtttaccgttttccggttaccttaccgaaccccgtagttaccgacgggttaccctaccgggtcctacccgggtagtaccggttacgttaacggtaaccgtttggtttaccgttagttaacggtttaactttcggtacgttccgagtacctaacgttagtaacggttacggtcgaccgttccgttactaacccggttggggccgaaacgggtcgtaagggttcgacgtaccgtacgaacggtcgtcgtggtaccgtagtccctaacgtcgtacgttaccgttcttacccgtntttacccccgg

SEQ ID NO: 160723 - DNA, 951 bp, Homo sapiens
  misc_feature: GYAE6OF02GD56V.9.67.G01.1.454.CMB.1.raw
  modified_base (185)..(185): a, c, t, g, unknown or other
  misc_feature (185)..(185): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccgagcccaccctntcttgtgtttccaggaacgaaacagccctaactctcacctcgacgacgggtaccagtcaaggtacgttcgttcgggacctaaccgtaaaccgtttacggtacccgttacgggtaaccccaggacccgtaaggaaccggtaacccggtttcgggtccgtttcgggccccgttaccccggacggggttcccctacttaacgtaccgttaccgggtggacccgttaccgacggtaccggtaaccgggcctaccggttacggtacccgtcccccgggtcgtaaccgggtttacgagggttagggttacgggttcggggtacgtcggggtaacgtaaggttacggttttccgttaccgtacctaacccgtactacccggagtacccgtacggtaccgtacgtaccgtcggttaccgttaaggttaacggttttacgttttacggtaaccggttttaagttttaaccggtttaacgtttcggttaaccggttacggtaaaccctttaaacgtttaacggtttaaaggttttacgggtttcccggtacccggttacccgtttttaccgggttaaaccgggttttcccgggggtaaacgggggttaaaccgggggtaaaccggtaaacggggggtttccggggtaaccgtacccgtttaaccggaaaacccggtttcggtaacgggttacgggtcccggttaaccacccggtttaaccttaccgggtttaccgttaccgtttccgttttaacccggcccggtttttaacccccg

SEQ ID NO: 160724 - DNA, 762 bp, Homo sapiens
  misc_feature: GYAE6OF02INOKI.9.67.G01.1.454.CMB.1.raw
  modified_base (510)..(510): a, c, t, g, unknown or other
  misc_feature (510)..(510): n is a, c, g, or t
  modified_base (543)..(543): a, c, t, g, unknown or other
  misc_feature (543)..(543): n is a, c, g, or t
  modified_base (549)..(549): a, c, t, g, unknown or other
  misc_feature (549)..(549): n is a, c, g, or t
tcagtgatacgtctcacgaccggtgctcgatttagagtatacatagttggggtttgggggaggaactgctcagttaggacccagacggaaccatggaagccccagcgcagcttctcttcctctgctactctggcctcccgagtactaccactaggaattaacagtgagtgccgtacagtcctaccacgtcccacccgttgtacttcggttacgttacccgaaagggtaacgaaaacgccgacctacctccgtacctaccgtgacggtacgggaccctaagtccgaaggtcggttccgttaagggacccttaaacggtaaccttacggaccgttaaccggtaccgaacgtaccgaaccggagtaccggtggtaccgttcggtccccgtccgtcggtacctcgtacgtaccgtacggtcgtcctacgcgacgcgaccgcgtcgtaccgccgtacgtacgtcgtaggtggtaggtcggtcggaggtaccgttaaggtccgtttacggttaccnccttaccgtaacgttcgacgtacgtccgtccgnggtacncgtacgtacgtgttacgttacgtacgttattacgttacgtctaccgttacgtacgttacgttaagtacgttacgggtacctcgttacccgttacggtaccgggttaacggccgggaaacggtacggtaacggccgttaacgaccgtaacgtaacggtcgtcggacgtacgacctacgtacgtcgttaccttccggtcttaccgtcgttacccg

SEQ ID NO: 160725 - DNA, 782 bp, Homo sapiens
  misc_feature: GYAE6OF02GTCB8.9.67.G01.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagtgatacgtctcacgaccggtgctcgatttagagtatacatattgggtttgggggaggaactgctcagttaggacccagacggaaccatggaagccccagcgcagcttctcttcctcctgctactctggctccagactaccactggaataatagtgatgacgcagtctccagcccacctgtctgtcgttccagganaaacncgccactcctacacctgcgacgggcctagtacagtacgttcgttacggacctaaccgtaacgttacgtcccgtacggtaaccagacgacggaccgtaccgtagggtccgttacggtcccgttacccggacggttcccctagtaccttacggtacccggtcgtacccgtaccgacggtaccgacgggtccctaacgttcgggtacccgtccccgggacgtacggttcgtaacgggttacgggtacgggttcggggtacggttacgggacgttacggtcgtttccgttacctacgtacctacgtacgacgacgtacgtcgtacgacgtcgtacgtaaggttacttagtttacgtacgtttacgtttacgttacgttacggtacgtacgttactaaattaacgttaggtacgttaccggtccgttaccggtttaccgttaccgggttaccgggtaacgggtaacgggtaacggtagggtaacggtaccgtaacggttaccgaaacggtggtaaccggttccgtaccgtcgtaaccgacgttaccggttaccttacgtttcccgttacctaccgttaccccg

SEQ ID NO: 160726 - DNA, 670 bp, Homo sapiens
  misc_feature: GYAE6OF02IGCVA.9.67.G01.1.454.CMB.1.raw
  modified_base (160)..(160): a, c, t, g, unknown or other
  misc_feature (160)..(160): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (287)..(287): a, c, t, g, unknown or other
  misc_feature (287)..(287): n is a, c, g, or t
  modified_base (396)..(396): a, c, t, g, unknown or other
  misc_feature (396)..(396): n is a, c, g, or t
tcagtgatacgtctcacgaccggtgctcgatttagagtatacatattggggtttgggggaggaactgctcagttaggacccagacggaacatggaagccccagcgcagcttctcttcctcctgctactctggctcccagactaccactggaataatagtnatgacgcagtctccagccacctgtctgtgttccagganaaacngccactcctcactgcgaggcagtcagagtctggcactaacttacgctcgtacagcagacgactgcgtggcctccgaggtcctanactacgtacggtcgtccggtccagcgcgggccacgtcggtccgtcccggacgtaggttcgaggttggttacgggtggtcggtggactacggtcgtttcgttccacactntacgacgctacgtccgagtacgtacgtacgtaaggttaagttagttttcgaagtttagtttttactacgttacgtcgtaacgtaccttaacttaattaacggttcggttccggtccggttaccttaccggtttacgggttaccgggacggggtaacgggaacggtaacgggtaggtacctaggtaaacccgtaacggtacggtcggttacggggtcctaacggtaccctacctaccgggtttagttccggtttacttacccgttacttcccccg

SEQ ID NO: 160727 - DNA, 679 bp, Homo sapiens
  misc_feature: GYAE6OF02F0GK5.9.67.G01.1.454.CMB.1.raw
  modified_base (209)..(209): a, c, t, g, unknown or other
  misc_feature (209)..(209): n is a, c, g, or t
  modified_base (334)..(334): a, c, t, g, unknown or other
  misc_feature (334)..(334): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (391)..(391): a, c, t, g, unknown or other
  misc_feature (391)..(391): n is a, c, g, or t
  modified_base (448)..(448): a, c, t, g, unknown or other
  misc_feature (448)..(448): n is a, c, g, or t
  modified_base (460)..(460): a, c, t, g, unknown or other
  misc_feature (460)..(460): n is a, c, g, or t
  modified_base (468)..(468): a, c, t, g, unknown or other
  misc_feature (468)..(468): n is a, c, g, or t
  modified_base (505)..(505): a, c, t, g, unknown or other
  misc_feature (505)..(505): n is a, c, g, or t
  modified_base (539)..(539): a, c, t, g, unknown or other
  misc_feature (539)..(539): n is a, c, g, or t
tcagtgatacgtctcacgaccggtgctcgatttagagtatacatattgggtttgggggaggaactgctcagttaggacccagacggaaaccatggaagccccagcgcagcttctcttcctcctgctactctggctcccagataccacgtggaataatgtgatgacgcagtcctaccagtcccaccgttgtcgtgtacgttccgaggaanaaacgcgacctactacctaccaccgtagaccgacgggtactacgtacgagacggttctggacctaacctaagtacgccgtacggaccagcagactaccgttggctcggacctccgacggttaccnctaagtcgtaacggtcncgtaaccnggactacgggcctaaggtcgaccgccggacgngttcgtaggtgtacggtcgggttcgtacggacgtagtacgtttcgtactaccatagntacgcactcgancctaaggntacgtaagtttcgttagtcttattaccgtaagtcganacgtaacttaataacttaaggcgttacgaccttntaccggtttaaggttccgggaacgggtaaacgtaacggtaggtaccgttacgtaccgtaaaatacgggttaccgaaggttccggtaacaacggtaccctacgttaacgttccagttttacccgtaacgtcccgttaaccg

SEQ ID NO: 160728 - DNA, 735 bp, Homo sapiens
  misc_feature: GYAE6OF02JFI7H.9.67.G01.1.454.CMB.1.raw
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (358)..(358): a, c, t, g, unknown or other
  misc_feature (358)..(358): n is a, c, g, or t
tcagtgatacgtctcacgaccggtgctcgattttagagtatacatattggggtttgggggaggaactgctcagttaggacccagacggaaccatggaagccccagcgcagcttctcttcctcctgccttactctggtcctcccgagactaccacgtggaattaatagtgatggacgctagtcctccagccctacctgtcttggtgttccaggagaaacncgccactcgtcacctgcgcggacngtcagngttctggactactagttacgcttacgacacgtcagtagaccgtggcgtcggtcctaccggtggtccctcgtactaccgtcggtcgccgtacgagtccgacgggtacccngttcggtaccgtcccggacgtacggttcgaggttcggtaggttccggggtcgtacgggtacgacggtacggttttacaccgttacgtccctaaggtccgacgtacggtcgtacctacgtaacgtcgttaacgtaggtacgtttagttgtaccgtttaagtttaccgttcgttacggtcctaggttacgttaacttaacttaacgggttacgttacgtaccggttacttaaccggttacggtttcgggtaaccgggtagggtaacccgtaagggttaccggggataccggtttaaacggaacgttcggtttaccgtacggtccgtacgtaacctacggtttcgtacggttacctttaccttacgtaccgtttaccccg

SEQ ID NO: 160729 - DNA, 501 bp, Homo sapiens
  misc_feature: GYAE6OF01C4LYF.22.27.C05.1.454.CMB.1.raw
  modified_base (408)..(408): a, c, t, g, unknown or other
  misc_feature (408)..(408): n is a, c, g, or t
  modified_base (493)..(493): a, c, t, g, unknown or other
  misc_feature (493)..(493): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctctctactgctcatttactgggcgtctacccgggaatccggggtcctgaccgattcagtgcagcgggtctgggacagatttcactctcaccatcagcagcctgcaggctgaagatgnggctagtttatactgtcagcaatattatattcctctcagtacgttcggaccaagggaccaaggtggaaatcaaaacgactgtagntgcactac

SEQ ID NO: 160730 - DNA, 497 bp, Homo sapiens
  misc_feature: GYAE6OF01AD4MV.22.27.C05.1.454.CMB.1.raw
  modified_base (490)..(490): a, c, t, g, unknown or other
  misc_feature (490)..(490): n is a, c, g, or t
tcagacatacgcgtcacgaccggtgctcgatttagacgcgatcgaagggtttggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgacccgattcagtggcagcgggtctgggacagatttcactctcaccatcagcagccctgcaggctgaagatgtggcagtttatactgtcagcaatattatattcctctcagacgttcgccaagggccaaggtggaaatcaaacgactgtgntgcacta

SEQ ID NO: 160731 - DNA, 509 bp, Homo sapiens
  misc_feature: GYAE6OF01BV4C9.22.27.C05.1.454.CMB.1.raw
tcagacatacgcgtcacgaccggtgctcgatttagacgcgatcgaagggtttggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatccggggtccctgaccgattcagtggcagcgggtctgggacagatttcactctcaccatcagcagcctgcaggctgaagatgtgctagtttatactgtcagcaatattatattcctcctcagtacgttcggacctaagggacctaagggtggaaactacgaaaacgactgtaggctgcaccta

SEQ ID NO: 160732 - DNA, 493 bp, Homo sapiens
  misc_feature: GYAE6OF01EPOAG.22.27.C05.1.454.CMB.1.raw
  modified_base (490)..(490): a, c, t, g, unknown or other
  misc_feature (490)..(490): n is a, c, g, or t
tcagacatacgcgtcacgaccggtgctcgatttagacgcgatcgaagggtttggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccgggtccctgaccgattcagtggcagcgggtctgggacagatttcactctcaccatcagcagcctgcaggctgaagatgtggcagtttatactgtcagcaatattatattcctcctcagacgttcggcaagggccaaggtgaaatcaaagactgtgatgcncta

SEQ ID NO: 160733 - DNA, 527 bp, Homo sapiens
  misc_feature: GYAE6OF01AP5DD.22.27.C05.1.454.CMB.1.raw
  modified_base (396)..(396): a, c, t, g, unknown or other
  misc_feature (396)..(396): n is a, c, g, or t
  modified_base (423)..(423): a, c, t, g, unknown or other
  misc_feature (423)..(423): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagaggccaccatcaactgcaagtccagccagagtatttttacagctccaccaataagagctacttagcttggttccagcagaaaccaggacatcctcctctactgctcatttactgggcgtctacccggaatccggggtccctgaccgattcagtggcagcggtctgggacagatttcactctcaccatcagcagcctgcnggctgagatgtggcagtttatactgtnagcaatattatacttcctcctactagacgtttcggaccctaaggggaccctaaagggtaggaaactacgaaaaccgtaactcggtaggactagccaacccgtag

SEQ ID NO: 160734 - DNA, 521 bp, Homo sapiens
  misc_feature: GYAE6OF01BPTC8.22.27.C05.1.454.CMB.1.raw
tcagacatacgcgtcacgaccggtgctcgatttagacgcgatcgaacgggtttggggagctacaacaggcaggcaggggcagcgaagatggtaggttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctggggacagatttcactctcaccatcagcagcctgcaggctgaagatgtggctagtttatactgtcagactaattattatattcctcctcagtacgttcggaccaaggggtacccaaggtacggaaatacaaacgaactgtggactgccactac

SEQ ID NO: 160735 - DNA, 543 bp, Homo sapiens
  misc_feature: GYAE6OF01DZ4L9.22.27.C05.1.454.CMB.1.raw
tcagacatacgcgtcacgaccggtgctcgatttagacgcgatcgaagggttttggggggtctacaacgaggcgaggacgaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtgcagcggtctggacagatttcactctcaccatcagcagcctgcagctagagatgtggactagtttattactgtcagactaattattattacttcctcctcagtacgttcggaccgaagggtacccgaaagggtagaaacgttcaaaaccgtagttacggtacggactacggaccaccgtagttccg

SEQ ID NO: 160736 - DNA, 511 bp, Homo sapiens
  misc_feature: GYAE6OF01D1LIL.22.27.C05.1.454.CMB.1.raw
  modified_base (407)..(407): a, c, t, g, unknown or other
  misc_feature (407)..(407): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccgggtccctgaccgattcagtggcagcgggtctgggacagatttcactctcaccatcagcagcctgcaggctgaagntgtggctagtttatactgtcagcaattattatacttcctcctcagtacgttcgaccgaagggaccaaggtggaaactcaaaacgaactgtggactgcacctacg

SEQ ID NO: 160737 - DNA, 503 bp, Homo sapiens
  misc_feature: GYAE6OF01A3D22.22.27.C05.1.454.CMB.1.raw
  modified_base (500)..(500): a, c, t, g, unknown or other
  misc_feature (500)..(500): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggctagtttattactgtcagcaatattatattcctctcacgtacgttcggccaagggaccaagggtgaaatcaaacgactgtgctagcacntcg

SEQ ID NO: 160738 - DNA, 518 bp, Homo sapiens
  misc_feature: GYAE6OF01D20BI.22.27.C05.1.454.CMB.1.raw
  modified_base (405)..(405): a, c, t, g, unknown or other
  misc_feature (405)..(405): n is a, c, g, or t
tcagacatacgcgtcacgaccggtgctcgatttagacgcgatcgaaggatttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggcgtctacccgggaatccggggtccctgaccgattcagtggcagcgggtctgggacagatttcactctcaccatcagcagcctgcaggctgaagntgtggctagtttatactgtcagcaattattatatttccctcctcacgtacgttccggacctaaggggacccaagggtaggaaactcgaaaacgactgtaggactcgcacctag

SEQ ID NO: 160739 - DNA, 501 bp, Homo sapiens
  misc_feature: GYAE6OF01B08UV.22.27.C05.1.454.CMB.1.raw
  modified_base (309)..(309): a, c, t, g, unknown or other
  misc_feature (309)..(309): n is a, c, g, or t
  modified_base (405)..(405): a, c, t, g, unknown or other
  misc_feature (405)..(405): n is a, c, g, or t
  modified_base (442)..(442): a, c, t, g, unknown or other
  misc_feature (442)..(442): n is a, c, g, or t
  modified_base (493)..(493): a, c, t, g, unknown or other
  misc_feature (493)..(493): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcattacnggcgtctacccggaatccgggtcctgaccgatcagtggcaggcgggtctgggacagatttcactctcaccatcagcagcctgcaggctgaagatgngctagtttatacgtgtcagcaattatatattcctctnagtcgttcgaccgaagggaccaaggtcgaaatcgaaaagtactgtagactncgacctag

SEQ ID NO: 160740 - DNA, 506 bp, Homo sapiens
  misc_feature: GYAE6OF01BV1BB.22.27.C05.1.454.CMB.1.raw
  modified_base (371)..(371): a, c, t, g, unknown or other
  misc_feature (371)..(371): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatccggggtccctgaccgattcagtggcagcgggtctgggacagntttcactctcaccatcagcagcctgcaggctgaagatgtggcagtttatactgtcagcaatattatattcctcctcagacgttcggaccaagggcctaagggtgaaatcaaacgactgtaggctggccacgtacg

SEQ ID NO: 160741 - DNA, 496 bp, Homo sapiens
  misc_feature: GYAE6OF01BX3BW.22.27.C05.1.454.CMB.1.raw
  modified_base (486)..(486): a, c, t, g, unknown or other
  misc_feature (486)..(486): n is a, c, g, or t
tcagacatacgcgtcacgaccggtgctcgatttagacgcgatcgaagggtttggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagctgcagctgaagatgtgcagtttatactgtcagcaatattatattcctctcagtaccgttcggaccaagggaccaaggtgaaatcaaagactgngctgcacgta

SEQ ID NO: 160742 - DNA, 508 bp, Homo sapiens
  misc_feature: GYAE6OF01B0Q45.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctggaccgattcagtggcagcgggtctgggacagattcactctcaccatcagcagcctgcaggctgaagatgtggctagtttatactgtcagcaattattatattcctctcagacgttcggaccaagggaccaaaggtcggaaatcgaaacgactggtagactgcactac

SEQ ID NO: 160743 - DNA, 528 bp, Homo sapiens
  misc_feature: GYAE6OF01BZR44.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagtatttcactctcaccatcagcagcctgcaggctgaagatgtggctagtttatactgtcagctaatattatacttcctcctacacgtacgttccggaccaaagggaccaaggtaggaaactacgaaaacgacgtagtacggactacgcctaacctacg

SEQ ID NO: 160744 - DNA, 508 bp, Homo sapiens
  misc_feature: GYAE6OF01ES0M3.22.27.C05.1.454.CMB.1.raw
  modified_base (406)..(406): a, c, t, g, unknown or other
  misc_feature (406)..(406): n is a, c, g, or t
tcagacatacgcgtcacgaccggtgctcgatttagacgcgatcgaagggtttggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatccggggtccctgaccgattcagtggcagcgggtctgggacagatttcactctcaccatcagcagcctgcaggctgaagntgtgcagtttatactgtcagcaatattatattcctctcagtacgttcggaccaagggacctaagggtacggaaatacgaaacgaactgtagactgcactacg

SEQ ID NO: 160745 - DNA, 513 bp, Homo sapiens
  misc_feature: GYAE6OF01EBS42.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggctagtttatactgtcagcaatattatacttcctcctcagacgttcggaccaagggacccaagggtggaaactcgaaacgaactgtaggactgcactacg

SEQ ID NO: 160746 - DNA, 565 bp, Homo sapiens
  misc_feature: GYAE6OF01CLLXZ.22.27.C05.1.454.CMB.1.raw
  modified_base (411)..(411): a, c, t, g, unknown or other
  misc_feature (411)..(411): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccgatcaactgcaaggtccagccagagtatttttacagctccaccaataagagctatagcttggttcagcagaaaccaggacatcctcctctactgcctctatttactgggctctacccgggaatcccgggtcctgacgattcagtgcaggcggtctgggacagtactttcactctcaccaatcagcacgcctgcgaggctagaagntggtgctagtttatacctgtacagactaagttattagttacttccctaccgtacgtaacgtacgtttacccgggacgtaaaccggggaacccgtaaagggtacggaaaacttacccgaaaacggacgttggtacggatacgccaacccgttacg

SEQ ID NO: 160747 - DNA, 510 bp, Homo sapiens
  misc_feature: GYAE6OF01DNUBL.22.27.C05.1.454.CMB.1.raw
  modified_base (499)..(499): a, c, t, g, unknown or other
  misc_feature (499)..(499): n is a, c, g, or t
  modified_base (505)..(505): a, c, t, g, unknown or other
  misc_feature (505)..(505): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccggaatccggggtcctgaccgattcagtggcagcgggtctgggacagatttcgactctcaccatcagcagcctgcagctgagatgtgctagtttatactgtacagactaattattatacttcctctcagtacgttcggaccaagggaccaaggtaggaaatcgaaagaactgtaggntcggcncctac

SEQ ID NO: 160748 - DNA, 587 bp, Homo sapiens
  misc_feature: GYAE6OF01DZBIS.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagctttggttccagcagaaaccaggacatcctcctctactgctcatttactgggcgtctacccgggaatcccggggtccctgaccgattcgagtggcagcgggtctggggacagatttcactctcaccatcagcagcctgcaggctagaagtatggtcggactaagttttatacgtgtacgagtactaattaattacttacgtttccctaccgtacgtacggtaccggttccggaaccgtaacgggtaaccgtaagggttaacggtaaaacttaacccgtaaaacgaacgtttaggtacggtacctcggaacccgtaccgttaacg

SEQ ID NO: 160749 - DNA, 529 bp, Homo sapiens
  misc_feature: GYAE6OF01AMTIQ.22.27.C05.1.454.CMB.1.raw
  modified_base (313)..(313): a, c, t, g, unknown or other
  misc_feature (313)..(313): n is a, c, g, or t
  modified_base (415)..(415): a, c, t, g, unknown or other
  misc_feature (415)..(415): n is a, c, g, or t
  modified_base (460)..(460): a, c, t, g, unknown or other
  misc_feature (460)..(460): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgctcatttacgngggcgtcgtacccgggaatcccggggtccctgaccgattcagtcggcaggcgggtctgggacagtatttcactctcaccatcagcagcctgcaggctgaagntgtgactagtttatactgtcagtctaatattatacttccctactnagtccgttcgaccgaacgggtaccaaggtagaaactacgaaacgtacgtgtacggactgcccgactacg

SEQ ID NO: 160750 - DNA, 522 bp, Homo sapiens
  misc_feature: GYAE6OF01CPHJ7.22.27.C05.1.454.CMB.1.raw
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (436)..(436): a, c, t, g, unknown or other
  misc_feature (436)..(436): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaccaggacatcctacctctactgctcatttactggcgtctacccgggaatcccgggtcctcgaccgattcagtggcaggcggtctgggacagatttcactctcaccatcagcagctgcagctagaagntgngactagtttatactgtcagtcaaattnttatacttcctctctagtacgttcgaccgtaagggacctaaggtacgaaactacgaaaacgtactaggtacgactgacctactacg

SEQ ID NO: 160751 - DNA, 612 bp, Homo sapiens
  misc_feature: GYAE6OF01CZ0NC.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgctctatttactggctcgtacccggaatcccgggtcctgaccgtattcgagtggcgacgcgggtcgtgggacagtatttcgactcgtacaccatcagtcagcctgcaggctagaacgtagtggtcgacttaagttttactacgttcgtcgaagtacctaaagttattacgttactttcccgttacctacgtaacggttaccggtttacccgggaaccgtaaaacggggtaaccctaaaggggttacggaaaaacttaccggaaaaaccgttaacgtcggtacggtaccttacggaccctaccgttaaaccg

SEQ ID NO: 160752 - DNA, 514 bp, Homo sapiens
  misc_feature: GYAE6OF01AXF8T.22.27.C05.1.454.CMB.1.raw
  modified_base (511)..(511): a, c, t, g, unknown or other
  misc_feature (511)..(511): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattaagtggcagcgggtctgggacagatttcactctcaccatcagcagcctgcaggctgagatgtgctagtttattattgtcagcaatattatattcctcctcagtacgttcggacctaagggaccaaggtaggaaatcgaaacgactggtggactagccacgtntcg

SEQ ID NO: 160753 - DNA, 253 bp, Homo sapiens
  misc_feature: GYAE6OF01D11VB.22.27.C05.1.454.CMB.1.raw
  modified_base (251)..(253): a, c, t, g, unknown or other
  misc_feature (251)..(253): n is a, c, g, or t
tcagacatacgcgtcacgaccggtgctcgatttagacgcgatcgaagggtttgggacagatttcactctcaccatcagcagcctgcaggctgaagatgtggcagtttattactgtcagcaatattatattcctcctcagacgttcggccaagggaccaaggtggaaatcaaacgaactgtggctgcaccatctgtcttcatcttccgccatctgaacgcgtatgtctgagcgggctggcaaggcgcatagnnn

SEQ ID NO: 160754 - DNA, 499 bp, Homo sapiens
  misc_feature: GYAE6OF01CYS99.22.27.C05.1.454.CMB.1.raw
  modified_base (412)..(412): a, c, t, g, unknown or other
  misc_feature (412)..(412): n is a, c, g, or t
  modified_base (489)..(489): a, c, t, g, unknown or other
  misc_feature (489)..(489): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgngctagtttatactgtcagcaatattatattcctctcagtacgttcggcaaggaccaaggtggaaatcaaaagactgngctagcacta

SEQ ID NO: 160755 - DNA, 532 bp, Homo sapiens
  misc_feature: GYAE6OF01EEM6Y.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcaagaaaccaggacatcctctctactgctcatttactgggccgttcgtacccgggatcccggggtccctcgaccgtattcagtcggcgaggcgggtctgggacagtatttcactctcaccatcagcacgcctgcaggctagaagatgtggctagtttatactgtcagctaatattatattcctctacagtacgttccggaccgtaaacgggacctaagggtagaaatacgaaaacgaacgtgtacgctgccactacg

SEQ ID NO: 160756 - DNA, 514 bp, Homo sapiens
  misc_feature: GYAE6OF01A8D4U.22.27.C05.1.454.CMB.1.raw
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccggaatccgggtccctgaccgattcagtggcagcgggtctgggacagatttcactctcaccatcagcagcctgcaggctgaagatgtggctagtttattactgtacagcaattattatacttcctctcagtacgttcggacctaagggaccctaagggtaggaaactacgaaacgactggngacngcacgtac

SEQ ID NO: 160757 - DNA, 525 bp, Homo sapiens
  misc_feature: GYAE6OF01BAT6P.22.27.C05.1.454.CMB.1.raw
  modified_base (404)..(404): a, c, t, g, unknown or other
  misc_feature (404)..(404): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttctggcgtctacccgggatccgggtcctgaccgattcagtggcacggcgggtctggacagtatttcactctcaccatcagcagcctgcaggctagaagntgtgctagttttattattgtcagtactaattatttatacttcctctacagtacgttccggaccgaaagggaccctaaggtagaaatcaaaacgtactggtacggactagcctacgagttcg

SEQ ID NO: 160758 - DNA, 521 bp, Homo sapiens
  misc_feature: GYAE6OF01A9YW5.22.27.C05.1.454.CMB.1.raw
  modified_base (517)..(517): a, c, t, g, unknown or other
  misc_feature (517)..(517): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagccctgcaggctaggaagatgtgctagtttattactgtcagcaattattatacttcctcctcagtacgttcggaccaagggaccaagggtgaaactcgaaaacgtactaggtcgactaggcaccgnttcg

SEQ ID NO: 160759 - DNA, 538 bp, Homo sapiens
  misc_feature: GYAE6OF01A5YDJ.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctggggacaggatttccactctcaccatcagcagcctgcaggctagaagatgtggctagtttactacgtgcagacaattattattacttccctcctcacgtacgttccggaccgaagggaccaagggtacggaaacttacgaaaacgacgttaggtacggactcggaccacctaag

SEQ ID NO: 160760 - DNA, 528 bp, Homo sapiens
  misc_feature: GYAE6OF01ESKFR.22.27.C05.1.454.CMB.1.raw
  modified_base (407)..(407): a, c, t, g, unknown or other
  misc_feature (407)..(407): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatccgggtccctgaccgattcagtggcagcgggtctgggacagatttcactctcaccatcagcagcctgcaggctagaagntgtggctagtttatactgtcagcaattattattacttcctcctcagtacgttccggacctaacgggtcccaaggtacggaaactaccgaaaacgtaacgtcgtaggacctgaccacctacg

SEQ ID NO: 160761 - DNA, 556 bp, Homo sapiens
  misc_feature: GYAE6OF01CEWAI.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgattgacccagtctccagactccctggctgtgtctctgggcgagagggccaccatcgaactgcaagtccagccagagtatttttacagctccaccaataagagctacttagcttggttccagcagaaaccaggacatcctcctctactgctcatttactgggcgtctacccgggaatccggggtccctgaccgattcagtggcagcggtctggacagatttcactctcacatcagcacgcctgcagctagaagatgtgctagttttattattgtacagactaatattaatacttcctccgtctaacgtaccgttccggaccgtaaagggtaccgtaaagggtacgaaaagtaccgaaaaccgtaacttacggtacggaccgttagacctaaccgtagttacccg

SEQ ID NO: 160762 - DNA, 600 bp, Homo sapiens
  misc_feature: GYAE6OF01COEZM.22.27.C05.1.454.CMB.1.raw
  modified_base (310)..(310): a, c, t, g, unknown or other
  misc_feature (310)..(310): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacactcctcctctactgctcatttacngggcgtctacccgggaatcccggggtccctgaccgattcagtggcagcggtctgggacagtatttcgactctacaccatcagcacgcctgctacggctagaacgtgtgtggtactagttttattacgtgtacgagtacctaaatttacttaagttactttcctacccttacgacgtaccggttccggaaccgtaaacgggtacccgtaaaggggttagaaaactaccggtaaaacccggtaacgttagggtaccgggacttaacggaccctaacccgtaagtttacccgg

SEQ ID NO: 160763 - DNA, 615 bp, Homo sapiens
  misc_feature: GYAE6OF01A6KAZ.22.27.C05.1.454.CMB.1.raw
  modified_base (311)..(311): a, c, t, g, unknown or other
  misc_feature (311)..(311): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttacngggctcgtacccgggaatcccgggtcctgaccgattcagtggcagcggtctgggacagattcactctcacctatcagcagccctgcaggcctagaacgtatgtggtactaggttttatagtttgtaccaggtactaaagttatttacttaacgttcccttacccttacgtaacggttaccggtttaccggaaccccgtaaaagggggtaaccccgtaaaggggttacgggtaaaaaccttacggtaaaaacccggtaacgtttcgggtaaccgggtaccttacgggaaccctaacccgttaacg

SEQ ID NO: 160764 - DNA, 515 bp, Homo sapiens
  misc_feature: GYAE6OF01AOXYA.22.27.C05.1.454.CMB.1.raw
  modified_base (409)..(409): a, c, t, g, unknown or other
  misc_feature (409)..(409): n is a, c, g, or t
  modified_base (451)..(451): a, c, t, g, unknown or other
  misc_feature (451)..(451): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaccaggacatcctctctactgctcatttactgggcgtctacccgggaatcccggggtccctgaccgattcagtggcaggcgggtctgggacagatttcactctcaccatcagcagccctgcaggctgaagntgtgctagtttatactgtcagcaattattatacttcctcctnagtacgttcggaccaaagggaccaagggtaggaaactcgaaaacgactgtaggactgcactacg

SEQ ID NO: 160765 - DNA, 534 bp, Homo sapiens
  misc_feature: GYAE6OF01CD4J8.22.27.C05.1.454.CMB.1.raw
  modified_base (311)..(311): a, c, t, g, unknown or other
  misc_feature (311)..(311): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttacnggcgtcgtacccgggaatcccgggtccctgaccgattcagtggcaggcgggtctgggacagtatttcactctcaccatcagcagcctgcaggctagaagatgtggctagtttattacgtgtcagtctaattattatacttccctctacacgtacggttccgaccgaacgggacctaagggtacgaaataccgaaaacgactacggtagactcgaccaccgtac

SEQ ID NO: 160766 - DNA, 836 bp, Homo sapiens
  misc_feature: GYAE6OF01C5WZG.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtctttatttctctgttgctctggatctctggtgcctccgggacatcgtgatgacccagtctccagactccctggctgtgtctctgggcgagagggccaccatcaactgcaagtccagccagtagtatttttacagctccaccaataagagctacttagcttggttccagcaagaaaccaggacactcctcctctactgctactatttacgtgggtccgtaccgtacccgggaacgttcccggggtcccctacggaccgtaagtttccgaaggttcgggacgacggccggggttacgtacggggaaccgtaaggtacttttacccgacttccttacccaacccgtactccgaacgcccgtaacgtcccgtacggccgtaacgggtcctaaggaaaggtacgttcgggttcgggtaacctttaagggttttttaacctttaaccggtttacggttacccggtaaagttacccgttaaaaattttaacgtttttaaactttaacccttttaccccttaccccgtttaacccggtaaccgggtttaaaccccgggttttacccggggaaaaccccgggtaaaaaccggggggttaaacccccgttaaaaggggggttaaaaacccgggtaaaaacccgtttaacccgggtaaaaaaacccggttaaaccgtttacggggttaacgggtacccgttaacggtaacccgtaaacccgtaacgtttcccggtttaacccg

SEQ ID NO: 160767 - DNA, 551 bp, Homo sapiens
  misc_feature: GYAE6OF01CAFUI.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctggacagatttcactctcaccatcagcagcctgcaggctgaagatgtgctagtttattactgtacagactaatatttatactttcccttcctcgtacgtaccgtttcggaccctaaaggggtaccgaaagggttggaaaacttcgaaaacgtaacttaggtacgggactaggacctacccgtgttaccg

SEQ ID NO: 160768 - DNA, 565 bp, Homo sapiens
  misc_feature: GYAE6OF01C7L3B.22.27.C05.1.454.CMB.1.raw
  modified_base (358)..(358): a, c, t, g, unknown or other
  misc_feature (358)..(358): n is a, c, g, or t
  modified_base (377)..(377): a, c, t, g, unknown or other
  misc_feature (377)..(377): n is a, c, g, or t
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctactagcttggttccagcagaaaccaggacatcctcctctactgctcatttactggctcgtacccgggaatccggggtccctgaccgattcagtgcagcggtcngggacagtattcactctcnccatcagcagcctgcnggctgaagntgtgctagtttatactgtcagctaattattatatttccctacctctaacggtaccgtttacggacccgtaaaggggtacccgtaaagggttggaaaaacttccgaaaaaccggtaacttgggttaacgggtaccttaggacccgtaacccgtacgtttacccg

SEQ ID NO: 160769 - DNA, 528 bp, Homo sapiens
  misc_feature: GYAE6OF01E1759.22.27.C05.1.454.CMB.1.raw
  modified_base (407)..(407): a, c, t, g, unknown or other
  misc_feature (407)..(407): n is a, c, g, or t
  modified_base (523)..(523): a, c, t, g, unknown or other
  misc_feature (523)..(523): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctagaagntgtgctagtttattactgtcagacaattattatacttccctctacagtaccgttcggaccaaagggtaccaagggtagaaactccaaaacgtacgtggtacggactagcctaccgnttccg

SEQ ID NO: 160770 - DNA, 533 bp, Homo sapiens
  misc_feature: GYAE6OF01BHSSG.22.27.C05.1.454.CMB.1.raw
  modified_base (405)..(405): a, c, t, g, unknown or other
  misc_feature (405)..(405): n is a, c, g, or t
  modified_base (422)..(422): a, c, t, g, unknown or other
  misc_feature (422)..(422): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagatttcactctcacatcagcagcctgcaggctgaagntgtgctagtttattacngtcagtacaattattattacttccctctctaacgtacgttacgggcctaaacgggtaccaagggtagaaactcgaaacgaacgtaggtacggactacggacaccgtgtccg

SEQ ID NO: 160771 - DNA, 544 bp, Homo sapiens
  misc_feature: GYAE6OF01BJQLU.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactacaagtccagccagagtatttttacagctccaccaataagagctacttagcttggttccagcagaaaccaggacatcctcctctactgctcatttactgggcgtctacccgggaatcccggggtcctgaccgattcagtggcagcgggtctgggacagatttcactctcaccatcagcagcctgcaggctgaagatgtgctagtttatacgtgtcagctaatattattacttcctcctcacgtacgttcggacctaaagggaccctaagggtacggaaataccgaaaaccgtaacgtcggtacggtactacggaccaaccagttccgttacgg

SEQ ID NO: 160772 - DNA, 541 bp, Homo sapiens
  misc_feature: GYAE6OF01BIABG.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggcgtctacccgggaatccggggtccctgaccgattcagtggcagcgggtctgggacagtatttcactctcaccatcagcagcctgcaggctgaagtatgtggcagttttatactgtcagcaattattatacttcctcctcagtaccgttcggacccgtaaagggaccctaagggtacggaaaacttccgaaaacggacttaggtacggacttacggaccacccgtaacg

SEQ ID NO: 160773 - DNA, 566 bp, Homo sapiens
  misc_feature: GYAE6OF01C56O2.22.27.C05.1.454.CMB.1.raw
  modified_base (442)..(442): a, c, t, g, unknown or other
  misc_feature (442)..(442): n is a, c, g, or t
  modified_base (555)..(555): a, c, t, g, unknown or other
  misc_feature (555)..(555): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgctctatttacgtgggcgttaccgtacccgggaagttccccggggtccctaggacccgtattccgaggtcggcaggccgggtctggggactagtatttcgactctcaccatcagtcacgcctgcaggcctagaagtagtgnggtcttagtttattacgtgtacagtacctaattattattacttccctctcgaacgttaccgtcggactaacgggaacctaagggtacgaaactacgaaacgtacgtggtacgntcgctactacg

SEQ ID NO: 160774 - DNA, 538 bp, Homo sapiens
  misc_feature: GYAE6OF01DP5HL.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggactccggggtccctgaccgattcgagtggcaggcggtctgggacagtatttcactctcaccatcagcagcctgcaggctagagatgtgctagtttatactgtcagctaatattatacttcctactctagaccgttcggacccgtaagggtacccgtaagggtaggaaactaccgaaaacgtactacggtacggtactagacctaccgtgttaccg

SEQ ID NO: 160775 - DNA, 566 bp, Homo sapiens
  misc_feature: GYAE6OF01CUUJV.22.27.C05.1.454.CMB.1.raw
  modified_base (419)..(419): a, c, t, g, unknown or other
  misc_feature (419)..(419): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccacaataagagctacttagcttggttccagcaagaaaccaggacatcctcctctactgctctatttactggcgtcgtacccgggaatcccggggtcctacgaccgtattcgagtcggcaggtcgggtcgtgggacagtacgtttcactctcaccatcagcagctgcaggctgaagntgtgcttagtttattactgtacagtactaagttattactacttccctactacgtagtaccgttcggaccgaaagggtaacccgtaaagggtacggtaaaactaccgtaaaaacgtacgttacggtacgacgtacgcctaacctaacg

SEQ ID NO: 160776 - DNA, 515 bp, Homo sapiens
  misc_feature: GYAE6OF01EFKQW.22.27.C05.1.454.CMB.1.raw
  modified_base (511)..(511): a, c, t, g, unknown or other
  misc_feature (511)..(511): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagagtgtggctagtttattactgtcagacaattattatacttcctcctacagtaccgttcggccaagggaccaaggtagaaatcaaacgactgtagactagacaccgntccg

SEQ ID NO: 160777 - DNA, 554 bp, Homo sapiens
  misc_feature: GYAE6OF01EOBRY.22.27.C05.1.454.CMB.1.raw
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcattactgggctcgtacccggaatccgggccctgaccgattcagtggcaggtcgggtctgggacagatttcgacttcgtcaccatcagcagcctgcaggctagaantgngctagtttatactgtntagactaattattattacttcctacctcgaagtccgtttaccggacctaagggaacccgtaaagggtcggaaaacttaccgaaaaaccggtaacgttggtacggtctacggacctaaccgttaacg

SEQ ID NO: 160778 - DNA, 250 bp, Homo sapiens
  misc_feature: GYAE6OF01BFVRR.22.27.C05.1.454.CMB.1.raw
  modified_base (250)..(250): a, c, t, g, unknown or other
  misc_feature (250)..(250): n is a, c, g, or t
tcagacatacgcgtcacgaccggtgctcgatttagacgcgatcgaagggtttgggacagatttcactctcaccatcagcagcctgcaggctgaagatgtggcagtttattactgtcagcaatattatattcctcctcagacgttcggccaagggaccaaggtggaaatcaaacgaactgtggctgcaccatctgtcttcatctccgccatctgaacgcgtatgtctgagcgggctggcaaggcgcatagn

SEQ ID NO: 160779 - DNA, 504 bp, Homo sapiens
  misc_feature: GYAE6OF01ESRRE.22.27.C05.1.454.CMB.1.raw
  modified_base (501)..(501): a, c, t, g, unknown or other
  misc_feature (501)..(501): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggctagttttattattgtcagcaatattattattcctcctctagacgttcggccaagggaccaagggtgaaatcaaacgatgtgctagcacntcg

SEQ ID NO: 160780 - DNA, 564 bp, Homo sapiens
  misc_feature: GYAE6OF01CXXLC.22.27.C05.1.454.CMB.1.raw
  modified_base (335)..(335): a, c, t, g, unknown or other
  misc_feature (335)..(335): n is a, c, g, or t
  modified_base (399)..(399): a, c, t, g, unknown or other
  misc_feature (399)..(399): n is a, c, g, or t
  modified_base (470)..(470): a, c, t, g, unknown or other
  misc_feature (470)..(470): n is a, c, g, or t
  modified_base (508)..(508): a, c, t, g, unknown or other
  misc_feature (508)..(508): n is a, c, g, or t
  modified_base (549)..(549): a, c, t, g, unknown or other
  misc_feature (549)..(549): n is a, c, g, or t
  modified_base (555)..(555): a, c, t, g, unknown or other
  misc_feature (555)..(555): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagacctccctggctgtgtctcgtgggcgaggacgggccaccatcaactgacaagtccagccagtagtttatttttacagcctccaaccaaataaagacgacttacttagcgttggttaccagacaacgaaaaccaggacactccctcctctactgctctattttacgngggtccgtccgtaacccgggacgtcccggggtccctaggaccgtattcaggtgcaggcggtcgnggacagtattcactctcacatcagcacgccgtagcgaggtacctggaagtagttcggtggcttaagttttnttaattgtacacgtactaattaattatacttctcctanacgtacgtcgaccgaagacggtaagtagaatacgaactagngtgacnacnctntcg

SEQ ID NO: 160781 - DNA, 519 bp, Homo sapiens
  misc_feature: GYAE6OF01B4LMK.22.27.C05.1.454.CMB.1.raw
  modified_base (310)..(310): a, c, t, g, unknown or other
  misc_feature (310)..(310): n is a, c, g, or t
  modified_base (403)..(403): a, c, t, g, unknown or other
  misc_feature (403)..(403): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaccaggacatcctcctctactgctcatttacnggctcgtacccggaatcccgggtcctgaccgattcagtgcagcgggtcgtgggacagtatttcactctcaccatcagcagcctgcagctgaanatgtgctagtttattactgtcagtctaattattatattcctctacagtacgtcgaccgaagggtaccaaggtaggaaactaccgaaaacgacgtacggtacgactcgccacgtacg

SEQ ID NO: 160782 - DNA, 549 bp, Homo sapiens
  misc_feature: GYAE6OF01CS4OR.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaccaggacatcctcctctactgctctatttactggctctacccgggaatccgggtccctgaccgattcgagtggcagcgggtctgggacagatttcgactctcaccatcagcagcctgcaggctagaagatggtgactagtttatacgtgtcagactaagttattatacttcctcttacaggtaccgttccggacctaaacgggacctaagggttacggaaacgttacgaaaacggtaactacggtacggtacgtacgccgtaaccgtacg

SEQ ID NO: 160783 - DNA, 537 bp, Homo sapiens
  misc_feature: GYAE6OF01C6HF1.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagctttggttccagcagaaaccaggacatcctcctctactgctctatttactgggcgtcgtaccccggaatcccggggtcctgaccgattcagtcggcagcgggtctgggacagatttcactctcacctatcagcagcctgcaggctgaagtatgtggctagtttattactgtcagactaatattatacttccctctacgagtaccgttcggaccaagggacctaagggtagaaacttacgaaaacgtacgttgtacggactacgctaccgtaacg

SEQ ID NO: 160784 - DNA, 541 bp, Homo sapiens
  misc_feature: GYAE6OF01AR5U7.22.27.C05.1.454.CMB.1.raw
  modified_base (405)..(405): a, c, t, g, unknown or other
  misc_feature (405)..(405): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcgagtggcagcggtctggacagatttcactctcaccatcagcagcctgcaggctgaagntgtgctagtttattactgtcagactaatattatacttacctcctacacgtacgttcggaccgaaacgggtacctaaagggtaggaaactaccgaaaaccgtacgttaggtacggtactagcctaccctagttaccg

SEQ ID NO: 160785 - DNA, 522 bp, Homo sapiens
  misc_feature: GYAE6OF01DX4ZF.22.27.C05.1.454.CMB.1.raw
  modified_base (408)..(408): a, c, t, g, unknown or other
  misc_feature (408)..(408): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctctctactgctcatttactgggctcgtacccgggaatccggggtccctgaccgattcgagtggcaggcgggtctgggacagatttcactctcaccatcagcagcctgcagctgaagntgtgctagtttatactgtcagactaatattatacttcctctcagtacgttcggaccgaacgggaccaaggtaggaaactacgaaacgaactggtacggctaggcctaccgtacg

SEQ ID NO: 160786 - DNA, 594 bp, Homo sapiens
  misc_feature: GYAE6OF01BJI0N.22.27.C05.1.454.CMB.1.raw
  modified_base (308)..(308): a, c, t, g, unknown or other
  misc_feature (308)..(308): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctctctactgctcatttacnggcgtctacccgggaatccgggtcctgaccgattcagtgcagcggtctgggacagattcactctcaccatcagcagcctgcaggctaggaagtgtggtgactagttttacttacgtgtacagtactaaattactttaattactttccctacctaccgtaacggttaccggtttccggacccgtaaacggggtaccccgtaaaggggttacgtaaaacgtacccgtaaaaaccggtaaccgttacgggttacgggaccttacggaccctaaacccgtagtttacccg

SEQ ID NO: 160787 - DNA, 560 bp, Homo sapiens
  misc_feature: GYAE6OF01AYDF3.22.27.C05.1.454.CMB.1.raw
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
  modified_base (553)..(553): a, c, t, g, unknown or other
  misc_feature (553)..(553): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccacaataagagctacttagcttggttccagcagaaaccaggacatcctcctctactgctcatttacgtggcgtctaccgggatccggggtcctgaccgattcagtggcagcgggtctggacagtatttcactctcaccatcagcagctgcaggctagaagtagtgtgcttagtttactactgtnagtactaattnttaattactttccctactacgtagtaccgtttaccggaccgtaaagggacccgtaaagggttacggaaaactccgaaaaaccggtaattcggtacggtaccttaggacctaaccgtnttacccg

SEQ ID NO: 160788 - DNA, 536 bp, Homo sapiens
  misc_feature: GYAE6OF01C4L0O.22.27.C05.1.454.CMB.1.raw
  modified_base (425)..(425): a, c, t, g, unknown or other
  misc_feature (425)..(425): n is a, c, g, or t
  modified_base (523)..(523): a, c, t, g, unknown or other
  misc_feature (523)..(523): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctattagcttggttccagcaagaaaccaggacatcctctctactgctcatttacgtgggctaccgtacccgggaatcccggggtcctgaccgtattcaggtggcaggtcgggtcgtgggactagtatttcactctcaccatcagcacgcctgcaggctagaagtatggngacttagttttatacgtgtcagtctaaattattattacttcctctcagtacgtccggacgaaggaccaaggtagaaactcgaaaacgtactggtacgntagcctaccgtac

SEQ ID NO: 160789 - DNA, 545 bp, Homo sapiens
  misc_feature: GYAE6OF01BSVJ9.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctctatttacgtgggcgtccgtacccgggaagtcccggggtccctgaccgattcagtggcaggcgggtctgggacagtatttcacttctcaccatcagcagccctgccgaggctaggaagagtgtggcctaagttttacttacgtgtacgagcgagtcgtagctatcgtcgccctcgtacctaccgtttcggccgtaggggaccaggccgtaggaacgtactacgaaacgactggtcggtaccg

SEQ ID NO: 160790 - DNA, 528 bp, Homo sapiens
  misc_feature: GYAE6OF01E1WJC.22.27.C05.1.454.CMB.1.raw
  modified_base (372)..(372): a, c, t, g, unknown or other
  misc_feature (372)..(372): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcgtcctgcactgctcatttactgggcgtctacccgggaatccggggtccctgaccgattcagtggcagcgggtctgggacagntttcactctcaccatcagcagcctgcaggctgaagatgtggctagtttattactgtacagctaaattattactacttacctcctcacgtaaccgttcggacccgtaagggaccaagggttcgaaatccgaaaacgactggtagtcctgcctaaccg

SEQ ID NO: 160791 - DNA, 605 bp, Homo sapiens
  misc_feature: GYAE6OF01C34VX.22.27.C05.1.454.CMB.1.raw
  modified_base (602)..(602): a, c, t, g, unknown or other
  misc_feature (602)..(602): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctaccaccaataagagctactagtcttgttccagcagaaccaggacactcctcctctactcgctctatttacgtggtctaccgtaccgggacgtccgggtccctagaccgtatcgagtcggcgaggtcgggtcgtagggactagtacgtttcactccgtaccaccactcgaacgtccgacgtcctgccaggtccgtaggaacgtgtaggtcgggtacttaagttttaacttacgtacgttacgtaacgtactaatttaacgtttacttaccgttcccttaccgtacgtacgttaaccggttccggaccgtaaggaccgtaaaggtagaaactacgaaacgtacgtggtacggactagcctactntcg

SEQ ID NO: 160792 - DNA, 547 bp, Homo sapiens
  misc_feature: GYAE6OF01ED011.22.27.C05.1.454.CMB.1.raw
  modified_base (314)..(314): a, c, t, g, unknown or other
  misc_feature (314)..(314): n is a, c, g, or t
  modified_base (349)..(349): a, c, t, g, unknown or other
  misc_feature (349)..(349): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagacgttatttttacagcctccaccaataagagctacttagcttggttccagcagaaaccaggacatcctcctctactgctcatttacnggctcgtacccggaatccgggtcctgaccgattcngtcggcagcggtctgggacagtattcactctcgacatcagcagcctgcagctgaatatgtggctagtttactactgtacagactaattattacttacttccctacctcagtaccggttcggacccgtaaaggggaccctaaagggtacggtaaaactacgaaaaccgaacgttcggtaggacctggacctacctaacg

SEQ ID NO: 160793 - DNA, 663 bp, Homo sapiens
  misc_feature: GYAE6OF01CJRGG.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctaccaaccaataagagctacttagcttggttccagacaacgaaaccaggacactcctcctctactgctctatttacgtggccgtccgtacccgggtaagtcccggggtcctcgaccgtattcgaggtcggcgacggtcgggtcgtagggactacgtactttcgacctaccgtaccaccgtaatcgacgcctaacgtcccgtgacgacgggtcgtacgaaaggtagttcggtacggtacgttaaacgttttacttaaccgtgggttaaccaaggtaccttaaaattactttaaccgttaactttccccctactaccgtaaggtacccggtttaccgggaaccgtaaacggggtaccgtaaaggggtacgtaaaacgtaaccgtaaaacgtacgttggtacggacttcgacccgtacttacgg

SEQ ID NO: 160794 - DNA, 594 bp, Homo sapiens
  misc_feature: GYAE6OF01AHR5V.22.27.C05.1.454.CMB.1.raw
  modified_base (590)..(590): a, c, t, g, unknown or other
  misc_feature (590)..(590): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctaccaaccaataagagctacttagcttggttccagcagaaaccaggaccatcctcctctactcgctctatttacgtcgggcgtccgtaacccgggtactcccggggttccctgaccgtattcgaggtcggcgtaggccgggtcgtagggactaggtactttccgaccttccgtaccacctataccacgtccacgcccttggccgagggtcctaggaagtagttcggtacggtacttaggttttacttacgtagtactagtacaatttagttattacttcctactacacgtaccgtcgaccgaagggacctaaggtagaactacgaaacgtactgtacgactagacctctnttcg

SEQ ID NO: 160795 - DNA, 612 bp, Homo sapiens
  misc_feature: GYAE6OF01CZJTZ.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagagttatttttacagctaccaccaataagagctacttagcttggtaccagcaagaaccaggacactccctctctactgctctatttacgtgggtccgtaccgtacccgggaacgttcccggggtccctgacccgtattcgaggtggcgaggtccgggtcgtgggactagtactttcactctaccaccatccaagcacgccctgcgaggctagaagtgtggtcggacttagtttattacttgtactagactaagttattattactttccctacttacgaacgtaccggttccgggaacccgtaaaggggtacccgtaaagggttaacggaaacgttaaccgaaaacgtacgttagggtacggaccttacggcccgtaaccctaacg

SEQ ID NO: 160796 - DNA, 604 bp, Homo sapiens
  misc_feature: GYAE6OF01BJU0L.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacactcctcctctactgctactactttacgtgggcgtccgtaaccccggggaacttcccgggggtcccctggacccgtattccgaggtcggacaggcgggtctggggacagtatttccgacttctaccgaccatcgacgcacgccctgccaggctagaacgagttgtggctagtttatacgtgtacgagtactaaattattaattactttcctacctacgtacgtaccgttccggaacccgtaaacgggtacccgaaagggttacggaaaactacgaaaaccggtaacgttacggtaggacctacggaccaaccgtacg

SEQ ID NO: 160797 - DNA, 648 bp, Homo sapiens
  misc_feature: GYAE6OF01DAJ2U.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagacaagaaaccaggacactcctcctctactgctctatttacgtggtcgtccgtacccgggtaacgtcccggggtcctggaccgtattacgaggtcggcgacggtcgggtcgtacgggaactaggtacgtttccacctccgtaccaccatcgacgcacgcctgcgaaggtctagaacgtagtggtacggtacttaagttttattactacgtactagaccgttaaatttatttaacttactttcccttccgtaacgtaaccggttaccggttcccgggaaccgaaacggggtaacccgtaaaggggttaaccggtaaaactaacccgtaaaacggtaaccgtcgggtacggtaccgtacgacccgtaaccgttacg

SEQ ID NO: 160798 - DNA, 535 bp, Homo sapiens
  misc_feature: GYAE6OF01D00AA.22.27.C05.1.454.CMB.1.raw
  modified_base (531)..(531): a, c, t, g, unknown or other
  misc_feature (531)..(531): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctcgtacccgggaatcccggggtccctgaccgattcagtggcaggcgggtctgggacagtatttcgactctcaccatcagcagccctgcaggctgaagatggtgtctagtttattacgtgtcagtactaattattattactttccctctactagtaccgttcggaccgaagggacctaagggtagaaatcgaaacgagtagtcggtactagaccacctntccg

SEQ ID NO: 160799 - DNA, 539 bp, Homo sapiens
  misc_feature: GYAE6OF01DPUWD.22.27.C05.1.454.CMB.1.raw
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcattactgggctcgtacccggaatccgggtcctgaccgattcagtgcagcgggtctgggacagatttcactctcaccatcagcagcctgcagcngaacntgtggactagtttatactgtcagtacaattattatacttccctcttcgacgtacgttccgggactaaagggaccctaaagggtcggaaaacttaccgaaaaccggaaacttgggtacggacctacgaccaccgtaac

SEQ ID NO: 160800 - DNA, 585 bp, Homo sapiens
  misc_feature: GYAE6OF01DCDDS.22.27.C05.1.454.CMB.1.raw
  modified_base (313)..(313): a, c, t, g, unknown or other
  misc_feature (313)..(313): n is a, c, g, or t
  modified_base (438)..(438): a, c, t, g, unknown or other
  misc_feature (438)..(438): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagacagaaaccaggacatcctcctctactgctctatttacgngggtccgtccgtaacccgggtaacttccccgggggtccctggaccgtacttcgaggtggcaggccgggtcgtggggacagtatttccactctacacctatacacgacagcctgcaggctagaagntggtgcttagtttattactgtcaagactaagttattattactttccctactacgacgtacggtttcggaccgtaagggacccgtaagggtacgaaactaaccgaaacgaacgttacggtacggtactacgacctaccgtgttacccg

SEQ ID NO: 160801 - DNA, 518 bp, Homo sapiens
  misc_feature: GYAE6OF01ASRPW.22.27.C05.1.454.CMB.1.raw
  modified_base (514)..(514): a, c, t, g, unknown or other
  misc_feature (514)..(514): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagactttcactctcaccatcagtcagcctgcaggctagaagatgtgctagtttattatgtcagacaatattatacttcctcctacagtacgtcggccaaagggacctaagggtagaaactacgaaacgatagtggactaggcacctntccg

SEQ ID NO: 160802 - DNA, 545 bp, Homo sapiens
  misc_feature: GYAE6OF01CB4CN.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagtagtatttttacagctccaccaataagagctacttagcttggttccagcagaaaccaggacactcctcctctactgctctattactgggcgtctacccggaatccgggtcctgacgtatcagtgcagcgggtctgggacagtattcactctcaccatcagcagcctgcaggctagaagtatgtgctaagtttataactgtacaagactaaattattatacttccctactactaggtaccgttaccgggacaaacgggtacctaaagggtacgtaaaactaccgaaaacgtaaccgtggtacggactgaccgactacg

SEQ ID NO: 160803 - DNA, 584 bp, Homo sapiens
  misc_feature: GYAE6OF01D5663.22.27.C05.1.454.CMB.1.raw
  modified_base (307)..(307): a, c, t, g, unknown or other
  misc_feature (307)..(307): n is a, c, g, or t
tcagacatacgcgtcacgaccggtgctcgatttagacgcgatcgaagggtttggggctacaacaggcaggcaggggcagcaagatggtgttgcagaccccaggtcttcatttctctgttgctctggatctctggtgcctccgggacatcgtgatgacccagtctccagactccctggctgtgtctctgggcagagggccaccatcaactgcaagtccagccagagtatttttacagctccaccaattaagagctacttagcttggttccagcagaaaccaggacatcctctctactgctcatttacnggctctaccggaatccgggtcctgaccgattcagtgcagtcggtctggacagacttcactctcacatcagcagcctgcaggctgagatgtgctagtttactactgtacaggtactaagttactttacgtaactttccctaccgttacgtaacgtaacccggtttacggacccgtaaaaggggtacccgtaaagggttacggaaaacttacccggtaaaaaccggtacgttacgggttacggtaccgttacggaaccctaaccgtacggtttacccgg

SEQ ID NO: 160804 - DNA, 712 bp, Homo sapiens
  misc_feature: GYAE6OF01DMP4M.22.27.C05.1.454.CMB.1.raw
  modified_base (311)..(311): a, c, t, g, unknown or other
  misc_feature (311)..(311): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccgggacatcgtgatgacccagtctccagactccctggctgtgtctctgggcgagagggccaccatcaactgcaaagtccagccagagttatttttacagctccaccaataagagctacttagcttggttccagcagaaaccaggacatcctcctctactgctcatttacgnggtcgtctacccgggaatccggggtccctgaccgtattccagtcggcgacggcgggtctgggactaggtacgttttcaactccttaccaccgtaattcccgaaggacctacggtccctaggtacccgaagggtccttaggaaaggtacttagggttcggtacttaacggtttttattaaccgttggtaccgtaagaaccttaaattaacttttaattaacctttcccccgttaccttacgtaaccggttaaccggtttaccccgggaaaccgtaaaaccgggggaacccccgtaaaaggggttaaaccggggtaaaactttaaacccggaaaaaaccggttaaccgttaacggggttacgggtacccttagggaaccccaaaccgttacgtttaaccccgg

SEQ ID NO: 160805 - DNA, 665 bp, Homo sapiens
  misc_feature: GYAE6OF01DF2OO.22.27.C05.1.454.CMB.1.raw
  modified_base (178)..(178): a, c, t, g, unknown or other
  misc_feature (178)..(178): n is a, c, g, or t
  modified_base (317)..(317): a, c, t, g, unknown or other
  misc_feature (317)..(317): n is a, c, g, or t
  modified_base (357)..(357): a, c, t, g, unknown or other
  misc_feature (357)..(357): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctgtggatctctggtgcctacggggacattgtgatgacccagtctccagactcccnggttctgtgtctcgtgggcgagagggtcacatcaactgcaagtccagccagagttattttacagctccaacaataagagttactagtcttggttccagcaagaaaccaggacatcgtcctgctactgctactattacgngggtcgtacgtacccggaagtcccgggtcctaggaccgtntacgaggcgagacggtcggtcgtaggacgtagtacttacgacctcgtaccactactcgacgtaccgacgtaccgtgacgtaggtccgtaagaacgtcggtaggttcgacgtttaagttttattacgtacggttacgaacgtaccttaaagtttactacctttacttcccgtaccgtacgttaaccggttaccgggtaacccggtaaccggtaaaacggggtaaccgtaagggggttaaagaacccgttaaaacggaaacgttaaccggtggttaaccggtacaaccgggttacccaacgtttaacccg

SEQ ID NO: 160806 - DNA, 540 bp, Homo sapiens
  misc_feature: GYAE6OF01CB0EQ.22.27.C05.1.454.CMB.1.raw
  modified_base (403)..(403): a, c, t, g, unknown or other
  misc_feature (403)..(403): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccggaatccgggtccctgaccgattcagtgcagcggtctgggacagattcactctcacctatcagcagcctgcagctgaagngtgtgctagtttatactgtcagtactaatattaatacttctaccctctagtaccgttccggaccgtaaagggaccctaaggtacggtaaactacgtaaaaaccgacgttggtacggacttacggacctaacgtaacg

SEQ ID NO: 160807 - DNA, 544 bp, Homo sapiens
  misc_feature: GYAE6OF01DG6BL.22.27.C05.1.454.CMB.1.raw
  modified_base (280)..(280): a, c, t, g, unknown or other
  misc_feature (280)..(280): n is a, c, g, or t
  modified_base (417)..(417): a, c, t, g, unknown or other
  misc_feature (417)..(417): n is a, c, g, or t
  modified_base (434)..(434): a, c, t, g, unknown or other
  misc_feature (434)..(434): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccgggacatcgtgatgacccagtctccagactccctggctgtgtctctgggcgagagggccaccatcaactgcaagtccagccagagttatttttacagctccaccaataagagctactagcttggttccagcagaaaccnggacatcctcctctactgctcatttactgggctctacccgggaactcccggggtcctgaccgtattcgagtggcacggcgggtcgtggacagtactttcactctcacctatccagcacgccctgcaggctagaacgntggtgactagttttatnttgtcagactaattattatacttccctctgtacgtaccgttcggaccaagggaccgtaaagggtagaaactcgaaaacgtactaggtcggtactagacctcgtagttccg

SEQ ID NO: 160808 - DNA, 1044 bp, Homo sapiens
  misc_feature: GYAE6OF01A6R9X.22.27.C05.1.454.CMB.1.raw
tcagacatacgcgtcacgaccggtgctcgatttagacgcgatcgaagggtttgggggtctacgaacaggcaggcgaggggcctagccaaggatcggtaggttcgtccagtacccgtagggtcttcatttctcgtgttgctctgggaactcctctgggtagccggtccggggacatccgtggttacttggtacccagttctttccgaaggtacgttcccctgggtcgtgtggttctcgtagggcggtaggagggtccaccgagtcgaacgttggccaagtcccaggaccaagtaccgttagtttttaacgacgtccttccctaaccgtaagtaacgaacggccttaaccgtttaaggccttttcgggtttaccccttaaggttaccgttaaacggttaaaaccccggaagggtaaccgtaacgttcccccgtttacccggttccccgttaacccgttacgggtaccctttaccgtaacgggtttttaaaccgggtcggggtaccgggtttaccggtttaacccccgggggtaaacggttcccccggggggttaacccctttaccgggtaaaccccggttaacgtttacccgtaaggggttaacggggtaaccggtaaaacgggtccggggtttacggttacggggggtaaacccttacgggtaacggttttttaccggaaccgggtttacccgttacccgttaaccccgtaacttacccgttaaccgggtacccgtaaacgggtaccccgttaacggaacccggtaaccgggtaaaccgttaacgggtaaaccggtaaccgtttggggttaaccggttacccgtttaacgggtttttaaaccgtttaacgttacggttaaccgaaggttaacccgttaaagttaacgtttaaacgtttaccgttacccgtaaccgttaccgtaggttaaccggtttacggacccgttaaacggggtaccggtaaacgggtaggtaaacgtacggaaaaccgtaaccgttacggttacggtaccgtttacggtaccgttaccgttacgttacccgg

SEQ ID NO: 160809 - DNA, 536 bp, Homo sapiens
  misc_feature: GYAE6OF01DSHHZ.22.27.C05.1.454.CMB.1.raw
  modified_base (311)..(311): a, c, t, g, unknown or other
  misc_feature (311)..(311): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttacnggcgtctacccgggaatcccggggtcctgaccgattcagtggcaggcgggtctgggacaggatttcactctcaccatcagcagcctgcaggcctgaagatgtgctagtttattactgtacagctaattattaatacttccctcctcacgtaccgttccggaccaaagggaccctaagggtaggaaactaccgaaaacgtacgtggtaggactacggctacctacg

SEQ ID NO: 160810 - DNA, 555 bp, Homo sapiens
  misc_feature: GYAE6OF01D3JVC.22.27.C05.1.454.CMB.1.raw
  modified_base (428)..(428): a, c, t, g, unknown or other
  misc_feature (428)..(428): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctctactttacgtgggcgtccgtacccgggaacgtcccggggtccctcggaccgtattcgagtggcgacggcgggtcgtgggacagtatttcactctcaccatcagcagccctgcaggctagaagtntgtggctagttttattagttgtcagactaaattatttaatcttccctctcaacgtaccggttccggacgaaagggtacctaagggtaggaaactacgaaaacgtacgtggtacggactggcacctag

SEQ ID NO: 160811 - DNA, 664 bp, Homo sapiens
  misc_feature: GYAE6OF01ETJD7.22.27.C05.1.454.CMB.1.raw
tcagacatacgcgtcacgaccggtgctcgattttagacgcgatcgaagggtttggggggagggctacaacagggcaaggcacggggcaggcaagactagggtgttgccagacccaggtcttcactttcctctgttgctctggatctcgtgggtgccgtccggggacactcgtgatgaccagtctccagactcctggctgtgtctcgtgggcgaggacgggccaccatcaactgcaagtccacgccagtagttatttttacagtcctaccaacctaataacgacgtacttacgttacgtcgttcggtaccacgacaacgaaccgacgactactcctcctactactcgtcctactacgttacgtcgggtaccgtaccgtacccgggtacggtcccgggtcctacgaccgtacgttcgaggtcggcgtacggtcgggtcgtacgggactacgtacttcactctacactactcacgcacgtcctgaccgaggtactaggagtcgtcggtacgtacgtttaagtttactacgtcgtactaacgtacttaattattacttaccttaccctactacggtacggttaccggtaccggaacggtaaacgggtaccgtaagggtaacgtaaactaccgtaaacgtacgttcgtacggacctacgccgtaactcg

SEQ ID NO: 160812 - DNA, 587 bp, Homo sapiens
  misc_feature: GYAE6OF01DPXMD.22.27.C05.1.454.CMB.1.raw
  modified_base (436)..(436): a, c, t, g, unknown or other
  misc_feature (436)..(436): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgacaagtccagccagagttatttttacagcctccaaccaataagagactacttagcttggttccagcaagaaaccaggacatcctcctctactgctctatttacgtgggcgtccgtacccgggtaagtcccggggtccctagaccgtattcgaggtgcgaggtcgggtcgtgggactagtactttcactctaccactatcagacagtcctgcaggcgtagaagngtggtcggtacttagttttacttacgtgttacagtactaattattactactttccctactcgtacgtacgttacggaccgtaagggtacccgtaaagggtacgaaactaacgaaaccgtaagtcggttacgatacgactaacctgttaccg

SEQ ID NO: 160813 - DNA, 559 bp, Homo sapiens
  misc_feature: GYAE6OF01C2BP4.22.27.C05.1.454.CMB.1.raw
  modified_base (314)..(314): a, c, t, g, unknown or other
  misc_feature (314)..(314): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (413)..(413): a, c, t, g, unknown or other
  misc_feature (413)..(413): n is a, c, g, or t
  modified_base (553)..(553): a, c, t, g, unknown or other
  misc_feature (553)..(553): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagaggccaccatcaactgcaagtccagccagagtatttttacagctccaaccaaataagagttactagcttggttccagcaagaaaccaggacatcgtcctgcactgctcatttacgngggctccgtacccgggaagtcccgggtcctcgaccgtataagtgcagcggtcnggacngtacttcgactctcaccatcagtcagcctgcaggctgaagntgtgacttagttttattagttgtacagtactaagttattatacttccctactcgaacgtaccgttacggacctaaacgggaccgtaaagggtaggaaaatccgaaaacggtaaacttggtaccggactagaaccaccgtnttaccg

SEQ ID NO: 160814 - DNA, 535 bp, Homo sapiens
  misc_feature: GYAE6OF01B6JTL.22.27.C05.1.454.CMB.1.raw
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
  modified_base (459)..(459): a, c, t, g, unknown or other
  misc_feature (459)..(459): n is a, c, g, or t
  modified_base (530)..(530): a, c, t, g, unknown or other
  misc_feature (530)..(530): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagttacttagtcttggttccagcagaaaccaggacatcgtcctgcactgctctatttacgtgggcgtccgtacccgggaacgtcccgggtccctgaccgtattcgagtggcaggcgggtcgtggacagtatttcactctcaccatcagccagtcctgcaggctagangtgtgntatttatntgcagctaattnttatcttcctctanacgtaccgttcgaccgaagggacctaaagggtagaaactcgaaaacggtactggtacgctagacctaccgnttccg

SEQ ID NO: 160815 - DNA, 604 bp, Homo sapiens
  misc_feature: GYAE6OF01AK057.22.27.C05.1.454.CMB.1.raw
  modified_base (599)..(599): a, c, t, g, unknown or other
  misc_feature (599)..(599): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagtctacttagcttggttccagacagaaaccaggacatcctcctctactgctctatttacgtgggtccgtccgtaacccgggaagtcccggggtccctaggacccgtattcgaggtcggcgacggcgggttacgtggggacaggtactttaccacctctaccacctatccagcctacgccctggcacggtactagggaaatcgtggtacggtcttaagttttactacgttcgtacgacgtactaattacgttaattactttccctctaccgtaggtaccgttaccggaccgtaagggtacctaagggtaacggaactaccgaaagtacgtggtacgactcgaccnctacg

SEQ ID NO: 160816 - DNA, 512 bp, Homo sapiens
  misc_feature: GYAE6OF01DE8L1.22.27.C05.1.454.CMB.1.raw
  modified_base (447)..(447): a, c, t, g, unknown or other
  misc_feature (447)..(447): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctctctactgctcatttactggctctacccggaatccggggtcctgaccgattcagtggcagcgggtctgggacagatttcactctcaccatcagcagcctgcaggctagaagatgtgctagtttattattgtcagactaatattatattcctctnacgtacgttcgaccgtaagggaccaagggtagaaatacaaacgaactgtacggctgcctactacg

SEQ ID NO: 160817 - DNA, 537 bp, Homo sapiens
  misc_feature: GYAE6OF01A3Y89.22.27.C05.1.454.CMB.1.raw
  modified_base (312)..(312): a, c, t, g, unknown or other
  misc_feature (312)..(312): n is a, c, g, or t
  modified_base (383)..(383): a, c, t, g, unknown or other
  misc_feature (383)..(383): n is a, c, g, or t
  modified_base (406)..(406): a, c, t, g, unknown or other
  misc_feature (406)..(406): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctctatttacnggctcgtacccggaatccgggtccctgaccgattcagtcgcagcggtctgggacagtattcacgtctcacntcagcagcctgcagctagaagtntgtgctagtttatactgtacagcgtaattacgttattcttacctctaccgtagtaccgttcggaccgtaagggtacctaagggtacgtaaataccgaaaagacttggtacggtactacgccgtaccgtacg

SEQ ID NO: 160818 - DNA, 602 bp, Homo sapiens
  misc_feature: GYAE6OF01DK4VQ.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcaagaaaccaggacatcctcctctactgcctctattttacgtgggtccgtacgtaccccgggaactcccgggggtccctacggacccgtattccgaagtcggccaggtccggggtcgttggggacaggtactttccacgttctccaacctatccaagcaagtccctgacaggcctaggaagtatggtggtacttagttttacttacgtgtacgagactaagttattaattactttccctcctactaacgtaccgttccggaccgaacgggaccaagggtacggaaaactaccgaaaacgtactggtacggtctcgacctaccgtacg

SEQ ID NO: 160819 - DNA, 568 bp, Homo sapiens
  misc_feature: GYAE6OF01EHH9D.22.27.C05.1.454.CMB.1.raw
  modified_base (311)..(311): a, c, t, g, unknown or other
  misc_feature (311)..(311): n is a, c, g, or t
  modified_base (343)..(343): a, c, t, g, unknown or other
  misc_feature (343)..(343): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcatgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttacnggcgtctacccgggaatccgggtcctgaccgntcagtgcagcggtctgggacagatttcactctcaccatcagcagcctgcaggctgaagatgtgctagtttatactgtcagctaatatttatacgtttcctccttacgacggttaccggtttaccggacccgtaaaggggtaccccgaaaggggttacgggaaaaaccttccggaaaaaaccggttaacccgttcgggtaacgggtccttacggccctaaacccgg

SEQ ID NO: 160820 - DNA, 663 bp, Homo sapiens
  misc_feature: GYAE6OF01EUHOX.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctcagactccctggctgtgtctcgtgggcgagagggccaccatcaactgcaagtccagccagagttatttttacagtctccaaccaataagagcttacttagtcttggttccagcaagaaaccaggacactcctcctctactgctcatttacgtgggcgtcgtacccgggaacttcccggggtccctcggaccgtattcgacggtggcgagggtccgggtcgtggggaactagtactttccgaccgttctaccaccctatccacgacgacgtcccgtgacgagggtctacggaaagtcgttggtcggtaccttaaggttttacttaccgtgtacgtagtaccgttaaatttactttaattaccgtttaccctcccgttacctacgggttaaccgtttcccgggaaccggtaaacgggtacccgtaaagggttaaggtaaaacgtaccgtaaaaccggtacgttacgggtacggtaccgttagacccgtaactacgttccg

SEQ ID NO: 160821 - DNA, 528 bp, Homo sapiens
  misc_feature: GYAE6OF01AVICU.22.27.C05.1.454.CMB.1.raw
  modified_base (406)..(406): a, c, t, g, unknown or other
  misc_feature (406)..(406): n is a, c, g, or t
  modified_base (429)..(429): a, c, t, g, unknown or other
  misc_feature (429)..(429): n is a, c, g, or t
  modified_base (518)..(518): a, c, t, g, unknown or other
  misc_feature (518)..(518): n is a, c, g, or t
  modified_base (523)..(523): a, c, t, g, unknown or other
  misc_feature (523)..(523): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagactacttagcttggttccagcaagaaccaggacatcctcctctactgctctatttacgtgggtccgtccgtaacccgggagttcccggggtccctacggaccgtattcgagtcggacaggtcggtcgtgggacagtattcactctcactntcagcacgctgcagctagaagtntggtgactagtttactatgtcagactatattatactcctctgagtcgtcgaccgaaggaccgaggtacgaatacaacgacgttgacggnagccncgtac

SEQ ID NO: 160822 - DNA, 595 bp, Homo sapiens
  misc_feature: GYAE6OF01EOO5F.22.27.C05.1.454.CMB.1.raw
  modified_base (318)..(318): a, c, t, g, unknown or other
  misc_feature (318)..(318): n is a, c, g, or t
  modified_base (354)..(354): a, c, t, g, unknown or other
  misc_feature (354)..(354): n is a, c, g, or t
tcagacatacgcgtcacgaccggtgctcgatttagacgcgatcgaagggtttgggggagctacaacaggcaggcaggggcagcaagatggtgttgcagacccagctcttccatttctctgttgctctggatctctggtgcctccggggacatcgtgatgacccagtctccagactccctggctgtgtctctgggcgagagggccaccatcaactgcaagtccagccagagttatttttacagtctccaaccaataagagctacttagcgttggttccagcagaaaccaggacatcctacctctactgctctatttacngggctccgtaccgggaagtcccgggtcctgaccgtnttcgagtgcacggcggtctgggacagtactttcacttctacacctatcagcagcctggcagctaggaagctggtcggacttagtttactactgtaccgagtactaaattagtttatacgttcccttacgtacgtacggtaccggttaccgggaaccgtaaacggggtacccgtaaagggttaggaaaaccttaccgaaaaaccggtaacgttcgggacggaccctcggacccgtaaacccg

SEQ ID NO: 160823 - DNA, 764 bp, Homo sapiens
  misc_feature: GYAE6OF01CHUMO.22.27.C05.1.454.CMB.1.raw
  modified_base (138)..(138): a, c, t, g, unknown or other
  misc_feature (138)..(138): n is a, c, g, or t
tcagacatacgcgtcacgaccggtgctcgatttagacgcgatcgaagggtttggggagctactaacggaggtcaggcaggggcagcaagatggtgttgcaagaaccaggtacttcactttctcttgttcgctcctggngtctctcggtgccgttccgggggacctagtccgtggtatcgaccctagtctccgagccgtccctggctgtgtctcgtgggacgacgacggccaccatccaactcgactaagtccacgccgaggtacgttactttttacaagtcttaccaactaattaagactcttacgttagtcgttacggtccgagaccgaaccggaaacgaggtacgacttccgtactcgtactgtctactagtttacgtcgggtcgtaccgtacccggtaacgttcccgggtacctcgtaccgtacgttacgaacggtcggtacgaacggtccggtacgtacggggaccgtaacggtacgtttaccaaccgttccgtaaccgtaacctaagttccaacggttaccgaacgtccccgtagacccgtaagggtccttaacgggaaacgtcgttacggtacggtacctttaaacggttttacttaagttggttaacctaggtaacctaaattttcgtaactttacgttccgtcgtagtaacggttacggttccgggtaacgaaacgggtacctaaagggttacggtaaaacttacggtaaaacgtacgtttcggtacgggacctaaccggtaccaaaccgttacgg

SEQ ID NO: 160824 - DNA, 770 bp, Homo sapiens
  misc_feature: GYAE6OF01CWBOJ.22.27.C05.1.454.CMB.1.raw
  modified_base (245)..(245): a, c, t, g, unknown or other
  misc_feature (245)..(245): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgaaccagtcctccagacctcccgtggctgtcgtctcgtgggcgagacgggccaccatcaactgcaagtccagccagagttacttttanacgtctaccaacctaataacgagtctacgttaagcgttcggtccagacaagaaccaggacactcctacctctactcgtactcgtaacttacgtcggtccgtaccgtaacccggtaacgttcccgggtaccacggtaccgtacgttacgaggtcgaccgtacggtccgggtacgtaggggtaaccaacgttacgttacctaccgttcctaccctacgtactacgacgaccgacgtaccgtcgacgtaacgggacttaggaacggaacgttcgggttacgtacgtttaacggttttaacttaacggttacgttaacgaaccggttaaacttaaacgtttaacctttaaacggtttacccttttaccccgttaaccccgttacggttaaaccgggtttaccgtaacccccggggttaaaccgaaacccgggggtaaaccggtaaacgggtaacggtaaaaaccgttacccgtaaaaaccggtaccggtacggttaacggaccggttaaccaaccgtacccttaaccgg

SEQ ID NO: 160825 - DNA, 641 bp, Homo sapiens
  misc_feature: GYAE6OF01DMHI5.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgacaagtccagccagtagttatttttacagtcctaccaaccaataagacgctacttagtcttcggttaccagacaagaaaccaggacactcctcctctactgctctatttacgtgggacctccgtacccgggtacgtcccgggtcctagtaccgtagttcgagtcggcgacggtcggtcgtaggactagtacgtttcacgtctacgaccagtcacgtcagtcctgacgaggtctaggaagtagttggtagtaccttagtttacttacgtgtaccgagtaacgtaatttaacttacttaccttcccttacctacgtaacggtacccgttaccggaaccgtaaacggggtaacccgtaaaggggtaacgaaaacgttaccgaaaacggttacgttacggtacggacttacgacccttaaccgtaattcccg

SEQ ID NO: 160826 - DNA, 648 bp, Homo sapiens
  misc_feature: GYAE6OF01DLFWH.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagagttatttttacagctccaaccaataagagtctacttagtcttcggttccagcacgaaaccaggacactcctcctctactgctctatttacgtggtcgtaccgtacccgggtaacgtcccgggtcctagaccgtagttcgaggtggcgacgggtcgggtcgtacgggacacgtacttccgaacttcgtaccaccgtatacaggccacgccgtaggaccgacggtacgtaaggaacgtagttcggtcggtacctttaaggttttacttacgtcgtacgaagtaactaattaattactactttccctactacgtaacggttaccgttacggaaccgtaaagggtaacccgtaaacgggttaggtaaaactaccgtaaaaccgtagtcggtaccggacttacgacctaacccgtagtttacccgg

SEQ ID NO: 160827 - DNA, 532 bp, Homo sapiens
  misc_feature: GYAE6OF01D3JGW.22.27.C05.1.454.CMB.1.raw
tcagacatacgcgtcacgaccggtgctcgatttagacgcgatcgaagggtttggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagattcactctcacatcagcagcctgcaggctgaagatgtggctagtttatactgtcagcaattattaatattcctcctcagtacgttccggaccgtaaagggaccctaaagggtcggaaaataccgaaaaacggaacctggtaggaccttgcctaacctaacg

SEQ ID NO: 160828 - DNA, 578 bp, Homo sapiens
  misc_feature: GYAE6OF01BZB03.22.27.C05.1.454.CMB.1.raw
  modified_base (317)..(317): a, c, t, g, unknown or other
  misc_feature (317)..(317): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagacaacgaaaccaggacatcctcctctactgctctatttacgnggcgtccgtacccgggaagtcccggggtccctacgaccgtattccgaggtcggcgacggcgggtctgggactaggtatttcgactctacacctatcagtccagcctgacgaggctagaagtgtagtcggacttagtttactacgtgtcaagactaattacgttatcttaccctctacacgtaccgttccgaaccgtagggaacctaaggtacggtaaacaccgtaaaacgacgttacggtacggtactcgacctacgtacg

SEQ ID NO: 160829 - DNA, 600 bp, Homo sapiens
  misc_feature: GYAE6OF01DPBKE.22.27.C05.1.454.CMB.1.raw
  modified_base (313)..(313): a, c, t, g, unknown or other
  misc_feature (313)..(313): n is a, c, g, or t
  modified_base (594)..(594): a, c, t, g, unknown or other
  misc_feature (594)..(594): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagtagttatttttacagctccaccaataagagctacttagcttggttccagcaagaaaccaggacactcctcctctactgctcatttacnggcgtactaccgggatccgggtcctgaccgattcagtggcgaggtcgggtcgtgggactaggtactttcgacttctaccacctatccagtccacgcctagcgaggctagaagtatgtggtacttagtttacttagtgtcagtactaaagttactttattaacttcccttaccgttactaaccggttaccgtttaccggaacccgtaaaggggtaaccccgtaaaggggtacgaaaacgttaccgaaaacggtacgtacggtacggtactacgaccaacctnttaccg

SEQ ID NO: 160830 - DNA, 531 bp, Homo sapiens
  misc_feature: GYAE6OF01C333L.22.27.C05.1.454.CMB.1.raw
  modified_base (308)..(308): a, c, t, g, unknown or other
  misc_feature (308)..(308): n is a, c, g, or t
  modified_base (465)..(465): a, c, t, g, unknown or other
  misc_feature (465)..(465): n is a, c, g, or t
  modified_base (524)..(524): a, c, t, g, unknown or other
  misc_feature (524)..(524): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctacgggacattgtgatgacccagtctccagactccctggctgtgtctctgggcgagagggccaccatcaactgcaagtccagccagagtatttttacagctccaccaataagagttacttagcttggttccagcagaaaccagacatcgtcctgcactgctcatttacgngggcgtcgtaccccgggaatcccggggtccctgaccgtattcgagtggcaggcgggtctgggacaggtactttcacttcctcaccatccagcagccctgccaggctagaacgatggtgctagttttatattgtcagtcaatatttatacttcctctnagtacgttcggacagggtaccaaggtagaaactcgaaaacgtactggtacggactgacnctatccg

SEQ ID NO: 160831 - DNA, 713 bp, Homo sapiens
  misc_feature: GYAE6OF01C5V3B.22.27.C05.1.454.CMB.1.raw
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgaggacgggccaccatcaactgcaagtccagccagtagttatttttacagtctaccaaccaataagagtacttactagtcttggttccagcaagaaaccaggacatcctctctactgctctattacgtggtccgtaccgtaccgggacgtcccgggtcctggaccgtntacgnggtcggcaggcgggtcgtagggactaggtactttccgaaccttcgtaccctaaccgtacgtaccgaacgccgtaacggtccctacgggtaccgaagggtcctaagggtaaacgtaggttcgggtagggtaccttaaggtttttacgtaccgtacggttaccgaaggttaccttaaaatttacgtttaacttaccttttaccccgtaccgttacgtaaccggttaccggttacccgggaaccgtaaaccggggtaaccttaaagggggtaaacgtaaacgtaaccgtaaaaaccggttacgttaccggggtacggtaccttaccggtaacccgtaccgttaaccgg

SEQ ID NO: 160832 - DNA, 580 bp, Homo sapiens
  misc_feature: GYAE6OF01CKOF5.22.27.C05.1.454.CMB.1.raw
  modified_base (404)..(404): a, c, t, g, unknown or other
  misc_feature (404)..(404): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccacaataagagctactagcttggtccagcagaaaccaggacatcctctctactgctctatttactggcgtactacccgggaatccgggtcctgaccgattcagtggcaggtcggtcgtggacagatttcacgtctcacatcagcacgcctgcagctgaanagtgtagcctagtttacttacgtgtacaggacctaaattacgttattacgttcccttctacgtacgtaccggtttccggaccgaaacgggtaacccgtaaagggttaacggaaaacttaaccggaaaaacccgtaacgttacggtagggaccttaccggtaccgaacccttaacgg

SEQ ID NO: 160833 - DNA, 550 bp, Homo sapiens
  misc_feature: GYAE6OF01AT4A8.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcattactggctcgtacccggagtccgggtcctgaccgattcagtgcaggcgggtctgggacagtactttcactctacaccatacagcacgcctgcaggctgaagtatgtgctagtttattagttgtcagctaattattatacttccctacctacgtacggtaccgttcggaccgtaaacggggtacccaaagggtacggaaactaccgaaaacggtacttcggtacgaccgtcggacctaccgtacg

SEQ ID NO: 160834 - DNA, 826 bp, Homo sapiens
  misc_feature: GYAE6OF01EAINH.22.27.C05.1.454.CMB.1.raw
tcagacatacgcgtcacgaccggtgctcgatttagacgcgatcgaagggtttggggggtaggctacaacacggcaggcaggggcagcaagatggtgttgcgacgacccaggtcttcatttcgtctgttgctctggatctctcggtgccgtcgggacatcgtgatcgacctagtcctccacgtacctccctcggtcctgtcgtctcgtgggcgaggacgggaccaaccagtacaactcgactaacgtcccacggcccgtaaggtacgtttactttttaacgacgtacctaccaaacctaaagttaaacgtacgttaccgttaaccgttaggtccgtttacggttaccacgaaccgaaacggaaaaccgacggaacctacctccctaccgttacttaccgtacgtccttactaacgttttacggacgggtaccttacccggtaacccggggtaacgttccccggggtaccctacgggtaacccggtactttacgacggttcggtacgacgggtcgggtcgtacggggactacgttacgtttaccgtacgtactaccgtaaccttacgtaccgtaacgacctaacggtcccttacggaccggtaagtccgttaacgggaagttaccgttggtaccggttacgtttaagttttaacttacgttagtaacgtaacgttaacttaagttaacctttaatttactttaccctacgttaaccgtaccggttacccgggttaccggaacccggtaacggggtaacccggtaaagggtacggtaaactaaccggaaacgttaacgtcggttaacggtcgtacgaccgtaccgtacg

SEQ ID NO: 160835 - DNA, 921 bp, Homo sapiens
  misc_feature: GYAE6OF01CH96Y.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatgacccagtctccagactccctggctgtgtctcgtgggcgagacgggccacatcaactgcaacgtccagccagagttattttacagctcaacaataagacactacttagcttggtaccagacaagaaaccaggactactacctcctctactgactactatttacgcgggtcctaccggtaacccgggaacgttcccggggtaccctacggtacccgtaagttcccgaaggttcgggacgtaacgggtccggggttacggttacgggggaaacctaacgggttaactttttacccgaaaccgttccgttaaccccgaaaccccgtaacttaccgaacgggtaccctaaaccggccccgtttaacgggaccgaaacggggtcccttaagggaaaacggttagttaaccggggtttggggtaaacctttaaagggtttttttaaactttaaaccccgttagggttaaacccttaacgggttaaaacccgttaaaaagttttaaaccgttttttaaactttaaacccggttttcccccgtttaacccttaacccggttaaaaaccgggttaaaccccgggttttaacccgggggtaaaccccgtaaaaaaccggggggtaaaaccccggttaaaaaggggggtttaaacccggaaaaaaaaaccgtttaacccgggaaaaaaaacccggttaaaccgggtttacggggtaaacccggggttaccggttaaacccggtaaccccggttaaaaacccgggtttaaacccg

SEQ ID NO: 160836 - DNA, 617 bp, Homo sapiens
  misc_feature: GYAE6OF01BEYWF.22.27.C05.1.454.CMB.1.raw
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagagttatttttacagtcctaccaaccaaataagagactaacttacgcttcggttccagcaagaaaccaggacatcctcctctactgctctactttacgtgggtcgtccgtacccgggagtcccggggtccctacgtaccgtatcaggtcggcaggcgggtcnggactagtntttacgactctcacctatcacgcacgtcctgaccgaggtccgtagaacgtgttggtcggactttaagtttaactttacgtgtactaaggtaactaattaatttacgttaactttccctacccgttgaacggttacggttacccggacgtaaaccggggaactaaacggggttagaaaactaccaaaacggtacttggtacgctagacctaacctgttaccg

SEQ ID NO: 160837 - DNA, 583 bp, Homo sapiens
  misc_feature: GYAE6OF01CLU4U.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcaagaaaccaggacatcctcctctactgctcatttactgggctccgtacccgggaatcccggggtccctcggacctacgttcagtcggcaggcgggtcgtgggacagactttcgactctcaccatcagcacgcctgcaggctagaagtatcggtagtctaagttttattactgtacaagtactaattatttaattacttcctacctacgtacgtaccggtttcccggaccgtaaacgggaccgtaaacgggtaggaaaacttaccgaaaacgtaacgtggtacggaccttggacctaacccgtagttaccg

SEQ ID NO: 160838 - DNA, 529 bp, Homo sapiens
  misc_feature: GYAE6OF01DTMZL.22.27.C05.1.454.CMB.1.raw
  modified_base (346)..(346): a, c, t, g, unknown or other
  misc_feature (346)..(346): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaaataagagctacttagcttggttccagcagaaaccaggacatcctcctctactgctcatttactgggctcgtacccgggaactccgggtccctgaccgnttcagtggcgagcgggtctggacagtattcactctacaccatcagcagcctgcagctganatgtgntagtttatatgtcagctaattattatacttcctacctcagtaccgttcggaccaaggggaccctaagggtaggaaatacgaaaacgtacgtaggtcggactgaccaccctagttccg

SEQ ID NO: 160839 - DNA, 634 bp, Homo sapiens
  misc_feature: GYAE6OF01BGCBT.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagagttatttttacagctccaccaataagagactattagcttggtccagcaagaaaccaggacatcctcctctactcgctctatttactggtcgtaccgtacccgggtaagtcccgggtcctcgaccgtacttcgaacgtggaccgacggtcgggtacgtacgggacgtacgtatttccgactcctacgaccctagtccaacgccacgtccctagcgacggattaaggaagtactcgggttacggtcctaaggtttttaactaccgttacgtcaacgtactaagttacttaagttccttaccgttcctacgtacggtaccggtttaccggaaccgtaacgggaccgtaaagggacgtaaaacgttaccgaaaacgtacgtcgtacggtacctggaccctaccgtaacg

SEQ ID NO: 160840 - DNA, 250 bp, Homo sapiens
  misc_feature: GYAE6OF01CIMUP.22.27.C05.1.454.CMB.1.raw
  modified_base (248)..(250): a, c, t, g, unknown or other
  misc_feature (248)..(250): n is a, c, g, or t
tcagacatacgcgtcacgaccggtgctcgatttagacgcgatcgaagggtttgggacagatttcactctcaccatcagcagcctgcaggctgaagatgtggcagtttattactgtcagcaatattatattcctcctcagacgttcggccaagggaccaaggtgaaatcaaacgactgtggctgcaccatctgtcttcatcttcccgcatctgaacgcgtatgtctgagcggctggcaaggcgcatagnnn

SEQ ID NO: 160841 - DNA, 675 bp, Homo sapiens
  misc_feature: GYAE6OF01A85A1.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagtagttactttttacagtctaccaacaaataagagtactacttagtcttggttccagcaacgaaaccaggacactccctcctctactgctactatttacgtcgggtccgtaccgtaacccgggtaacgtccccgggtccctacggtaccgtacttcgacggtcggacgtaggtccgggtcgtagggactaacgtactttaccacctccgtacccaacctactaccgacgaccgtacgcccgttgacgacggtaccgtaggaagtacgtggtcgtaccgttagttttaacgttacgttcgacgtaacgtaaccttaagttaatttaaccttacctttcccttacccgtacgtaaccggtaccggttacgggtacccgaaacgggtacccgtaaagggtacgaaataccgaaacggacgttcgtacgggtctacggaccctaagtcgttacg

SEQ ID NO: 160842 - DNA, 530 bp, Homo sapiens
  misc_feature: GYAE6OF01CAYOK.22.27.C05.1.454.CMB.1.raw
  modified_base (524)..(524): a, c, t, g, unknown or other
  misc_feature (524)..(524): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtgctagtttattactgtcagcaattattatattcctctcagtaccgttcggacctaagggaccctaaagggtaggaaactcgaaaacgtaactaggtacggactaggccaaccgtnttaccg

SEQ ID NO: 160843 - DNA, 679 bp, Homo sapiens
  misc_feature: GYAE6OF01B2VQ2.22.27.C05.1.454.CMB.1.raw
  modified_base (349)..(349): a, c, t, g, unknown or other
  misc_feature (349)..(349): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagtagttatttttacagctccaaccaataagagctaacttagcttggttccagcaagaaaccaggacactcctcctctactgctcatttactggtcgtcgtaccgggatcccggggtcctgaccgntcgagtggcaggtcgggtcgtgggacagtatttccacctctaccaccgtatccgagccacgtcctcgaccgtacgggtctaggaacgtagttcgggtacggacgttaacggttttaacttacgtgttacgaacggtaactaaatttaacttaacgtttactttacccctcccgttacgaaccgggttaccccggtttaccgggaacccgttaaaaccgggggtaaccccgtaaaggggttaaccgggaaaaacttaacccggaaaaacccggttaaagttcggggttaacgggtacccgttaaggacccctaaacccgtgtttaacccgg

SEQ ID NO: 160844 - DNA, 673 bp, Homo sapiens
  misc_feature: GYAE6OF01E0AUM.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctcggggacatcgtgatgacccagtctccagactccctggctgtgtctctgggcgagagggccaccatcaactgcaagtccagccagagtatttttacagtctccaccaataagagctacttagcttggtccagcaacgaaccaggacactcctcctactactgctctatttacgtcgggtcgtccgtacccgggtaacgtcccggggttccctgacccgattcgaggttcggcgacggtccggggttcgtcgggggtaacaacggtactttcgaaccgttcctacctaccaatccgagtcccacggtccctaggaccagggtacctagaaagtacgtggtacggtaccttagtttttacgtatttcggtacaaggtactaaactttatttaactttactttccccttaccttacgaacggttacccggttaccgggaaccgttaaacgggggtaaccctaaaggggttacgaaaaccgttaccgaaaaacccggttaagtcgggtacggacccgtgacccgtaccttaaccgg

SEQ ID NO: 160845 - DNA, 651 bp, Homo sapiens
  misc_feature: GYAE6OF01BAM24.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagacgggccaccatcaactgcaagtccagccagagttatttttacagctccaccaatagagctacttagcttgttccagtcaagaacctaggacatcctcctactactgctactactttacgtcgggtcctacgtaccccggggtaaacttcccggggtccctcggaccgtattacgagtcggctacggcggtcgtacggggactagtactttccaacgtcctactacctagtccacgtaccgtaacgtcccgtacgtaccgagggtacctaggaaacgtagttaggtcggacgttagtttaacgttaccttggtaccaaggtcttaaacgtatttaacttacgttaccctaccgttccaaggttaccggttaccgaccgtaaacgggtacctaagggtaacggtaaacaacggtaaacccgaacgttcgggtacggtactcgtaaccgctaacg

SEQ ID NO: 160846 - DNA, 681 bp, Homo sapiens
  misc_feature: GYAE6OF01C8TCJ.22.27.C05.1.454.CMB.1.raw
  modified_base (126)..(126): a, c, t, g, unknown or other
  misc_feature (126)..(126): n is a, c, g, or t
  modified_base (197)..(197): a, c, t, g, unknown or other
  misc_feature (197)..(197): n is a, c, g, or t
  modified_base (642)..(642): a, c, t, g, unknown or other
  misc_feature (642)..(642): n is a, c, g, or t
tcagacatacgcgtcacgaccggtgctcgatttagacgcgatcgaagggtttgggggtaggcgtacaacaggcaggcagggcgagcaagatggtgttgcagacccaggtcttcactttctctgttnctctgatctctggtcgcctccgggactatcgtagatcgacccagtcctccagctcctggctcgtgtctcgngggcgagacggccacatcaactgacaacgtccagtccagtagttactttttacgagtctaccaacaaatacgagtactactagcttcggtaccaagctaacgaaccaggtactacgttaccctccgtacgtaactcggtacctacgtaacgttttacggtcgggtaccgttacccgtaacccgggtaacggttccccggggttacctacggtaccgtaccgttcgacggttacggcgtaacgggtccgggtacgtaggggacctaggtactttcacgtcctaccgactagtcaacgtcgacgtctgcgtaacggcgtagaagtacgtgcgtacgttagtttactacgtacgtaactagtactaagttattaccggttaacttcccgtagttaacctacgggtaccgttacggaaccgtaacgggtacgaaggttacggtaaaacncgtaaacgagttacggcgtactaacgccgtaaccttcgg

SEQ ID NO: 160847 - DNA, 658 bp, Homo sapiens
  misc_feature: GYAE6OF01AXSSF.22.27.C05.1.454.CMB.1.raw
  modified_base (309)..(309): a, c, t, g, unknown or other
  misc_feature (309)..(309): n is a, c, g, or t
  modified_base (406)..(406): a, c, t, g, unknown or other
  misc_feature (406)..(406): n is a, c, g, or t
tcagacatacgcgtcacgaccggtgctcgatttagacgcgatcgaagggtttgggggcgtacaaacaaggcaggcaggggcgagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcacgaaaccaggacactcctcctctactgctntactttacgtcgggctccgtacccgggaagtccgggtccctgaccgtattcagtggcgagcgggtctaggggacagtatttccacttctaccacctntacgacgcgacgtcctacgcgaacggcgttagaacgtagtgggtacggtacgttaacgtttttaacgtttacgttcggttactaacgtaccttaaaacgtttaatttaacgtttacctttccctaccccgtataaccggttaaccggttccggaaacccgtaaacgggggaacccgtaaggggttacggtaaaacgtcctaaaaacccgggtacttagggtaccggtcgtaagacccctacgtaacttccgg

SEQ ID NO: 160848 - DNA, 754 bp, Homo sapiens
  misc_feature: GYAE6OF01BF970.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgaggagggccaccatcaactgacaacgtccacgccgagtagtttatttttacgacgtcctaccaacctaaattaaggtaacgttttactttaacggtcgtttacgggttacccaagtaccgtaaacgaaaacccgtagggaacctaacgtccgtaccgtgcctaactcggtaccttacgtacgttttacggtcgggtacccgttaccggtaacccggggtaacggttcccggggttaccctacggtaaccgtacgttaccggaaggtcgggtaccgtacgggtccgggtcgtacggggtactacggttactttccgaccttccgtaccacctagttccgaggtccacgtcccgtagacgacgggtctaggaacgttggtcgtacggtactttaagttttaagttcggttacgactaaggtaacttagttaaacctttataccctttaccctcgtaaccgtacgggttacccgtaccgggaaccggtaaacgggtaccgtaaagggtaacggtaaaactacggaaaccgtagttcggagtacgtaccgaacgtcccgtag

SEQ ID NO: 160849 - DNA, 609 bp, Homo sapiens
  misc_feature: GYAE6OF01DJEJZ.22.27.C05.1.454.CMB.1.raw
  modified_base (560)..(560): a, c, t, g, unknown or other
  misc_feature (560)..(560): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgaggacgggccaccatacaactgacaagtccagccagtagttatttttacagcctccaaccaataagagctacttagtcttggttaccagacaagaaccaggacactcctcctctactgctactacttacgtcgggtcgtaccgtaccgggtaacgtccggggtccctggaccgtagtcgaggtggacgacggtcgggtcgtacgggactagtactttacgacttccgtacactacgtacgacgtcaccgtcctggaccgagggctaggaatgtggtacgtactagttttatacgtgtacagtactaatacgttatacttcctactactcggtaccgttcggaccgtaaagggaccgtaagggtaanaaccgtacgaaacgtaacgtggtaccgactacgactaccgtgtttaccg

SEQ ID NO: 160850 - DNA, 745 bp, Homo sapiens
  misc_feature: GYAE6OF01BPHEC.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccacaatagagctactagtcttggttcagacaagaaaccaggacactcctcctcctactcgtctactatttacgtcgggtcgttaccgtacccgggtaacgtccccggggttacccgtacggtaacccgtagttaccggtaggttcggacggtaacggtccggggttcgtacgggggtactaacggttactttaccgaccttccgtacctacccaagttaccgacgtaccgaacgtcccgtacgacgacggtctaagggaacgtcggttaggtacgggtacctttaaggtttttaacctacgttacggtacgtaacggtacttaaagttaactttaacgtttaccttcccgttacgtaccgtaacggtacccggtttacccggaaccggttaaacggggtaaaccccgtaaaggggttaaacggtaaacgtaaaccccggtaaaacggtaacccggtttacgggtaccgggttaccaacggaacccgttaacccgttaaccg

SEQ ID NO: 160851 - DNA, 597 bp, Homo sapiens
  misc_feature: GYAE6OF01EB9X4.22.27.C05.1.454.CMB.1.raw
  modified_base (456)..(456): a, c, t, g, unknown or other
  misc_feature (456)..(456): n is a, c, g, or t
tcagacatacgcgtcacgaccggtgctcgatttagacgcgatcgaagggtttgggggagctacaacaggctaggcaggggcagcaagatggtgttgcagacccaggtcttcatttctctgttgctctggatctctggtgcctccgggacatcgtgatgacccagtctccagactccctggctgtgtctctgggcgagagggccaccatcaactgcaagtccagccagagttatttttacagctccaccaataagagctacttagcttggttccagcagaaaccaggtacatcctcctctactgtctcatttactgggcgttcgaacccgggtccaacttccggggtccctagtaccgatttcgacgtgggccgagtcgggtctgggactagatttcacgtctacacctatcagctagccctagcctagggactggaagtgtgtaggtctaggtttnttacgtggtacaagtctaaatactttacgtctttcccgacgttctaacggtaccgttaaccgggccctaaagggggtaccctaaaaggtccggtaaaaactacgaaaccggtaacttcggtacggctccggtcgtaacccg

SEQ ID NO: 160852 - DNA, 567 bp, Homo sapiens
  misc_feature: GYAE6OF01EBC8G.22.27.C05.1.454.CMB.1.raw
  modified_base (454)..(454): a, c, t, g, unknown or other
  misc_feature (454)..(454): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctctatttacgtgggtcgtcgtacccgggaacgtcccggggtccctcgaccgattcgagtggcaggtcgggtcgtgggacagtactttcactctcacctatcgacgcacgtcctgcgaggctagaagtatgtcggacttagtttattactgtacngtactaattattaatcgtttcctcctacgacgtaccgtccgaccgaaagggtaccgaaagggtagaaactccgaaaacgtacgttagtcggactacggaccctactgttaccg

SEQ ID NO: 160853 - DNA, 630 bp, Homo sapiens
  misc_feature: GYAE6OF01ES20W.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatgacccagtctccagactccctggctgtgtctcgtgggcgagacgggccaccatcaactgcaagtccagccagtagttatttttacagcctaccaaccaaataagacgtaccttaacttacgcgtttggttaccagtacaagaaaccaggacactcctcctctactcgctactatttacgtggtccgtacgtaccgggacgtcccgggtcctcggtaccgtattcgaggtcggcgtacggcggtacgtgggactagtactttcacttctaccacctagtccacgctacgcctcgacgtacggctacggaatacgttggtcggtacttagttttactacgtagtacgagtaacgtaattacttacttacttccctaccgtacgaccggtccggttaccggacccgaaagggtacccgtaagggttaacaaactaccggaaacgttacgtgggtacgcctagaccgtactgttaccg

SEQ ID NO: 160854 - DNA, 629 bp, Homo sapiens
  misc_feature: GYAE6OF01CN5C9.22.27.C05.1.454.CMB.1.raw
  modified_base (465)..(465): a, c, t, g, unknown or other
  misc_feature (465)..(465): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatgaccagtctccagactccctggctgtgtctcgtgggcgaggaggccaccatcaactgacaagtccagaccagagttatttttacagctacaaccaataagagtctacttagcttggttccagacagaaaaccaggactaactcctcctctaactcgctctagtttacgtgggccgtcgtacccgggtaacgtcccggggtccctcggacccggtaattcgtaggtacggcgtacgtcggggtcgtagggacaggtatttccaactctacgacctagtcacgcagccctagcgaacgcgtagaaagtntggtagactaggtttaatacgtgtacagactaagtattatacgttccctctacgaagtaccgggttaccgaaccggtaaacggggaacccgttaaagggtacgggtaaaaacttacccgaaaaacgtaacgtacggttacggaccgttcgcctaaaccggttac

SEQ ID NO: 160855 - DNA, 577 bp, Homo sapiens
  misc_feature: GYAE6OF01C19XE.22.27.C05.1.454.CMB.1.raw
  modified_base (415)..(415): a, c, t, g, unknown or other
  misc_feature (415)..(415): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtttctgggcgagagggccaccatcaactgcaagtccagccagagttattttttacagctccaccaataagagctacttagcttggttccagcagaaaccaggacatcctcctctactgctcatttactgggcgtctacccgggaatcccggggtccctgaccgtattcagtggcagcgggtctgggacaggtatttcactctacaccatcagcagcctgcaggctgaagntgtggctagtttatattgtcagtactaattattattactttccttacctcaacgttaccgttaccggaccgtaacggggtaacccgtaaagggttaggaaaactaccgtaaaaaccgtaacgtcgggttacggtacgtacggaccctaaccgtacgttaccg

SEQ ID NO: 160856 - DNA, 676 bp, Homo sapiens
  misc_feature: GYAE6OF01DKVS2.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctactagcttggttccagcagaaaccaggacatcctcctctactgctcatttactgggcgtctaacccgggaatccgggaccgtccgtacgacgtactacgtaggtcgacgacgggtccggtcggacggtacgagtttacttacctaccgttacctaccgtaacctactacgacgtacgaccgtcgtcgaacggtacgtcgtaaggaacgtaggttcggtacgtacgtttaagttttacttacgtcgtaacgtacgtaaattaactttaagtttacttaacctttccctaccgtacgtaaccgttaccgggtacccggtaaaccgggtaaaccgggtaaaaccggttaagggtaaaggtaaaccgtaaaccgaaaacggttaacgttcgggtacgtaccgtacggtaaccctaacgttaaccg

SEQ ID NO: 160857 - DNA, 589 bp, Homo sapiens
  misc_feature: GYAE6OF01D6VNF.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagcctccaccaataagagcttacttagcttggttccagacaagaaaccaggacatcctcctctactgctctatttacgtggcgtccgtacccgggaactcccggggtccctgaccgtattcgagtggcaggtcgggtctggacagtactttcactctacaccatcagcacgcctgacgacggtctaggaagagtggtaggtacttagttttattattgtacagtacttaagttatttacttacttcctacctacgtaacgtacccggttacggaccgtaaacgggaccgtaaagggtacgaaactacgaaaaccgtacttacgggtcgacgtagaccctaacgtacttccgg

SEQ ID NO: 160858 - DNA, 635 bp, Homo sapiens
  misc_feature: GYAE6OF01ETWKB.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagagttatttttacagtcctccaccaataagagtctacttagtcttggttccagacaacgaaaccaggacactcctcctctactgctactactttacgtcgggtccgtaccgtaccccgggtaacgttccccggggtccctcggacccgtagttacgaggtcggcgaggtccgggtcgtcgggaacagtactttcactctaccaccatcagcacgccctgacgaggctaggatagtgtacgtacttagttttactcgtgtacaagtactaagttatttaacttacctttcctaccttacgaacggttaccggttaccggaaccgtaaacgggacccgtaaaggggtaacggtaaactaaccgaaaaccggtacgttacggtacggtaccctacggaccctaccgtaacg

SEQ ID NO: 160859 - DNA, 577 bp, Homo sapiens
  misc_feature: GYAE6OF01BMTP9.22.27.C05.1.454.CMB.1.raw
  modified_base (310)..(310): a, c, t, g, unknown or other
  misc_feature (310)..(310): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgcgatgacccagtctccagactccctggctgtgtctctgggcgagagggccaccatcaactgcaagtccagccagagtatttttacagctccaccaataagagctacttagttggttccagcagaaaccaggacatcctcctctactgctcatttacnggcgtcgtacccggaatccggggtccctgaccgattcagtggcgagcgggtctgggacagatttcacgtctcaccatcagcagtcctgccaggctaggaacgagttcggtggtactagttttacttacgttgtacaggtacctaattagttactttacgttccctccttactacggttaccgttccggaccgtaaagggacccgtaagggtaggaaaactacgaaaaccgtacgtaggtacggtccttagacctaccgtagttaccg

SEQ ID NO: 160860 - DNA, 586 bp, Homo sapiens
  misc_feature: GYAE6OF01AM5EC.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagtctaccaccaataagacgctacttagcttcggttccagacaagaaccaggacatcctcctctactgctctatttactgggcgtccgtacccgggacgtcccgggtccctgaccgtattcgaggtcggcacggtccgggtcgtacgggtacagtacttaccacgttctaccacctatcgagcagccctgcgaggctagagtgtggtcgacttagtttactacgtgtcaagtctaattacttactacttccctacctacgtacggtaccgttccggaaccgtaacgggaccgtaagggtaacgaaactacgaaaccgtacgttaggtcggactcgacctaccgtacg

SEQ ID NO: 160861 - DNA, 514 bp, Homo sapiens
  misc_feature: GYAE6OF01CHPKW.22.27.C05.1.454.CMB.1.raw
  modified_base (309)..(309): a, c, t, g, unknown or other
  misc_feature (309)..(309): n is a, c, g, or t
  modified_base (409)..(409): a, c, t, g, unknown or other
  misc_feature (409)..(409): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccacaataagagctacttagcttggttcagcagaaccaggacatcctcctctactgctcatttacnggctctacccgggaatccggggtccctgaccattcagtggcaggcgggtctgggacagtatttcactctcaccatcagcagcctgcaggctgagatgtgntagttattactgtacagcaattattatacttcctctctagtacgttcgacgaagggaccctaaggtacggaaatacgaaacgtactacggtagactgacacgtac

SEQ ID NO: 160862 - DNA, 649 bp, Homo sapiens
  misc_feature: GYAE6OF01E3LIH.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgaggagggccaccatcaactgcaagtccagccagtagttatttttacagtcctaccaaccaataagagctacttagcttggttccagcaagaaaccaggacatcctcctctactgcctactactttacgtgggcgttaccgtaacccgggtaacgtcccggggtccctacggacccgtattcgaggtcggcgacggtcggggtacgtggggaccaggtactttcaccgttctaccacccgtataccgagccacggcctacggacgtacgggactagggaagtcgttacgggtcgtacgtaagttttacgtacgttgtcaaggtactaaattactttattacctttccctaccgtactaacggtccgtttaccggaaccgtaaacggggtacctaaaggggtacggtaaaactaccgaaaaggtaccgtggtacggacctcggacctacgtaccg

SEQ ID NO: 160863 - DNA, 655 bp, Homo sapiens
  misc_feature: GYAE6OF01DLYL8.22.27.C05.1.454.CMB.1.raw
  modified_base (336)..(336): a, c, t, g, unknown or other
  misc_feature (336)..(336): n is a, c, g, or t
  modified_base (399)..(399): a, c, t, g, unknown or other
  misc_feature (399)..(399): n is a, c, g, or t
  modified_base (493)..(493): a, c, t, g, unknown or other
  misc_feature (493)..(493): n is a, c, g, or t
  modified_base (561)..(561): a, c, t, g, unknown or other
  misc_feature (561)..(561): n is a, c, g, or t
tcagacatacgcgtcacgaccggtgctcgatttagacgcgatcgaagggtttgggggagctacaacaggcaggcgaggggcagcaagatggtgttgcacgacccaggtcttctatttctctgttgctctggatctctggtgccgtccggggacatgtgatcgacccagtcctccagacctcccgtggctgtgtctcgtgggcgaggacgggccaaccatacaaactgacaacgccagaccaggtatttatttttacacgtcctaccaaccaaataaagtacgttaacttagtcttggttaccagacaacgaaaccaggacatccgtcctgcacgtnctactattacgtgggcctacgtaacccgggtaagtcccgggtcctacgaccgtattacgaggngaccgaggcgggtcgtaggggacctaggtactttaccgacttcctacaacccgatacgacgacacgtcccgtgaccgaggcctaagggaaagtntcggtaggaccttaaggttttaacttagtgtaacagtactaaagtttactagttacttccctaccgtnaacggttccggttaccgaaccgtaaagggaacccgtaaagggtagaaaaccttacgaaaaactacgtcgtacggtccaatcccgtaagttaccg

SEQ ID NO: 160864 - DNA, 586 bp, Homo sapiens
  misc_feature: GYAE6OF01B5KQ0.22.27.C05.1.454.CMB.1.raw
  modified_base (314)..(314): a, c, t, g, unknown or other
  misc_feature (314)..(314): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagagttatttttacagctccacaataagagctacttagcttggttccagcaagaaccaggacatcctcctctactgctactactttacgnggtccgtccgtacccgggtaagtccccggggtccctacggaccgacttcgagtcggcacggtcggtcgtgggactagtactttcgactcctctaccaatccgagcagcctgacgacggtactagaagtactggtcgacttagtttattacctgtcgagtactaagttatttacgtactttccctcttacgaacgtaccgttaccgggaccgtaaagggaccgtaagggtagaaactacgaaacgtactggtacgtcgagccaacgtgttccg

SEQ ID NO: 160865 - DNA, 621 bp, Homo sapiens
  misc_feature: GYAE6OF01DSW8Y.22.27.C05.1.454.CMB.1.raw
  modified_base (324)..(324): a, c, t, g, unknown or other
  misc_feature (324)..(324): n is a, c, g, or t
tcagacatacgcgtcacgaccggtgctcgatttagacgcgatcgaagggttttgggggctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacacgtctaccaccaaataagagtttacttagtctttggttccagacaagaaaccaggacatcgtcctgcactgctctatttacgngggctcgtacccgggtagtccgggtcctgaccgattcagtgcaggcggtctggactagtatttcactctcacctatcaacgcacgtccctgcgagcgtagaagtgtgtggaccttagtttttactagtttcgtcaagtacctaagttttaacttacgttaaccttcccgttaccctacgtaacggtaccgtttaccgggaacctaaagggggacccgtaaaggggttactaaaacgtacgtaaaaaccggtacgttacggttaccggacttacgaaccctaccgtaaggtttacccg

SEQ ID NO: 160866 - DNA, 639 bp, Homo sapiens
  misc_feature: GYAE6OF01COQQE.22.27.C05.1.454.CMB.1.raw
  modified_base (431)..(431): a, c, t, g, unknown or other
  misc_feature (431)..(431): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgctcatttactgggtcgtccgtacccgggaactcccggggtccctggaccgtattcaggtcggcgaggcgggtcgtgggacagtactttacgacttcgcaccatcagcacgcctgacgtaggactaggaagngttggtggtacgtaagttttactacgttggtactaagtacctaaagttaatttagttaaccttcccttcctaccgtaacggtacccgtttacgggaacccgtaacggggtaaccgtaacggggttaacggtaaaaacttaccggtaaaaaccggtaccgtttaggggtaccggtaccgttacggtaccctaaccgtacgtttacccgg

SEQ ID NO: 160867 - DNA, 664 bp, Homo sapiens
  misc_feature: GYAE6OF01ENTKZ.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctccctggctgtgtctctgggcgagagggccaccatcaactgcaagtccagccagtagttatttttacagcctccaaccaataagagcttacttagcttggttccagcaagaaaccaggacactcctcctctactgctactattacgtgggcttaccgtaaccccgggtaacgtccccggggtccctcggtaacccgtacgttccgaaggttggaccgtaggtccgggtcgtaggggaccagttactttccactcctccaaccgtactccaagcctaacgcccgtgacgaggacgttaggaacgtgttcggtacggtcttaaggttttacttacggtgtacgaagtactaaattatttaacttctttaccctaccttaccgtaacggtaccgttaccgggaaccgtaaacggggtaaccgtaagggtaacggtaaactaacccggtaaaaccggtaacgttcgggtacggtactaccggcctaaccgtacg

SEQ ID NO: 160868 - DNA, 564 bp, Homo sapiens
  misc_feature: GYAE6OF01B6D26.22.27.C05.1.454.CMB.1.raw
  modified_base (419)..(419): a, c, t, g, unknown or other
  misc_feature (419)..(419): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagctttggttccagcagaaaccaggacatcctcctctactgctcatttacgtggtcgtcgtaccccgggaatcccggggtccctgaccgtattcagtcggcaggcggtctgggacagtatttcacttctcaccatcagccagcctgcaggctgaagngtgtggctagttttactactgtacagtactaattattaattactttccctacttctagtaccgttaccggaccgtaacgggtaccgaaagggttacggaaacttaccgaaaacgtacgtacggtacggactacgccaccgtaacg

SEQ ID NO: 160869 - DNA, 563 bp, Homo sapiens
  misc_feature: GYAE6OF01EUK57.22.27.C05.1.454.CMB.1.raw
  modified_base (309)..(309): a, c, t, g, unknown or other
  misc_feature (309)..(309): n is a, c, g, or t
  modified_base (335)..(335): a, c, t, g, unknown or other
  misc_feature (335)..(335): n is a, c, g, or t
  modified_base (408)..(408): a, c, t, g, unknown or other
  misc_feature (408)..(408): n is a, c, g, or t
  modified_base (429)..(429): a, c, t, g, unknown or other
  misc_feature (429)..(429): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctcagactccctggctgtgtctctgggcgagagggccaccatcaactgcaagtccagccagagttattttttacagctccaccaataagagctacttagcttggttcagcagaaaccaggacatcctcctctactgctcatttacnggtcgtcgtaccggatccggggtccncgaccgattcagtgcagcgggtctgggacagtatttcgactctcacctatcagcagtcctgcgaggctgaagntggtgctagtttacttacgtntacagtactaagttacttaattactttccctaccgtacgagtaccggttcggaccgtaaacgggaaccgtaaagggtagaaaacgtacgaaaacgtaacgttaggtacggcgttacgacctaccgtaagttccg

SEQ ID NO: 160870 - DNA, 650 bp, Homo sapiens
  misc_feature: GYAE6OF01CZHR6.22.27.C05.1.454.CMB.1.raw
  modified_base (388)..(388): a, c, t, g, unknown or other
  misc_feature (388)..(388): n is a, c, g, or t
  modified_base (516)..(516): a, c, t, g, unknown or other
  misc_feature (516)..(516): n is a, c, g, or t
  modified_base (537)..(537): a, c, t, g, unknown or other
  misc_feature (537)..(537): n is a, c, g, or t
  modified_base (604)..(604): a, c, t, g, unknown or other
  misc_feature (604)..(604): n is a, c, g, or t
  modified_base (637)..(637): a, c, t, g, unknown or other
  misc_feature (637)..(637): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctcccgtggctgtgtctcgtgggcgaggacgggccaccatcaactcgacaagtccagacctagtagtttactttttacagtctaccaacctaataagacgtctaacttacgtcttagtccagtaacgaacgagactactccctcctctactgtcctactactttacgtcggtaccgtacgtacccgggtacgtcccgggtacccgtagtaccgtntttacgaggtcggtcgacgggtccgggtcgtacgggactacgtacgtttacacttccgacaacctactaccgacgctaccgcgtcgagacggtactacggaagtgttaggtcggtacttaaggttttnacgtgtacagtaactaagttntaacgttacttcctacctagtacgtaccggttacggaacgttaacgggacgtaagggtagtaaaacnccgtaaacgagttcggacggtactaccgtaacncccgtattaccgg

SEQ ID NO: 160871 - DNA, 711 bp, Homo sapiens
  misc_feature: GYAE6OF01DZ7IW.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatcgacccagtctccagacctcccgtggctgtgtctcgtgggcgaggacgggccaccatcaactgacaacgtccagccagtagttattttacagacctaccaaccaataagagtcttacttagtcttcggttccagcaagaaaccaggacactcctcctctactgctactatttacgtcgggtcgttaccgtaacccgggtaacgtccccggggtaccctcggaccgtacttcgaggtcggacgaggtcgggtcgtgggacagtactttccactcctaccacctatcgagtcacggtcctggcgaaggtcctaagaacgtagttgggtacggtactttaagttttagttactggtaccgtagtaacgttaagtttaacgtttaaacgtttaccggtcgggtaccccgttacgggtaacccggttaccggggaccgtaaaaacccgggggtaccggttaaagggttaccggggaaaacccgttaaccgtaaaaacccgggtaagtttcgggaccgggtacgttaacccgacccgtaacccttaagttccggttacccg

SEQ ID NO: 160872 - DNA, 799 bp, Homo sapiens
  misc_feature: GYAE6OF01CI519.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctccctggctgtgtctcgtgggcgagagggccaccatcaactgcaacgtccagaccagtagttatttttacagcctaccaacaataacgagtacttacttaagtccgtttaggttccaggacaacgaaacccaaggacctaactccctacctccttacctcgtcctactattttaccggcgggtccgttaccgtacccgggtaacgtccccggggtccctacggtaccgtacttacgtacggttcgacgtacgggtccggtacggtagggactaggtactttccaccgttcttaccaacctacgttacgaacgaccgtacgtacccgtacggtaccgtaaacgggtaccgttagggaaaacggtccggtttagggttaacggtaccggttttaacgttttaacgtttacccgttagggttaaccctaaaggtaaacttaaacgttttactttaactttaaccctttacccttcccgttaacgttagttaaccccggggttaccgaaacccgggttaaaccggggtaaacccgtaaagggttaacggttaaaaccgttaaaccggtaaaacccggttaaacgttacgggttacggtaccccggttacggtaaccctaccgttaaacg

SEQ ID NO: 160873 - DNA, 687 bp, Homo sapiens
  misc_feature: GYAE6OF01D408V.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgacaagtccagccagtagttattttttacagtctaccaaccaaataagagctacttagcttggttccagacagaaaccaggacactcctctactactgtctctatttacgtgggtcgtaccgtacccgggtaacgtcccgggtccctacgaccgtattcgaggtcggacgacggtcgggtcgtagggacagttactttccgaacttcctaccacctataccgacgcacgtcccgtcgacgacggtactaaggaagtgttcggtaggtacttaagtttacttacgtgtacaggtactaagtttatttaacgttccttccctaccgttacgtaacggttaccggtttacccgggaacccggtaaaaccggggtaaccggtaaaggggttaacggtaaaaaccgttaaccggaaaaccggttaaccgttacggggtacgttaacccggtaccggtaacccgtaaccgttaacccgg

SEQ ID NO: 160874 - DNA, 742 bp, Homo sapiens
  misc_feature: GYAE6OF01AS3DZ.22.27.C05.1.454.CMB.1.raw
  modified_base (319)..(319): a, c, t, g, unknown or other
  misc_feature (319)..(319): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccgggggacatcgtgatgacccagtctccagactccctggctgtgtctctgggcgagagggccaccatcaactgcaagtccagccagagttatttttacagtctccaccaataagagctacttagcttcggttaccagcacgaaaccaggacatcctcctctactgctctatttacgngggtctccgtacccggtacgtcccgggtccctggaccgtattcgaggttcggcgacggtccgggtcgtacggggactaggttactttaccgacgttacctacctaacccgtacttacccgacgtaccccgtacgtaccccgtcggaccgtacgggtaccctagggaaacgtacgtcgggttcggtacgtttaacggttttacgtttacgttcgtacgtaacgttacctaaagttttactttaactttacctttaccccgttaccttacgttaacgggtacccgtttaccgggaaacccgggtaaacggggtaaaccccggttaagggggttaaaccggtaaaacgttaaacccggtaaaaccggttaacccggttacgggttaaccgggtaccgtttaccgggaacccgtaacccgtttacgg

SEQ ID NO: 160875 - DNA, 680 bp, Homo sapiens
  misc_feature: GYAE6OF01DA31D.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagagttatttttacagctccaacaataagagtactacttagtcttggttaccagacaacgaaccaggacactcctctactactcgtctctatttacgtcgggtcgtaccgtaacccgggaacgttcccgggtccctacgaccgtacttacgaggtcggcgacggtcgggtcgtggggactaggtactttctacgtcttaccaccgactacacgtcacgtcctgacgtaggcctaggaagtagtgtggtaccttaaggttttactaacttgtaaccgtagtaacttaaatttacgtttaacttacctttacccttcgtaccgtaaacggttacccggttaccggaacccggaaaacggggtaacccggtaaaggggttaaccggtaaaaactaaaccggtaaaaaccgtaaaccggttgggtaccggtacgtaccggtaacccgtaccgttaacg

SEQ ID NO: 160876 - DNA, 746 bp, Homo sapiens
  misc_feature: GYAE6OF01B1H8Q.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatcgacccagtcctccagacctccctggctgtcgtctcgtgggcgaggacggccacatcaactgacaacgtccagccaagtagtttaatttttacacgcctaccaactaaataagtacttacttagtcgttggttaccagacaacgaaaccaggactactaccgtcctcgacctacgtctccttacgttactttacggtcgggtacccggtaccgttaaccccggggtaaccggttccccggggttaccgtaaccggtaacccgtaacgttccggtaagggtccggacgacggggtccgggttaccgtaggggtaaccgagttacgttacccgaccgttacctacccacctagtccgaagccgtaccgtcctaggcgaacggtacgaggaaacggttgtcggttaggtacctttaagttttaacttcgttacggtactaagtacttaaacgttacttacttacccttccgtaccgtacgtacgggttacccgtaccggtaaccggaaaacgggtaccgtaagggtaacgtaaaccgtaaaccgtaaacgaccgggttaggtaccgtaaccgccgtacgtaaacccttcgg

SEQ ID NO: 160877 - DNA, 728 bp, Homo sapiens
  misc_feature: GYAE6OF01BSV16.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttgtccagcagaaccaggacatcctcctctactgctactatttacgtcgggcgtccgtaaccccgggtaacttcccggggtaccccttggaacccgtattccgaggttcggccgtaacggtccggggtctacggggaactacggtacgttttaccaaccgttcctaccgaaccctaacttccgaaacggccgaaccggtccccttagggacccgtaaacggggtacccgttacgggaaacgtacggttggttagggtacccgttaagttttttaacgtaaccgttcgggtacctaaggtactaaaatttacgtttaattaaccgttttccctacctacgtaacggtaccggtttcccggaaccggtaaaacggggtcccaaaagggtttaccggaaaaagttacccggaaaaacccggttacgttacggttacgggacccttacgggtaccaacccggtttaac

SEQ ID NO: 160878 - DNA, 629 bp, Homo sapiens
  misc_feature: GYAE6OF01AU16L.22.27.C05.1.454.CMB.1.raw
  modified_base (435)..(435): a, c, t, g, unknown or other
  misc_feature (435)..(435): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagacgttatttttacagcctaccaccaataagacgtactacttagcttggttccagacacgaacagacactcctcctctactgctctattacgtggctacgtacccggtagtccgggtcctcgacgtattcgagtcggcgacggcggtacgcgggacagttacttaccgcgtactacgactatccgagcgtacgccctaggtcgaacggntacgtaaggacgttcggtaggtacttaacggtttaagtttactcgtacgtaaggaccttaagttaactttacttacgtttacccgttcctaaccgtacggtaccgttaccgggaacctaaaccggggtacgtaaagggtacgtaaaacgtactaaaccgggagttacgggtacgtactcgaacctccgttaacg

SEQ ID NO: 160879 - DNA, 559 bp, Homo sapiens
  misc_feature: GYAE6OF01B5ZXP.22.27.C05.1.454.CMB.1.raw
  modified_base (319)..(319): a, c, t, g, unknown or other
  misc_feature (319)..(319): n is a, c, g, or t
  modified_base (412)..(412): a, c, t, g, unknown or other
  misc_feature (412)..(412): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcatgatgacccagtctccagactccctggctgtgtctctgggcgagagggccaccatcaactgcaagtccagccagtagttatttttacagcctccaaccaataagagctaactagcttggttcccagtcaagaaaccaggacactcctcctctactgctcatttacngggctcgacccgggaatcccgggtcctgaccattcgagtggcaggcggtcgtgggacagtatttccgactctccgaccatcagcagcctgacngactgaagtgtgtaggctagtttactcgtgtcagctaagtactttagtacttccctaccacgtaagtaccgttacggaaccgtaaacgggacctaaagggtacggaaaacgtacaaaacgtacgtaggtacggctccgactaacccg

SEQ ID NO: 160880 - DNA, 618 bp, Homo sapiens
  misc_feature: GYAE6OF01ESEN5.22.27.C05.1.454.CMB.1.raw
  modified_base (470)..(470): a, c, t, g, unknown or other
  misc_feature (470)..(470): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccttccggggacatcgtgatgacccagtctccagactccctggctgtgtctctgggcgagagggccaccagtccaactgcaagtccagccagtagttatttttacagtctaccacaataacgagctacttagcttggttccagcagaaaccaggacatcctcctctactgctcatttacgtggcgtctaccgggatccgggtcctgaccgtattcagtggcaggcggtactgggacaggtactttacgacttctaccacctagtaccgagtaccaggtccctcggacgaacggaccttaggaacgtagtggtggacttaggtttactttaacgngtacagaacttaattacgttaattaccgttccctacctagtaacggtaccgtttaccggaccgtaaacgggtacccgtaaaggggttacgaaaacttcggaaaaaccgttctcgggttacgtacgttcggaaccaccgttgttacccg

SEQ ID NO: 160881 - DNA, 596 bp, Homo sapiens
  misc_feature: GYAE6OF01EMF7H.22.27.C05.1.454.CMB.1.raw
  modified_base (316)..(316): a, c, t, g, unknown or other
  misc_feature (316)..(316): n is a, c, g, or t
  modified_base (366)..(366): a, c, t, g, unknown or other
  misc_feature (366)..(366): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctactagcttggtccagacaacgaaaccaggactactcctcctctacctgctctatttacngggcgtcgtaacccggtaatccggggtccctgaccgtattcagtcggacnggcgggtctggggacaggtctttacacttctaccacaatcaacgctacgccgtgaccaagggtctagaagtatggtaggtacctagttttaacttactgtacgtagtactaaagttatttaattattaccctctacgtaggtaccgttcggaaccggaaagggtacccgtaaaggtaacgggaaaactacgtaaaacgaccgttgtacgggacttacggctaaccgtaag

SEQ ID NO: 160882 - DNA, 556 bp, Homo sapiens
  misc_feature: GYAE6OF01CO928.22.27.C05.1.454.CMB.1.raw
  modified_base (281)..(281): a, c, t, g, unknown or other
  misc_feature (281)..(281): n is a, c, g, or t
  modified_base (376)..(376): a, c, t, g, unknown or other
  misc_feature (376)..(376): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccnggacatcctcctctactgctcatttactgggcgtctacccgggaatccggggtccctgaccgattcagtggcaggcgggtctgggacagatttcnctctcaccatcagcagcctgcaggctagaagatgtaggctagtttacttactgtacagacaattattatacttccctcctctacggtaccgttcggacctaagggaacctaagggtaggaaaacttccgaaaaaccggtaacgttcggtacggtactaggaccctaaccgagtttacccg

SEQ ID NO: 160883 - DNA, 540 bp, Homo sapiens
  misc_feature: GYAE6OF01ATH1O.22.27.C05.1.454.CMB.1.raw
  modified_base (383)..(383): a, c, t, g, unknown or other
  misc_feature (383)..(383): n is a, c, g, or t
  modified_base (407)..(407): a, c, t, g, unknown or other
  misc_feature (407)..(407): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctacgggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactggcgtctacccgggaatccgggtccctgaccgattcagtgcagtcgggtctgggacagtatttcactctcacntcagcagctgcagcagagatgcgnagtttatatgtcagacaatagttatactttcctcctacgtagtacggtttaccggacctaaaggggaccctaaggggtacgtaaaacttaccaaaacggtaacgttgtacggaccttcggacctaaccgtacg

SEQ ID NO: 160884 - DNA, 580 bp, Homo sapiens
  misc_feature: GYAE6OF01EHF08.22.27.C05.1.454.CMB.1.raw
  modified_base (419)..(419): a, c, t, g, unknown or other
  misc_feature (419)..(419): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagtagttattttttacagtctaccaaccaataagagctacttagcttggttccagcaacgaaaccaggactactcctcctctactcgctctactttacgtcggtccgtaccgtacccgggaacgttccccggggtcctcggaccgtattcgaggtcggcgaggtcgggtcgtaggactagtatttcactctcactntacagcagcctgcgaggctagaagtagtggtcgtacttaggttttactacgtgtacagtactaattattacttacttccctactacagtaccggtcggaccgaagggaccgaaggtagaaactacgaaacgtcgtaggtacgacgtagaccactcgttacg

SEQ ID NO: 160885 - DNA, 820 bp, Homo sapiens
  misc_feature: GYAE6OF01ENRNM.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctccctggctgtgtctcgtgggcgagagggccaccatcaactgacaacgtccagccagtagttatttttacagtcctccaaccaataagagacttaacttagtcgtttcggtaccagtacaacgaaaccaggacactccctcctctactgcctactactttacgtcgggtccgtaccgtaccccgggtaacgttccccggggtccctcggtaacccgtattcgaggtcggccgacgggtccgggttcgtaggggaccaggttactttaccaccgttaccctaccctaacccgtaactacccgaacggtaccgtaacggtccccgtaggaccgtaacgggtccgttaagggaaaccggttaaggttcggttacgggtaccgttttaacgggtttttaaccttttaccgtacggttaccgtaacgtaaccgttaaaagtttaacgttttaaacgtttaacccgtttaccccgttacccttaaccgggtaacggtttaaccccgggttttacccggggaaacccccggttaaaaccgggggtaaaccccggttaaaaggggttaaaccggtaaaaccggttaaacccggtaaaaccggtaaccgttacgggttaccggtaaccgtaccgtaacccgtaacccgttaaccg

SEQ ID NO: 160886 - DNA, 746 bp, Homo sapiens
  misc_feature: GYAE6OF01CW07E.22.27.C05.1.454.CMB.1.raw
  modified_base (110)..(110): a, c, t, g, unknown or other
  misc_feature (110)..(110): n is a, c, g, or t
  modified_base (151)..(151): a, c, t, g, unknown or other
  misc_feature (151)..(151): n is a, c, g, or t
  modified_base (164)..(164): a, c, t, g, unknown or other
  misc_feature (164)..(164): n is a, c, g, or t
  modified_base (519)..(519): a, c, t, g, unknown or other
  misc_feature (519)..(519): n is a, c, g, or t
tcagacatacgcgtcacgaccggtgctcgatttagacgcgatcgaagggtttgggggcgtacaacaggcaggcaggggcagcaagatggtgttgcagacccaggtcttcntttctcctgttgctctggatctctggtcgccgtccgggacntcgtgatgacccncgtctccagtcctccctggctgtcgtctcgtcgggcgagacggaccaccactacaacgtcgaccgaagtaccgacgtacgtaagtacgtttatttttaacgacgtacctacctaaaccaaagttaaacgcgtaccttaacgttacgtacgtttacgggtaccaacgaccgtaaacgtaaaccgtacggtacctaacttacccttacctaccgtacctcgtacctacgttaacgttttacggcgggtaccttacccggtaacccgggtaaccgttccccgggtccttacgaccgtacgttacgacgtcggacgcggtacgtcggaggtacgtagtacttacacgtctacaaccgtntaccgagacgtacgctggaccgagtcgtaagaagtcgttacggtacgtacgtttaacgtttcgtacgtgttaaccgtaggtaaacctttaattaagttacccgtactttccccgtaccgttacgaacggtttacccggttacccgacgggtaaacccgtacgaacggttaacgaaaccttaacggaaacccgtcgttacggacgtactaccggactggtcttaccgg

SEQ ID NO: 160887 - DNA, 558 bp, Homo sapiens
  misc_feature: GYAE6OF01EIEZR.22.27.C05.1.454.CMB.1.raw
  modified_base (342)..(342): a, c, t, g, unknown or other
  misc_feature (342)..(342): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagctttggtccagcaagaaaccaggacatcctcctctactgctctatttactgggcgtctacccgggaactccgggtcccngaccgattcagtgctaggcggtctgggacagtactttcactcgtcaccatcagccagtcctgcaggctagaagtgtgtggactagttttacacgtgtcaagactaatatttactacttcctaccgtcgtagtaccggttaccggaccgtaacgggacctaaggggtacgaaactaaccgaaaggtacgttcggtacggactcggaccctacgtacg

SEQ ID NO: 160888 - DNA, 660 bp, Homo sapiens
  misc_feature: GYAE6OF01APCE5.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagacgggccaccatcaactgacaacgtccagccagtagttactttttacagtcctccaacctaaataacgagtccttaacttacgtcttggttccagtacaacgaaaccaggaactacgtccctcctactacctcgcctctaactttacgtcgggtccgttaccggtacccgggtaacgttcccggggtccctcggtaccgtacgttcgaggtcggccgaggtcgggtcgtggacgtagtactttacgacttcctacacctatacgtacgctaccggtcctacggaccgtaggtcgtaggaacgtacgtcgggttcgtacgttagtttactaccgtgtactagtaactaattacttattacttacccttctacgtacgtaccggttacgaccggtaacgggtaaccgtaagggtaacgaacgtacgaaacggtcttacgggtacgtactagacctacgtgttaccg

SEQ ID NO: 160889 - DNA, 494 bp, Homo sapiens
  misc_feature: GYAE6OF01A5I5C.22.27.C05.1.454.CMB.1.raw
  modified_base (368)..(368): a, c, t, g, unknown or other
  misc_feature (368)..(368): n is a, c, g, or t
  modified_base (384)..(384): a, c, t, g, unknown or other
  misc_feature (384)..(384): n is a, c, g, or t
  modified_base (492)..(492): a, c, t, g, unknown or other
  misc_feature (492)..(492): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctggacngatttcactctcaccntcagcagcctgcaggctgagatgtgcagtttatactgtcagcaatatttatattcctctcagtcgttcgaccaagggaccaaggtgaaatcaaagactgtgctgcacntc

SEQ ID NO: 160890 - DNA, 550 bp, Homo sapiens
  misc_feature: GYAE6OF01D3PX5.22.27.C05.1.454.CMB.1.raw
  modified_base (441)..(441): a, c, t, g, unknown or other
  misc_feature (441)..(441): n is a, c, g, or t
  modified_base (447)..(447): a, c, t, g, unknown or other
  misc_feature (447)..(447): n is a, c, g, or t
  modified_base (458)..(458): a, c, t, g, unknown or other
  misc_feature (458)..(458): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgacaagtccagccagagttatttttacagcctccaccaataagagctacttagcttggttccagcagaaaccaggacatcgtcctgcactgctcatttacgtggcgtcgtacccgggaagtcccgggtcctgaccgattcgagtcggcaggcgggtcgtgggacagtattcactctcactatcagcagcctgcaggctagaacgtgtgtggactagttttatattgcagntaattnttatacttccnctacgtagtcgttaccggacgtaaacgggacctaaagggtacggtaaaactacccgaaaacgtacgtggtacggtactcgaccgtacctacg

SEQ ID NO: 160891 - DNA, 712 bp, Homo sapiens
  misc_feature: GYAE6OF01DTC0U.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagtagttatttttacacgcctaccaaccaataagacgtctacttagtctttggttccagacaagaaccaggacactcctctctactgctctatttacgtggtcgtccgtacccgggacgtcccgggtcctcggacccgtattcgaggtcggcgtacggtcgggtcgtacgggactagtactttaccacgttcctaccgacctacgtaccgacgtacctacgccctggaccgtacgggtactacggaaacgtacgtcggttagggtacctttaaggtttttaactttaagttcgttaaccgtaacggttacttaaaatttacgttttaactttacctttaccccttccgttaccgtaacggttaccgggtttacccggaacccgggtaaaccggggtaacccgtaaaggggttaaacgggtaaaaccttaaccggaaaaccggttaacgttacgggtaccggtacgtacggaccctacccgttaacg

SEQ ID NO: 160892 - DNA, 810 bp, Homo sapiens
  misc_feature: GYAE6OF01DIW0B.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtcgccgtccggggacatcgtgatcgacccagtcctccagacctcccgtggctgtgtctcgtgggcgaggacgggccaccatacaactcgacaacgtccacgacctaaggtagttttaactttttacacgtcctaccaacctaaagtaagacgtcttacttacgtctttcggtaccagacaagaaccagacactcctacctctactcgtacctcttacgttacgtcggtaccgttacccggtaacccgggtaccggttccccgggtacctaccggtaccgtacgtacggtacggtcggacggtacgggtccgggtcggtacgggacgtacgttacttacctacctaccgtaccaaccgtaactccgaacggtcctaacggtcccgttacggaacggtacgggtacgtaaggtaacgtgttcggggtacgttaaccgttttaacgtttaacgtttacgtggtaacctaacgttaacttttaaactttactttacctttaccctttccccgttaccgtaacggttaaacccgggttcccgggttaaacccgggtaaaccgggtaaaaccgggggttaacgttaaacggggttaaaaccggtaaaccctaaaaccgggtaaaccggttacgggttacgggtaccggtacccgtaaccggtaacccttaccgtttaccg

SEQ ID NO: 160893 - DNA, 659 bp, Homo sapiens
  misc_feature: GYAE6OF01DARXQ.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatcgacccagtctccagactccctggctgtgtctcgtgggcgagagggcccaccatcaactgcaagtccagccagtagttatttttacagctccacaataagattactagcttggttccagcaagaaaccaggacatccgtcctgcactcgctctatttacgtgggtccgtaccgtaccccgggtaacgtcccgggtcccgtacgaccgtattcgacggtggcgaggtccgggtcgtacgggaccgtagtactttccacgttctaccaacccgactaccagaccgacgccctagccgaaggcctagaaggtacttggcggtactttaaggttttatttagttcgtacgtaagtactaaatttattaacgtttacctttaccccttaccgttacgtaacggttaacccgttaccgggaccgtaaacgggtaaccgtaaggggtaaacggtaaaactaaccgaaaaccgtacgttacggtacggacttacgaccgtaacccgtacg

SEQ ID NO: 160894 - DNA, 594 bp, Homo sapiens
  misc_feature: GYAE6OF01CGJSG.22.27.C05.1.454.CMB.1.raw
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (575)..(575): a, c, t, g, unknown or other
  misc_feature (575)..(575): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccaatcaactgacaagtccagaccagagttatttttacagctccaccaataagagctacttagcttggtccagacaacgaaaccaggacatcctcctctactgctctatttacgtggcgtcgtacccgggaagtcccgggtccctgaccgtattcgagtggcaggcgggtctgggacagtattcactctcaaccatcagcacgcctgcaggctagaantgnggtactagtttactactgtaccagtactaaattattaacttaacttcccttacctacgtaacggttaccgttccgggaaaccgtaaacggggtaaaccaaagggttaacggaaaaactaaccgtaaaacggtaaaccgttggaaacggtntaccgtccgaaccttaacg

SEQ ID NO: 160895 - DNA, 574 bp, Homo sapiens
  misc_feature: GYAE6OF01BYXQP.22.27.C05.1.454.CMB.1.raw
  modified_base (386)..(386): a, c, t, g, unknown or other
  misc_feature (386)..(386): n is a, c, g, or t
  modified_base (568)..(568): a, c, t, g, unknown or other
  misc_feature (568)..(568): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagacgggccaccatcaactgcaacgtccagccagagttatttttacagtctccaaccaataagagctacttagcttggttccagcaagaaaccaggacatcctcctctactgctctatttacgtgggctcgtacccgggaagtcccggggtcctcgaccgtattcgagtcggcgaggcgggtctgggacagtnttcactctcaccatcacgcacgtcctgacgaggctaggaagtagttgtggtcttagtttacgttactgtcagtactaagttattaattcttccctcctacgtaacggtccgttccggaccgtaacggggaccgtaagggtaagaaactaccgtaaacgacgtggtacggctacgtcaccgtnttaccg

SEQ ID NO: 160896 - DNA, 609 bp, Homo sapiens
  misc_feature: GYAE6OF01CEWRH.22.27.C05.1.454.CMB.1.raw
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgacaagtccagccagtagttatttttacagtctccaacaataagagctattagcttggttccagacagaaaccaggacatcctcctctactcgcctctatttacgcgggtccgttccgtaacccgggtacgtcccggggtccctgaccgtattcgaggtcggcgaggtcgggtcagggacagtactttcactcncactntacagccagtcctagcgaggtcagaagtgtggtcggtattaggttttaactacgtcgtacgtacgaactagttaattcgttacttcccttaaccgtctaacgggttaccgttaccggaaccggaaacgggtaccgtaaaggggtaagaaacttaacccggaaactaagtcggtacggtactacgacctacgcttccgg

SEQ ID NO: 160897 - DNA, 757 bp, Homo sapiens
  misc_feature: GYAE6OF01EEV72.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagaggccaccatcaactgacaacgtccagccagtagttatttttacacgactaccaaccaaataagacgtacttaacttacgtacgtttcggttaccaagacaagaaacccaggactactcctcctactactcgctactactttacgcgggtaccgtaccgtaacccgggtaacgtccccgggggttccctacggaaccgtacgttccgaaggtcggacgtaacgggtccggggttacgtacggggaacctaaggtacttttaccgaccttacctacacctatacgaccgacacgtcctaggaccgaagggtacttaggaagtagttacggtcggtaacgtttaaggtttttaacttaccgtagtaccgtaaagtaaccttaaatttaacgtttaactttaacctttacccgttaccccgttaggtaaaccggttaacccggtttacccgggaaaccggtaaaacggggtaaccgtaaaacggggttacggaaaaacttaaacccggaaaaacgttaccgtagggttaccggaacttaccggaacctaacccgtaagttacccg

SEQ ID NO: 160898 - DNA, 799 bp, Homo sapiens
  misc_feature: GYAE6OF01CDVQ9.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatgacccagtctccagacctccctggctgtgtctcgtgggcgaggacgggccacatcaactgacaacgtccgagccagagtttatttttacagtctaccaacaacaagacgtctactagtcgttcggtaccagacaagaaccaggaccactccctacctctactcgtctactatttacgcgggtaccgtaccggtaaccgggaacgttccccggggtacctacggtaccgtacgttcgaggtcggacgacgggtccgggtcggtacgggactacgttactttaccgaccttacgtacccgtaacctagttaccggaacgtaccgtaacgtccccgttaggacccgttaaagggcccgttaacgggtaaaagggtcgtttacggggtacggttaacgttttaacgggtttttaacttaccggttacgttaaccggaaccttacgttaaactttaacgttaacttaccgtttacccgtaccgttaacgtaacgggttaccggttacccgggtaaacccggtaaaccgggggtaacccgtaaaagggggttaaaccggtaaaaaccgttaaacccgggtaaaaaccggtttacggttaaccgggtacgggttaaccgtccgtaaacccgtaacccggtttaaccgg

SEQ ID NO: 160899 - DNA, 726 bp, Homo sapiens
  misc_feature: GYAE6OF01CLBSY.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgaggagggccaccatcaactgcaagtccagccagagttatttttacagctccaccaataagagtctacttagcttggttccagcagaaccaggacactcctcctctactgctctatttacgtcgggccgtccgtacccggggtaacgtccccggggtccctacggacccgtacgttaccgtaggttcgggaccgtacgggtccgggttcgtacggggaacctaggttaacgtttccaccgttacctaccgaaccctattaccgaacggccaacggtccccgtaggaccgacggtccgtaagaagtacgtgggttacggactttaagttttactaccgtgtaccgaagtacctaaaagtttactttaacgttacctttacccgttaccctaacgtacccggttaaccggttaccccgggaaccggtaaaaccggggtacccgtaaagggggttaacggtaaaaccgttaacccgaaaaaccggtttcggtacgggtaccggtaaccttaccgggcccttaacccgttaaccgg

SEQ ID NO: 160900 - DNA, 686 bp, Homo sapiens
  misc_feature: GYAE6OF01C11GA.22.27.C05.1.454.CMB.1.raw
  modified_base (334)..(334): a, c, t, g, unknown or other
  misc_feature (334)..(334): n is a, c, g, or t
  modified_base (423)..(423): a, c, t, g, unknown or other
  misc_feature (423)..(423): n is a, c, g, or t
  modified_base (658)..(658): a, c, t, g, unknown or other
  misc_feature (658)..(658): n is a, c, g, or t
  modified_base (667)..(667): a, c, t, g, unknown or other
  misc_feature (667)..(667): n is a, c, g, or t
  modified_base (678)..(678): a, c, t, g, unknown or other
  misc_feature (678)..(678): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtcgccgtccggggacatcgtgatcgacccagtctccagacctccctggctgtcgtctcgtgggcgaggacgggccacatacaactgacaacgtccacgccgtagtagttactttttacagtcctaccgaaccaaagttaaacgacgtacctaacttaagctttcggttaccaagacaaacggaaaaccctagggaaaccncttaccctaccttactacctagtcctacttacgttttaagccgggtcgtaacccgtacccgggaacgttccggggtaccctggaccgtnttcgaggtcggcgagggtcggtcgtaggggactacggttaacttcacttaccacctaaccgatacgacgacacgtcccgtagacgtaacggtcttaaggaacgtagttggcgtaaccttagtttactacgttgtacgaagaactttaataacttattaccttcctactcgacggtccttaccgggaaactaacggggtaacggtaagtaaggtaaaccacgaaacgtacgttacncgggtaacncgtaaccctancgttaccg

SEQ ID NO: 160901 - DNA, 652 bp, Homo sapiens
  misc_feature: GYAE6OF01DAL5L.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctggcgagaggccaccatcaactgacaagtccagccagtagttatttttacagtctccaaccaataagagctacttagtcttggttccagtcaagaaaccaggacatcctctctactgctctatttacgtgggtccgtaccgtacccgggtaacttccccggggtccctacggtacgtacgtacgtaggtcggacgacggtccgggtacggtacggacgtagttactacgtacctacgtacccaactacgtaccgacgtcgacgtcgtcgacgtaggtcgtagagtgtgtcgtagttactttacgttactcgtactagtaacttaagttacttacttaccttacctaccgtacgtaccggtaccggtaccggtaaccggtaacgggtaaaccgtaagggtaaacgtaaccgtaaaccggtaaaccgttaacgtcggtaacggtcctacgtccctaacgttaccg

SEQ ID NO: 160902 - DNA, 635 bp, Homo sapiens
  misc_feature: GYAE6OF01AVO2F.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatgacccagtctccagactccctggctgtgtctcgtgggcgaggacggccaccatcaactgcaagtccagccagtagttatttttacagtcctccacaataagagtctacttagcttgtcagcaacgaaccagacactcctctctactgctctattacgtggcgtccgtaccggacgtcccgggtcctgaccgtattcgagtcggcgacggcgggtcgtagggactagttactttccactcctaccacgtactaccacgcgacgcccgtcacggggggggggactacgagtaacgtagttcggtacggtacgtttaacgttttacgtttacgttacgtacgaacgtactaagtttaacttattacctttacccttacctaccgttacggttaccggttaccggaaccggaacgggtaacggtaaggtaacgtaaacgtaaccgaaacgtacgtacggtacggactcgacctacgttacg

SEQ ID NO: 160903 - DNA, 698 bp, Homo sapiens
  misc_feature: GYAE6OF01CE9GF.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagagttatttttacagctccaccaataagagctacttagcttggttccagcagaaaccaggacatcgtcctgcactgctctatttacgtgggtccgtccgtaacccgggtaacgtcccggggtccctcggtaccgatttccgaggtcggcgaggtcgggtcgtggggacagtactttcactctacacctatccagcacgtcctggcgaggccttaggaaacgtagttcggtcgtacgttaagttttaagttaactttcggtacgtaagtaaccttaaagtttaacttttaacttaacctttcccgttacccgttccgtaaacgggttacccggtttacccgggaaccccggtaaaacgggggtaaccccgttaaaaggggtttacggttaaaaaaccgttaacccgtaaaaacccgggttaaaccgtttacgggttaaccgggtaccgttaccggtaacccgttaaaccccg

SEQ ID NO: 160904 - DNA, 635 bp, Homo sapiens
  misc_feature: GYAE6OF01A54HC.22.27.C05.1.454.CMB.1.raw
  modified_base (432)..(432): a, c, t, g, unknown or other
  misc_feature (432)..(432): n is a, c, g, or t
  modified_base (448)..(448): a, c, t, g, unknown or other
  misc_feature (448)..(448): n is a, c, g, or t
tcagacatacgcgtcacgaccggtgctcgatttagacgcgatcgaagggtttgggggctacaacaggcaggcaggggcagcaagatggtcgttgcagacccaggtcttcatttctctgttgctctggatctctgggtgccttccggggacatcgtgatgacccagtctccagactccctggctgtgtctcgtgggcgagacggccaccatcaactgcaacgtccagccagtagttatttttacagtctccacaataagagtcttacgttagtcttggttccagcaagaaacaggactactcctcctctactcgctctacttacgtcggtaccgtccgtaccgggaactcccggggtacctacgaccgtacgtcaggtcgcgacggtcggtcgtggacagtattcgactcacgactatccgacgctacgtccngacgacggctaggagngtggtgtacttaagtttactactacgtacgagttaaccgaatttacgtttaacttacctttcccgacttacgaacgggttaaccgggttccggaaaccggaaaccggggtaacctaaaggggtaacgaaacgttaaccgaaacgggtacgttacggttcggactaccgacctaacccttcgttaccg

SEQ ID NO: 160905 - DNA, 572 bp, Homo sapiens
  misc_feature: GYAE6OF01ESMBA.22.27.C05.1.454.CMB.1.raw
  modified_base (371)..(371): a, c, t, g, unknown or other
  misc_feature (371)..(371): n is a, c, g, or t
  modified_base (424)..(424): a, c, t, g, unknown or other
  misc_feature (424)..(424): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgacaagtccagccagagttatttttacagctccacaataagagctacttagcttggttccagtcaagaaaccaggacatcctcctctactgctctatttactgggctcgtacccgggaatccggggtccctacggaccgattcaggtcgcgagccgggtntcggggacaggtatttcactctacacatcagcacgcctgcgaggctagaagtntggtgtactaggttttaactactgtacaagaccgtaaattagtttaataccttccctactacgaacgtcggtccggaccgaaaggggtacccgaaagggtacgaaattacgaaaaccgtaagtggtacgactaggacccacgattacg

SEQ ID NO: 160906 - DNA, 816 bp, Homo sapiens
  misc_feature: GYAE6OF01AQ7R3.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagagttatttttacagtcctaccaccaataagacgtacctacttagtacgtttcgggttccaagcaagaaaccgaggactactccctacctacctactcgactacgtacttttacgtgggtaccgttaccgtaaccccgggtaacgttccccggggtaccctacggtaacccgtacgttaccgaaggttcggaccaacgggtcccggggttacgtacgggggtaacctaacggtacttttacccgaccttccgtacccgaacccttaacgtccgaacggtccgaaccggtcccgtacggtacccgacgggtaccgtacgggtaaacgtaacggtgggtacgggtaacctttaaggtttttaactttaacgttttcggtaaccttaacggtaaccttaaaacgtttacgtttaacctttaaacccgtttcccttaacccgtttacgggtaaaccgtttaccgggttttaaacccgggaacccggtaaaaccggggtaaacccgttaaaggggttaaccggtaaaaacctaccggtaaaaacccggtaacggttacggtaccgggacgttaccggaaaccgtacccgtaacg

SEQ ID NO: 160907 - DNA, 572 bp, Homo sapiens
  misc_feature: GYAE6OF01CY4C0.22.27.C05.1.454.CMB.1.raw
  modified_base (424)..(424): a, c, t, g, unknown or other
  misc_feature (424)..(424): n is a, c, g, or t
  modified_base (483)..(483): a, c, t, g, unknown or other
  misc_feature (483)..(483): n is a, c, g, or t
  modified_base (545)..(545): a, c, t, g, unknown or other
  misc_feature (545)..(545): n is a, c, g, or t
  modified_base (563)..(563): a, c, t, g, unknown or other
  misc_feature (563)..(563): n is a, c, g, or t
  modified_base (566)..(566): a, c, t, g, unknown or other
  misc_feature (566)..(566): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatcgacccagtctccagactccctggctgtgtctcgtgggcgaggacgggccaccatacaactgacaagccagccagtagttatttttacagcctaccaaccaataagagcttactagcgttcggttaccagcaagaaaccaggactactcctcctactacgtcgctctatttaccgtggtccgtaccgtacccgggtaacgtcccgggtcctagaccgtattcgaggtcggctacggcggtcgaggactagtactttcactcacgacancgagcacggtcagacgtagctagaagtgtcggtcggtataacgttttgtactgtacganaattaatacttattacctcggttaccagtacgacgttcggacgaaaggacgtaggagaacanaaccgattggcgctagcncgnttaccg

SEQ ID NO: 160908 - DNA, 685 bp, Homo sapiens
  misc_feature: GYAE6OF01CBAQK.22.27.C05.1.454.CMB.1.raw
  modified_base (401)..(401): a, c, t, g, unknown or other
  misc_feature (401)..(401): n is a, c, g, or t
  modified_base (431)..(431): a, c, t, g, unknown or other
  misc_feature (431)..(431): n is a, c, g, or t
tcagacatacgcgtcacgaccggtgctcgatttagacgcgatcgaagggtttggggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccacatcaaactgacaagtccacgccaagtagtttatttttacagcctccaacctaaataaacgagtaccttaacttacgtctttcgggttaccaagccaacggaaaccaggacactccctcctctactcgctactacttacgtggtccgtaccggtacccggtaaggtcccgggtcctgaccgtagttcaggtggacncggcgggtcgtgggactagtcttcacttcncacctatccagcacgcccgtgcgacggtcgtaagaaggtcgttggtacgtactttaacgtttttattaacgttcggtacctaagggtaaccttaaagttttactttaagtttaacccctttacccgtacccgttaacggtaccggttaacgttacccgggaaccgggtaaaacggtcccgtaaaaggggttaaccgaaacgttaaaccgaaaacgttacggtacggtcggtacccagtaaccccgtataacccg

SEQ ID NO: 160909 - DNA, 673 bp, Homo sapiens
  misc_feature: GYAE6OF01CTPPB.22.27.C05.1.454.CMB.1.raw
  modified_base (653)..(653): a, c, t, g, unknown or other
  misc_feature (653)..(653): n is a, c, g, or t
tcagacatacgcgtcacgaccggtgctcgatttagacgcgatcgaagggtttggggggagctacaacaggcaggcaggggcagcaagatggtgttgcagacccaggtcttcatttctctgttgctctggatctctggtgcctccggggacatcgtgatcgacccagtctccagactccctggctgtgtctcgtgggcgaggacgggccaccatcaactgacaacgtccagccagtagttatttttacagtctacccacaaataagagcctaacttagtcgttcggttaccagacaacgaaaccgaggacactcctcctctactcgcctctatttacgtcgggtccgtaccgtacccggtaacgtcccggggtacctacgaccgtattacgagtcggacgacggtcgggtcgtacgggacgtagttacttcacctctaccacctactccgacgtaccgacgtaccccgtggaccgacggtccgtaaggaacggtagttacggtcgggtacgttaaggttttacttacggtagttacgtaacgtagttaacttattacttaccttcctaccttaccgtaacgtaccggtacccggaccggtaaacgggtaccgtaaaggtacggtaaacttaaccgaaacgtacgtaggtacgtntaaccgtcgtaacgttaccg

SEQ ID NO: 160910 - DNA, 270 bp, Homo sapiens
  misc_feature: GYAE6OF01CEIZQ.22.27.C05.1.454.CMB.1.raw
  modified_base (259)..(270): a, c, t, g, unknown or other
  misc_feature (259)..(270): n is a, c, g, or t
tcagacatacgcgtcacgaccggtgctcgatttagacgcgatcgaagggtttgggacagatttcactctcaccatcagcagcctgcaggctgaagatgtggctagtttattactgtcagcaatattatattcctcctcagacgttcggccaaagggaccaaggtgaaatcaaaacgactgtggctgcacatctgtcttcatccttcccgccatctagaacgcgttatcgtctggagcgggctggacaaggctcaatagnnnnnnnnnnnn

SEQ ID NO: 160911 - DNA, 594 bp, Homo sapiens
  misc_feature: GYAE6OF01AYEG4.22.27.C05.1.454.CMB.1.raw
  modified_base (440)..(440): a, c, t, g, unknown or other
  misc_feature (440)..(440): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagtacgttatttttacagcctaccaaccaaataagagttacttagcttggttccagcagaaaccaggacatcgtcctgcactgctctatttacgtgggtcgtccgtacccgggaacgtcccggggtccctcggaccgtattcgagtggcaggcgggtcgtagggactagtactttcactctccactatcagccagcctgcaggctagaagagtggngtacttaagtttattacgtgtacagactaagttaatattacgcggtacctcgggtacgttacggaccgaagggaacccgtaaggggtacggaaagtaccggaaaacgttaccggtaggtacggtacgtacgaccctaacgtacttcgttaccgg

SEQ ID NO: 160912 - DNA, 646 bp, Homo sapiens
  misc_feature: GYAE6OF01B5L0L.22.27.C05.1.454.CMB.1.raw
  modified_base (625)..(625): a, c, t, g, unknown or other
  misc_feature (625)..(625): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctccctggctgtgtctcgtgggcgagacgggccaccactcaactgacaacgtccacgaccagtagttatttttacacgctaccaaccaataagagctacttagcttggtccagcagaaaccaggacatcctcctctactgctactatttacgtgggtaccgttccgtaacccggggaacgttcccggggtccctacggacccgtacttcgacggtcggccgaggccgggttcgtagggacaggtactttcgaccttcctaccaacctataccgacgtccgacgtcccctaggacgaacgggtcctagggaagtagtcgggttacggacgtttaacgttttattaccggttgtaccgagtaccttaattaacttagttacctttacctccttacgacgtaccggttccgaaccgtaagtcgaacgtaggtaacggaaacttaccgaaaacgtnttacggagtcctgacctaccg

SEQ ID NO: 160913 - DNA, 620 bp, Homo sapiens
  misc_feature: GYAE6OF01CJDC0.22.27.C05.1.454.CMB.1.raw
  modified_base (442)..(442): a, c, t, g, unknown or other
  misc_feature (442)..(442): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctccctggctgtgtctctgggcgagagggccaccatcaactgcaagtccagccagtagttatttttacagtctaccaacaataagagtctacttagtcttggtccagacaacgaaccaggacactcctctctactcgactctatttacgtgggtcgtaccgtaccgggtaacgtcccggggtccctacggaccgtacgttcgaggtcggcgacggtcgggtacgtgggactagtactttcactcctcacctatcacgcacgctcgacgngtctagaacgngtcgnggtactagtttacgttacgtgtcgaacgtacaattatttactcttcctacttacgacggtaccgttaccgggaaccggtaaacgggtaaccctaaaggggttaacggtaaaactaccgtaaaacggtacgtcggtacgggactacggacccgtacgtaacgg

SEQ ID NO: 160914 - DNA, 597 bp, Homo sapiens
  misc_feature: GYAE6OF01CBQAA.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcaagaaaccaggacatcctcctctactgctctatttactgggcgtctacccgggaacgtccggggtccctgaccgtattcgagtcggcaggcgggtcgtgggacagtatttcactcgtcacctatcaagcagcctgacaggctagaagtattcggtaggactaggttttacttacgtgttacgagtacaattatttacttacttcccttacctacgtaacggtaccgttaccgggaccgtaaagggtacccgaaagggttaggaaaacttaccgaaaaccggtaacgttcggtaccggactaccggactacccgtacgttacccg

SEQ ID NO: 160915 - DNA, 877 bp, Homo sapiens
  misc_feature: GYAE6OF01E5ZYB.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctcgtggtcgccgtccggggacatcgtgactcgaccctagtcctaccacgacctcccgtggtctggtcgtccgtcggtgggacgaggacgggacccaccatacaacgtcgaccgaacgtccgacgaccgtaaggttaacgttttaactttttacgacgtaccctaccctaaaccgtaaagtaacggtacgtaccgtttaacgtttacggttccggtttaccggttaccaacggaccgaaaccggaaaacccgtaacggtaacctaccttccccgttacccttacgttaccttcggtccttacttacgttttaccgggtcgggtacccgtacccgggttaacccgggtacggttccccgggttacccgtacggtaccgtacgttacgtagggtcggtacgtacgggtccgggtacgtacgggtaactacgttacttacccgtactacccgtacctaaccgtacgtacgaccgtacgtaccgtcccgtacggaccggagtacgtaaggagttacggttgttacggttaacgtttacgttttactaccgttaaggtaccgtaagttaacctttaacgtttaacttttaacctacccgttttcccctaccggtaacgttaccgggttaccggttacccgggaacccgggtaaaccggggtaaccgtaaacgggttaaccgtaaaccgtaaacccggtaaacggttaccggttacggtaccggtaccacccggttaccctacggtttacccg

SEQ ID NO: 160916 - DNA, 697 bp, Homo sapiens
  misc_feature: GYAE6OF01CZHYQ.22.27.C05.1.454.CMB.1.raw
  modified_base (189)..(189): a, c, t, g, unknown or other
  misc_feature (189)..(189): n is a, c, g, or t
  modified_base (535)..(535): a, c, t, g, unknown or other
  misc_feature (535)..(535): n is a, c, g, or t
tcagacatacgcgtcacgaccggtgctcgatttagacgcgatcgaagggttgggggagctacaacaggcaggcaggggcagcaagatggtgttgcagacccaggtcttcatttctctgttgctctggatctcgtggtcgccgtccgggacatcgtgactcgacctagtcctcagtcctccgtgtctgtntcgtcggtggcgaggacggccacatacaacgtcgactaacgtccgacgaccgtaagtaacgttttacttttacgaacgtctaaccaactaaagtaagacgtacttaacgttacgtcgtttacggtaccaacgacgaacgaacgacggactctacctcctactactcgtacctacttacgtttaacggtcgggtaccgtaccggtacccgggtaacggtcccgggttaccgtacgtacgtactacggaggtcggaacgtcgggtcggtcggtaacgggtactacggttcttacctacctactacctactaccgtacgaactcgacgcctagacgagcgtagatcggngtacggttattattagttacgttcgaagtatacttaattacttagttaccttcgtactacgacgttaccggacggaaaccgtaaccgggaagttaaggaacggtaaacgtaccgtaaaagggtacgtaacggttacgtaccgtaacgtcccgtaagttcccg

SEQ ID NO: 160917 - DNA, 738 bp, Homo sapiens
  misc_feature: GYAE6OF01C7H26.22.27.C05.1.454.CMB.1.raw
  modified_base (528)..(528): a, c, t, g, unknown or other
  misc_feature (528)..(528): n is a, c, g, or t
  modified_base (726)..(726): a, c, t, g, unknown or other
  misc_feature (726)..(726): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatgacccagtctccagacctccctggctgtgtctcgtgggcgaggacggccaccatacaactgacaacgtccacgccaagtagtttatttttacacgtctaccaaccaaataagacgtacctaacgttacgtcgtttacggttaccaggacctaaacggaaaacccgagggtaacctaactttcccctcccttaccttaacgttcggtaccttccttaacgttttaccggttcggggtcccgttacccggtaaccccggggtaacggttcccccgggggttccctacggtacccggtaagtttccgtaacggtcgggaccgtacgggtccgggttcgtacggggactagttactttcaccttcctacgaccngtaccacgtcaacgtccgtgacgacggtctagggaagtacgtcggtaggtaccttagtttaacttccgttgggtaccaagttactaaagtttaacttcgttacctttcccgtacgtacgttacggtacccggtacggaccgtaaacgggtacgtaagggtaacgtaaactaaccgaaaggtacgttggacgacgtacnccgcgttaaccg

SEQ ID NO: 160918 - DNA, 766 bp, Homo sapiens
  misc_feature: GYAE6OF01D1K4C.22.27.C05.1.454.CMB.1.raw
  modified_base (182)..(182): a, c, t, g, unknown or other
  misc_feature (182)..(182): n is a, c, g, or t
  modified_base (294)..(294): a, c, t, g, unknown or other
  misc_feature (294)..(294): n is a, c, g, or t
  modified_base (303)..(303): a, c, t, g, unknown or other
  misc_feature (303)..(303): n is a, c, g, or t
  modified_base (324)..(324): a, c, t, g, unknown or other
  misc_feature (324)..(324): n is a, c, g, or t
  modified_base (340)..(340): a, c, t, g, unknown or other
  misc_feature (340)..(340): n is a, c, g, or t
tcagacatacgcgtcacgaccggtgctcgatttagacgcgatcgaagggtttgggggagctacaacaggcaggcaggggcagcaagatggtgtgcagacccaggtcttcatttctctgttgctctggatctctggtgccgtccggggacatcgtgatcgacccagtctccgagtactcccgnggtctgtcgtctcgtgggcgaggacgggccacatacaactgacaagtccagccaaggtattattttacagcctacaacaataagatacttaactacgtcttaggtacacganaacgaaacnggaactactcctactactacngtctatacgtttacgnggtacctacggtaacccggtaacgtcccggggtacctacggtaaccgtacgttacgaacggtcggtacgaacgggtcggtacggttacgggactaacggttacttacctacgttaccgacaactacgtacgacgtacgaacggtcctcggaacgtacggaccgttaacgaaaggttcgttaggtaccggttaacgtttaagtttttaacggttaccacggtttaacgtaacgtaaccctttaaaggttttaaacctttaaacttaacccgttttcccgaccgttaaacggtacccgggtttaaccggttacccgggaaaacgtttaaaccggggaaacccgttaaagggggttaactaaaaacctaacccgggtaaaacgttaaccggtcggttacgtaccgtaaccggtaacctccgttaaacgg

SEQ ID NO: 160919 - DNA, 632 bp, Homo sapiens
  misc_feature: GYAE6OF01ANXCF.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagaggccaccatcaactgcaagtccagccagagttatttttacagtctccaccaataagagctacttagcttggttccagcaagaaaccgaggacactcctcctctactgctctatttactgggtccgtctacccgggaacttcccgggtcctcgaccgtatcgaggtggcaggcgggtctgggactagtactttcgactctccacctatcacgccgactcccgtagccgaggtcgtaggaagtagtgtacggtacttagtttacgttacgtcgtactaacgtactaaagttattaattaccgtttaccctaccgttgtaaccggttacccgttaccgggtaacccgtaaacggggtaacccgtaagggtaaacgggtaaactaaccggtaaaaccgtaacgtacgggtacggtacgtacgtccccgtaacttaccg

SEQ ID NO: 160920 - DNA, 591 bp, Homo sapiens
  misc_feature: GYAE6OF01BJTOU.22.27.C05.1.454.CMB.1.raw
  modified_base (439)..(439): a, c, t, g, unknown or other
  misc_feature (439)..(439): n is a, c, g, or t
  modified_base (460)..(460): a, c, t, g, unknown or other
  misc_feature (460)..(460): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagttacttagcttggttccagcagaaaccaggacatcgtcctgcactcgctcagtttaccgtgggtcgtaccgtacccgggaacgttcccggggtccctggaccgtattcgaggtggcacggtcgggtcgtgggacagtactttcacgtctacaccatcagtcacgccctagcaggtctagaagngtgtggcttagtttactacgngtacagtacaattacttaatcttacctccttacgaggtaccggttccggaccgtaaagggtacccgtaagggtacggtaaaactaccgaaaacggtaacttcggtacggtacgtacgaccgtaccgttacg

SEQ ID NO: 160921 - DNA, 618 bp, Homo sapiens
  misc_feature: GYAE6OF01DM7GN.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcactttctctgttgctctggatctctggtgcctccggggacatcgtgatgacccagtctccagactccctggctgtgtctcgtgggcgaggacgggcccaccatacaactcgacaacgtccacgccaagtagtttactttttacacgcctaccaaccaaataagtacgtttacttagtcttcggttaccagtacaacgaaaccaggacactcgtcctcgcactcgctctacgtttacgtcgggtccgtaccggtaccgggtaacgtcccgggtacctaggaccgtacttcgaggtcggcgacggtcggtcgtacggactacgtacttctactcgtaccacctatcagctacgcctgcgaggctagagtcgtggtcgtattaggttttacttgtcgtaacagtaactaagttacttactctttcccgtactacgtacgttacgtaccgacgtaacgggacctaagggtataaacacgaaacgtacgtcggtacgactaagactatcggttac

SEQ ID NO: 160922 - DNA, 625 bp, Homo sapiens
  misc_feature: GYAE6OF01BC6MN.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgaggagggccaccatacaactgacaagtccacgccagtagtttatttttacacgtcctaccaacctaaataagacgtacttaactttagcgtttcggttaccaagcaacgaaaccgaggactactacctcctactactgctctattacgtggcgtaccgtaccgggacgtccgggtcctagaccgtactcgacgtacggcgaggtcggtacgtaggactacgtacttacgtactctacaccgtatcgaacgtcacgtctaggcgacggtctaggaagtcgttaggtcggtaacttgttttactacgtagtacgtaacttacgtaattatttacctcttaccctctacgacgttaccgtacggacgtaagggacctaacgggttagaaactacgaaacggtcgtacggtacggataccgactaccgtgttacc

SEQ ID NO: 160923 - DNA, 733 bp, Homo sapiens
  misc_feature: GYAE6OF01E0UBL.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccagtcaactgcaacgtccagccagtagttatttttacacgtctcccaaccaataagagtcttacgttagcttggttaccagacaacgaaaccgaggacactcctcctactactgctctatttcgtgggtctcgtaccggtacgtccgggtcctcgaccgtatcaggtcggacaggtcgggtcgtcgggactagtacttcacgttcctacgacctagcacggtccaacgtccctggaccgtaaggtcgttaaacggaaagttcggttacgggttacggtaccgtttaacggtttttaactttaaccggtacggttaccgtaaaggtaaccttaaaacgttaagttttaaacccgtttaacctttcccccgttacgttaacggtaaccgggttaaccgggtttaccgggaaacccgtaaaaccggggggtaccctaaaagggggttaacggttaaaaaccgttaaccgtaaaaaccgggtaccgttacgggtaccggtacgtaaccgacccgtaaccgtagtttaccccgg

SEQ ID NO: 160924 - DNA, 907 bp, Homo sapiens
  misc_feature: GYAE6OF01D4FLD.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgaggacgggccaccatcaactgcaacgtccagccagtagttactttttacagtcctaccaaccaaattaagacgtaccttaacgtttaacggtccgttttacgggtttcccaacggtacgaaacggtaaaaacccgaaggggtaaccctaacttaccccttacccgtttaccttaaccgttcgtaccctttaccgttaacgtttttaaccggttcgggggtacccggtttaccccgtaaacccccggggggtaaacggttccccccggggggttaccccgttacggaaccccggttaactttaccggagggtacgggaccgtaacggggtccggggttaccggttacggggtaaccgtaacggttaacgttttaccgtaacccgttccgttaccctaacccgtaacgttaccggaaccggtcccgtaacggtaccccgttacggaccgtaacgggtccgtaaggaacggtaacgttcggttacgggtaacgtttacgtttttaacgttaccgtacgggtaactaacggtaaccttaaattacgtttaacttaacctttccccgtaccttaccggtacggttaaccggttacccgggtaaaccggtaaacgggggtaaacccgtaaacggggttaacgggtaaaacttacccggaaaaacccggttacgttacgggttacgggaccttaccgggacctaacccgtaggttacccg

SEQ ID NO: 160925 - DNA, 566 bp, Homo sapiens
  misc_feature: GYAE6OF01A9J0Y.22.27.C05.1.454.CMB.1.raw
  modified_base (438)..(438): a, c, t, g, unknown or other
  misc_feature (438)..(438): n is a, c, g, or t
  modified_base (554)..(554): a, c, t, g, unknown or other
  misc_feature (554)..(554): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccacatcaactgcagtccagccagagttatttttacagctccaccaataagagttacttagcttggttccagcaagaaaccaggacatcgtcctgcactgctctatttacgtgggcgtccgtaccccgggtaacgtcccggggtccctggaccgagttcgacggtggcgacggtcgggtcgtagggacagtactttccactctccacctatccagccacgcctgcgagctagaagtntggtgtactagtttatagttgctaagctaattattatacttcctacctcgacgtaccgttcggaaccgtaacgggaccgtaagggtagtaaactacgaaacgacgtggtacgactnaccgtacctacg

SEQ ID NO: 160926 - DNA, 766 bp, Homo sapiens
  misc_feature: GYAE6OF01EEM0Y.22.27.C05.1.454.CMB.1.raw
  modified_base (99)..(99): a, c, t, g, unknown or other
  misc_feature (99)..(99): n is a, c, g, or t
  modified_base (486)..(486): a, c, t, g, unknown or other
  misc_feature (486)..(486): n is a, c, g, or t
  modified_base (513)..(513): a, c, t, g, unknown or other
  misc_feature (513)..(513): n is a, c, g, or t
tcagacatacgcgtcacgaccggtgctcgatttagacgcgatcgaaggggtttgggggagctacaacaggcaggcaggggcagcaagatggtgttgcanacccaggtcttcatttctctgttgctctggatctctggtgccgtccggggactatcgtgatcgacccagtcctccagacctccctggtcctgtgtctcgtgggcgaggacgggccaccatcaactgacaatccagccagtacttattttacagtcctaccaactaataagagtaccttaacgttagtccgtttacggttacccaagaccaaacgtaaaccgacggtaacctactcccttcctacctactcgaccttactatttaccggtcggtaccggttaccgtaaccccggggtaacgttcccggggtaccctacggtaaccgttacgttacggaggtcggacgtacggggtcgggttaccgtaggggaactaggttacttaccnccttacctaccacccgtataccgaacnccgtaacgtccgtaggaccgtaggtacgtacggtaaagtcggttacgggtacggtacgttaaacgttttacttaccggtagttaaccgaacgttaactaaacgtttaagtttaccgttaaccgttcccgtaccgttaaccggaaccgggttacggtacccgggaaccgtaaacggggtaaccgtaaagggtaaggtaaaaccgtaaccgaacggtaaccgttggtaccggataccgtaccgtaaccttaccgg

SEQ ID NO: 160927 - DNA, 681 bp, Homo sapiens
  misc_feature: GYAE6OF01AG1A6.22.27.C05.1.454.CMB.1.raw
  modified_base (567)..(567): a, c, t, g, unknown or other
  misc_feature (567)..(567): n is a, c, g, or t
  modified_base (596)..(596): a, c, t, g, unknown or other
  misc_feature (596)..(596): n is a, c, g, or t
  modified_base (668)..(668): a, c, t, g, unknown or other
  misc_feature (668)..(668): n is a, c, g, or t
tcagacatacgcgtcacgaccggtgctcgatttagacgcgatcgaagggtttgggggctacaacaggcaggcaggggcagcaaggatggtgttgcagacccaggtcttcatttctctgttgctctggactctctggtgccgtccggggacagtcgtgattcgtacccagtctccagacctccctggctggtgtctcgtgggcgagacggccacagtaccgaactcgacgaacgtccacgccgagtagttacgtttttacagtcctaccacaaataacgacgtcttacgttagtccgttcggttacccacgtacgaacgaaaccgacggtactacgtccctcctcctacgtcgtcctcgtaacgtttacgtcgggtaccgtccggtaacccgggtaacggtccccgggtacccgtacgtaccgtaacgtttcgaaggttcggacgtaacggtccgggtacggtcggtaactacgtacgtttccacgtcctaccacctacgtaccagtaccacgtactcgacacggtactagaacgtgttggctacgttaacgtttcttagtccgtaancgtaacttatacgttataccgtttacccncgtacgacgttccggacgtaaccggtacgggtacgtaaggtacaaacgtactaacgactggtacgtacgacncaccgtgtacccg

SEQ ID NO: 160928 - DNA, 771 bp, Homo sapiens
  misc_feature: GYAE6OF01C524F.22.27.C05.1.454.CMB.1.raw
  modified_base (130)..(130): a, c, t, g, unknown or other
  misc_feature (130)..(130): n is a, c, g, or t
  modified_base (160)..(160): a, c, t, g, unknown or other
  misc_feature (160)..(160): n is a, c, g, or t
  modified_base (222)..(222): a, c, t, g, unknown or other
  misc_feature (222)..(222): n is a, c, g, or t
  modified_base (262)..(262): a, c, t, g, unknown or other
  misc_feature (262)..(262): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctaggntctcgtggtcgcccgtccggggacatcgtnatcgacccagtcctccacgacctccctggtcctgtgtctcgtgggcgaggacggccacctanacaacgtgacgaactccacgaccagtatttacgttttacncgtctaccaactaataacgactactacttacgtcgttcggtaccagacaacgaaacgacgactacctcctcctcgtactcgtcctacttacgttacggtcggtacccgttaccggtaacccgggtaccggttccccggtctaaccggtaccggttacgttacggtaacggtccggtacgtacgggtaccgggttaccggtaacgggtacgtacggtttacttaacctaccgtacctacccggaactaccgtacgaccgactaacccggtcctacgggtaacgcggtaccaaggttaccgagggttcgacgttaacggttttactttaaccgtcggttagtacccgtaaaggttacttaaactttttgaaacctttccgttaacccttacgtacggttaaccggtacccgtaccgggaaacgtaacccgggtaaaccgtagggaaacctaacccgtaaacggtaaacgttccggtaacgttaccggtaatacccgacgtcctttaacggg

SEQ ID NO: 160929 - DNA, 754 bp, Homo sapiens
  misc_feature: GYAE6OF01BKV0F.22.27.C05.1.454.CMB.1.raw
  modified_base (374)..(374): a, c, t, g, unknown or other
  misc_feature (374)..(374): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagacgggccaccatcaactcgacaacgtccacgccagtagtttacttttttacagtcctaccaaccaataagagcttacttagcttggttccagcagaaaccaggacactcctcctctactgcttcatttcgtcgggtcgtaccgtacccgggtaacgtcccggggtcctacggaccgtnttccgtaggtcggcgtacggtccgggtcgtagggacgtaggtactttccgaactccgttaccaccgtagttaccgaacgtcctaacggtccccgttaggacccgtagggtacctttaagggaaaggtacgtttcgggtaggtaccctttaaggtttttaacttaccgttaggttacccgaagttacctaaagtttaacgttaatttacctttccccttaccggtacgttaaaccgggttacccggttaccgggtaaaccccggtaaaacgggggtaaacccgtaaagggggttaaacgtaaaaccgttaccggtaaaaaccgggtaactttcggggtacggtaccggttaacgtacccctaaaccgttagtttaccccgg

SEQ ID NO: 160930 - DNA, 661 bp, Homo sapiens
  misc_feature: GYAE6OF01CM47Z.22.27.C05.1.454.CMB.1.raw
  modified_base (240)..(240): a, c, t, g, unknown or other
  misc_feature (240)..(240): n is a, c, g, or t
  modified_base (287)..(287): a, c, t, g, unknown or other
  misc_feature (287)..(287): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgaccccagtctccagactccctggctgtgtctctgggcgagagggccaccatcaactgcaagtccagccagtagttatttttacngctccaaccaataagagctacttagcttggttccagcaacgaaaccnggacactcctcctctactgctctactttactcgggtctaccgtaccgggaactccggggtccctgaccgtatcgacgtcggcgacgcgggtctgggtacagtattccacttctacacctactacgtacgcgacgtaccgtgacgtaggtcgtgaacgtagtcggtacggtacttagttttaactttacgtacggtactaacggtactaaagtttaacttacgttaacgtttccccttacccgtaccgttaacggtaccccgggttaccgggtaaacccggtaaaccggggtaacccgtaaaggggttaacggtaaacgttaacccggaaaacgtacgttacggtacggtacgtacgacccgtactacgttaccg

SEQ ID NO: 160931 - DNA, 705 bp, Homo sapiens
  misc_feature: GYAE6OF01DP4IZ.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagacgggccaccatcaactgcaagtccagccagagttatttttacagcctaccaccaataagacgacttacgttagccgtttcggttaccagacaacgaaaccaggacctactccctcctactactgtcctactactttacgtcgggtaccgttaccgtaacccggggtaacgtcccggggttccctacggtaccgtactttcgaggtcggcgacgggtcgggtacgtggggtaactagtaactttccgacttccgtacctaccgtacgtacgacgaccgaacgtccgtacggcgaacgggtacctaggaagtagttaggtcggtacttagtttttattatttacgtacaagtacctaaagtttattttaacttacgtttcccttaccgtacgtaacggttaccggttaccgggaaaccgtaacggggtaaaccgtaaagggttaaggaaacttaaccggaaaaccgttagttacggtacggtacctacggaccctaacgtcgtttacccg

SEQ ID NO: 160932 - DNA, 719 bp, Homo sapiens
  misc_feature: GYAE6OF01CGN8A.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtggcgagacgggccaccatcaactgcaagtccagccagtagttatttttacacgtcctaccaacaataagactactacttagtcttcggtccagtacaacgaaaccgaggactactcctccgtcctactcgtctactacgtttacgtgggtcccgttaccggtaacccgggtaccggttcccggggtaccctacggtacccgtacgttacgtacggtcggacgtacgggtccgggtacggtacggggaactacggttaactttaccgaccttaccgtaccgaacctaacgtcgacgccgtacgtccctaggaccgtaacggtcgttagaaggtacgttcggtacggtaccgtttaagtttactacgttgtaaccgtagtacttaaattacgttaactttacccgttcccgtaccgtaacggtaccggttaccggtaccggtaaccggtaaaccgggtaccgtaaagggtaagtaaacccgtaacggtaaacgtacggtacggtacggtacctcgtacccgtacttaccg

SEQ ID NO: 160933 - DNA, 738 bp, Homo sapiens
  misc_feature: GYAE6OF01C6PSM.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatgacccagtctccagactccctgctgtgtctcgtgggcgaggacggccaccatcaactgacaacgtcacgccagtagttatttttacagtctaccacaataagagtacctattagtcgtttacggttccagactaagaaaccgtaggactactacctctctactcgctactatttcgcgggtcgttaccgtacccggaacgttcccgggtacctacgaccgtacgttcgaggtcggccgtaggtccgggtcgtacggggaactacgtacgtttactacctaccgtcctaaccgtacgtaccgacgtcgaaccgtccgtacggtacgacgggtacttaggaaacgtgtgggtacggttacgtttaaacgtttttacgttacgttacggttacaacggttacgtaaacttttactttaacttaccccgttttaccgtttaccctaacggttaacccggttaccgggttacccggtaaaccgggaaaaccgggtaaccggttaaagggtacggttaaaaactaaccccggttaaaacgttaaccgggttagtaccgggtaccttcgaccccgtaacgttaaacg

SEQ ID NO: 160934 - DNA, 710 bp, Homo sapiens
  misc_feature: GYAE6OF01AMI41.22.27.C05.1.454.CMB.1.raw
  modified_base (561)..(561): a, c, t, g, unknown or other
  misc_feature (561)..(561): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatcgacccagtctccagactccctggcctgtcgtctcgtgggcgacggacggccaccgatacaactgacaagtccagccagtacgttatttttacacgtctaccaacctaataacgagtacttacttagtctttcggttaccagtacaacgaaaccgtggtaacctacgttcccttccgttacctaaccgtcgtaccttactaacgttttaccgtcgggtaccgttaccgtaacccggggtaacgttccccggggttccctacggtaccggtactttccggaggttacgggccgtaacgggtccgggttacgtacggggtactacggttacttttaccaccgttcgtacccaccgtacgtaccgtaacgccgtaacgtccctacggcgtacggacttagaacggtntcggtgtaaccgttagttacttacgggtacttacgagtaacgttaacttagttaacttcgttcctacgtacgtagtaccgttcggaccgtaacgggtacctaggtacgtaaactacggaaacgtctggtacgactacacctcgttaacg

SEQ ID NO: 160935 - DNA, 819 bp, Homo sapiens
  misc_feature: GYAE6OF01BUR3D.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgaggagggccaccatcaactgacaagtccagccagtagttatttttacagcctaccaaccaaataagagtacttaacttagtcttcggttccagcaacgaaaccaggacactccctcctactactcgtcctactacgtttacgtcgggtccgttacccggttaacccggggtaacgttccccgggggtaccccttacggtaacccggtacgtttcgaacgggtcgggtaccgtacggggtcccggggttacgtacggggaacctaacgggtttacttttacccgtaaccttccgttaaccaacccgtaacgtaccgtaacgggtacaacgggtccccgtacggacgtacgggtaccgttagggaaacgtacggttaggttacggttacgtttaaacggtttttacttaaccgtttgggtaaacccgtaaggttaaccttaaagtttaaacgttttaactttaaccctttccccgttaccgttaccggttaacggtacccgggtttaaccgggaaaccccggtaaaaccggggtaccggtaaaacgggttaacgggtaaaaccctaaccggtaaaaccggtaacgttcgggtaaccggtaccgtacggaacccttaccgttaacg

SEQ ID NO: 160936 - DNA, 625 bp, Homo sapiens
  misc_feature: GYAE6OF01DMODA.22.27.C05.1.454.CMB.1.raw
  modified_base (493)..(493): a, c, t, g, unknown or other
  misc_feature (493)..(493): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccgggacatcgtgatcgacccagtctccagtacctccctggctgtgtctcgtgggcgagacgggccaccatcaactgacaagtccagaccagagttatttttacagtcctaccaacaataagacgtctacttagtcttggttccagacaagaaaccaggacatcctctctactgctctatttacgtcggctcgtaacccggacgtcccgggtcctcggtaccgtattcgaggtggacgacggtcggtcgtagggactaggtactttccacgtctacgaccatcagctacgcgtgacgaggtaccgtagaaacgtgttagtggttaccttaagttttacttacgtcggttanaacgtacttaattaatttacttacctttacctacctacgtaccgttaccggtaccgacggtaaacggacccgtaaagggtacggtaaacgtacgaaaacggtacgttacggacgtacgtcaacgtacctacg

SEQ ID NO: 160937 - DNA, 183 bp, Homo sapiens
  misc_feature: GYAE6OF01CWESC.22.27.C05.1.454.CMB.1.raw
  modified_base (129)..(129): a, c, t, g, unknown or other
  misc_feature (129)..(129): n is a, c, g, or t
  modified_base (170)..(183): a, c, t, g, unknown or other
  misc_feature (170)..(183): n is a, c, g, or t
tcagacatacgcgtcacgaccggtgctcgatttagacgcgatcgaagggtttgggggctacaacaggcaggcaggggcagcaagatggtgttgcagacccaggtcttctatttctctgttgctctggtntctctggtcgcccgtccgggacatcgttgagcaaccccgtnnnnnnnnnnnnnn

SEQ ID NO: 160938 - DNA, 719 bp, Homo sapiens
  misc_feature: GYAE6OF01ENS6D.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccgggacatcgtgatcgacccagtctccagacctcctgctgtgtctcgtgggcgaggacgggccaccgatacaactcgacaacgtccacgaccagtagtttactttttacgagtcctaccaacctaagtaacgacgtacttacgttacgtcgtttacgtaccgaacgacgaaacgaaaccgacggtactacctcccttcctactactcgtccttacttacgttacggtcgggtaccgtaccggtaacccggtaccggtcccgggtaccgtacggtaccgtacgtcggacggtcggacgtacgggtcgggtcggtacggtacgtacgttacttaccgtaccttacctacctactacgtaccgacgaccgtacgtacgtacgacgtacgtacgtaaggagtacggtacggtacgttacgtttaacgtttacgtacgtagtacgtaacgtaacttaagttactttaccttaccttccgtaccgtacggtaccggttaccggtaccggtaaccggtaacggtaacgtaaggtaactaaaccgaacgtaaacgtcgtacggtacgacctacgacctcgtacg

SEQ ID NO: 160939 - DNA, 825 bp, Homo sapiens
  misc_feature: GYAE6OF01BUWOE.22.27.C05.1.454.CMB.1.raw
tcagacatacgcgtcacgaccggtgctcgatttagacgcgatcgaagggtttgggggagctacaacaggcaggcagggcagcaagatggtgttgcagacccaggtcttcatttctctgttgctctggatctcgtggtgccgtccggggactatcgtgatgtaccagtctccagactccctggctgtgtctcgtgggcgagacgggccacctagtaccaactcgacgtaacgtccacggaccagtacgtttactttttacgacgtcctaccaacctaagtaacggtacgtaccttaaccgtttacgtccgttttacggttacccaacggacgtaaacggaaacccgtacggtaccgtaccgttacccctcccgttacctaaccggttcggtacccttacgttaacgtttttaccggtcggggtacccgttacccgggttaaaccccgggtaacgtttccccgggggttacccctggtaaccccgtagttccgtaacggtcggacctacgggtacccgggtcgttacgggaaccgtacgttactttaccgacttcctacaacctactaccgaagccgacgtcccgtacgacgtcggtacctaggtaacgtgttggtacgacgtttacggttttactacgttacggtacgtaaccgtaagtaacgtttattaacgtttacttcccgttacctacggtaaaccgttccgggtttaaccgggaaacccggtaaacgggtaaaccggtaaggggttaaaccgtaaacgtaaacccggaaagttaccggttaggttaccgggtacttacccgaaccgtaaccgtttaaccgg

SEQ ID NO: 160940 - DNA, 758 bp, Homo sapiens
  misc_feature: GYAE6OF01CMQ10.22.27.C05.1.454.CMB.1.raw
  modified_base (325)..(325): a, c, t, g, unknown or other
  misc_feature (325)..(325): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgaccatctccagactccctggctgtgtctcgtgggcgaggacgggccacatcaactgacaagccagaccagtattatttttacagtcctaccaaccaaataagtacgtactacttagcgttcgttaccaagcaaacgaaaccgaggaactaactcctacctactacctcncttacttacgtttacgtcgggtaccgttaccgtaaccccgggtaacgtcccgggggttaccctacggaccgtaacgttacgacgggttacgggacgtacgggtccgggtacgtacggggaactaacgttacgtttaccaccttacctacctaaacctcttaacgaacgccgtacgtacccgtacgaccgtaaggtacctaaggtaaacggtagttacggtacgggtacctttaagggttttaacttaacgtacgtacgtaacaaaccggttttaaataaacccttttaagttcccttacccgttaacccgtacgaacgggttaacccggttaccggaaaccggtaaaccggaaccggtaaagggtaaaccgaaaacttaacgaaaaccgttacggtacggtacgacttacggaaccttaacgacgtttcccgg

SEQ ID NO: 160941 - DNA, 883 bp, Homo sapiens
  misc_feature: GYAE6OF01CI5J9.22.27.C05.1.454.CMB.1.raw
  modified_base (137)..(137): a, c, t, g, unknown or other
  misc_feature (137)..(137): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtcnccgtccggggactatcgtgatcgacccagtcctaccacgtacctcccgtggtctgtcgtctcgtgggcgaggacggccaccataccaactgacacgtccacgacgagtattacttttacagacctaccaaccgaagtaacgacgtaccttaacgttacggtacgtttacgggtaccaacggtaccgaaaacggaaaacccgacggtaacctaacctttaccccttaccttacccgttaaccttcggtacccttacgtttaacggttttaaccgggtaccggggttacccgttaacccgggttaaccccggggtaaccggttccccgggggttaaccctacggttaaccccggtacgttccggtaacgggtaccgggtaccggtacggggtaccgggtttccggtaacggggtaactaacgggttaccttttaacccgtaacccgttacccggttaaccacccgttaacgaaccggtaaccggtaccggtacggtaccccgttcgggaaccggtttaacgggaccgttaaaggggtaacgggtaccgtttacggggtaccggttaacgttttaacgttttaaaccggtttcgtaaccgtaacgggttaactaacgttaaacgtttaagtttaacctttaccgtttacccgtacctacggtaccgttacgggtaaccggaccggtaaacgggtacggtaacgaagtaaccaccggtaaagtacgcgtacgctaaccgctacgtctcgg

SEQ ID NO: 160942 - DNA, 782 bp, Homo sapiens
  misc_feature: GYAE6OF01D9X21.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatcgacccagtcctccagtacctcccgtggctgtgtctcgtcgggcgaggacggccacacgtacaactgacaacgtccagaccgtaagtacgtttaactttttacgacgtaccttaccaacctaaagtaacgacgtaccttaacgttacgtccgtttacggttaccaacgacaaacgaaaccgtacggaactaccttccttcctacgtactcgtacctacgttacgtttaccggtcgggtaccgttaccggtaacccgggtaaccggttccccggggtaccctacggtaaccgttacgttacgaaggtcgacgtacgggtccggtcgtacggactagttacttcgaccgttctacgactatcgacgtcgacgtccgtaggacgtaggtcgtaaggagtcggttcgtaggttacttttaacgttttaacgttcgtacgtacgacgttaaacttaaagtttactttacctttaaacccttccgttccgtaaaccggttacgggttaacccgggttaaccccggaaaccgggaaaaccgggttaacggtaaaggggttaaacctaaacgtaacccggtaaaacggttcgttaccggtcggttaccaccgtaaacccttagtacggtttccc

SEQ ID NO: 160943 - DNA, 629 bp, Homo sapiens
  misc_feature: GYAE6OF01A1AGC.22.27.C05.1.454.CMB.1.raw
  modified_base (621)..(621): a, c, t, g, unknown or other
  misc_feature (621)..(621): n is a, c, g, or t
tcagacatacgcgtcacgaccggtgctcgatttagacgcgatcgaagggtttgggggagctacaacaggcaggcaggggcagcaaggatggtgttgcagacccaggtcttcatttctctgttgctctggatctctggtgcctccggggacatcgtgatgacccagtctccagactccctggctgtgtctcgtgggcgaggacgggcccaccatcaactgcaacgtccagccagtagttatttttacagtctccaaccaataagagccttacttacgcttcggttccagcaacgaaaccaggacactcctcctctactgctactacttttacgtcgggtcgttccgtaacccgggtacgtcccggggttccctcggaaccgtacttcgtacggtcggacgtacggtcggggtcgtacggggactacgtactttccacctcctaccacctaactcgacgccgtacgcccgtggaccgagtccgtaagtaacgtagtcggtggtaccttagttttacttaccgtgtacacgttactaagttattcttacttccctacgtactacggtcgttaccgacggaacggacgtaaggtacggaactaacgaacgtacgtacgcgacacncgtctacg

SEQ ID NO: 160944 - DNA, 860 bp, Homo sapiens
  misc_feature: GYAE6OF01AZ47V.22.27.C05.1.454.CMB.1.raw
tcagacatacgcgtcacgaccggtgctcgatttagacgcgatcgaagggtttgggggggagctacaacaggcaggcaggggcagcaagatggtgttgcagaccaggtcttcatttctctgttgctctggatctcgtggtcgccgtccggggtactatcgtgatgtaccagtctccagactcctggctgtgtctcgtgggcgaggagggccacctatcaactgccgaacggtccagaccgagtacgttactttttacgagtcctaccacctaagtaacgacgtaccttacgttaacgtcgtttacggttaccagtacctaacggaaaccgacggtaaccactcccttaccgttacctaccgtacggaccttacgtacgttttaccggtcgggtccggtacccgttaacccggggtaacgttaccccggggtcccttacggtaaccgtacgttaccgacggtcggaccgtacgggtccgggttacgtacgggaccgtacgttacgtttaccgtaccgttacctaacgtaaccctagttaccggaccgaccgaccggttaccctacgggtacgtaacgggtaccttaagggaacggttacgttcgggttacggtaccttttaaacggttttactttaaccggtcgggttaacctaacgggtaactttaaacgtttaacgtttaccttttacctttacccgtaccccgttagggaaacccggtttccgggttaaacccgggaaacccgtaaacggggggtaaccccgttaaaggggtaacggttaaaaccggttaaccgaaaaccgggtttacggttacgggtacccgggttaaacctaccggtaacccctaaacggtttccgg

SEQ ID NO: 160945 - DNA, 603 bp, Homo sapiens
  misc_feature: GYAE6OF01BCWE8.22.27.C05.1.454.CMB.1.raw
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (377)..(377): a, c, t, g, unknown or other
  misc_feature (377)..(377): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagtctccacaataagagctactagtcttggttccagacagaaaccaggacactcctcctctactgctctattacgtggctcgtaccggtacgtcccgggtccncgaccgnttcagtggcaggcggtcgtgggacagtnttcgactctacaccatccagcacgtcctacggcaggactagaacgtagtcgtagggccttaaggttttactactacgtacagtacaaagtttacttagttacttacccgtccttagaaccggttacggttccggaacccggtaaacgggtaaaccctaaggggtaaacgtaaaacctaccggaaaaccgtaacgttagtaccgggacctagaacctaccgtaaccg

SEQ ID NO: 160946 - DNA, 782 bp, Homo sapiens
  misc_feature: GYAE6OF01AO626.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgacacgtccacgccagagttactttttacacgtcctccaaccaataagagcttacttagtcgttcggttaccagtacaagaaaccgaggacactcctcctactactgtctctactttacgtcgggtcgttaccgtacccgggtaacgtcccggggtccctacggaccgtacttcgaggtcggacgacgggtccgggttcgtaggggtaacctaggtactttaccacgttccctaccaaccctagttaccgacggacctacggtaccccttacggaccggacgggttaccgtaagggaaacgttcggttacgggttacggtaacgtttaacgtttttttaacgtttagttttacggtaaccggtaacgttaaaccgttaaagttttaaaccttttaacggtttacccttttccccgttacccccgttaaggtaacccgggtttaacccgggttttaccccgggaaaccgttaaacccggggtaacccgtaagggtaacggtaaaccgtaccgtaaaaaccgtaccggttagggtaccggtccttaacggtacccaaccgttcgttacccgg

SEQ ID NO: 160947 - DNA, 726 bp, Homo sapiens
  misc_feature: GYAE6OF01B3AN0.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatcgacccagtctccagacctcctggctgtcgtctcgtgggcgaggacgggcccaccactacaaactgaccaacgtccacgaccagtagtttactttttacacgtcctaccaaccaataacgacgtactacgttagtcgtttcggtccaagacaacgaaccagacactcctcctctactcgtctactacgtttacgtcgggtaccgtaccggtacccgggtacgtcccggggttaccctacggaccgtagttcgtaggtcggtacgacggtcgggtacgtcgggacgtagtacttcgtacctcctaccacctgtaccgacgcgacgtccgtagcgtacggctaacggaagtcgtcgggttacgtactttaacgttttacgtaacgtcgtaacgtaagtacctaaatttcgtttaacttaccttcccccgttactaccggtaacgggtttaccggtaaccccgggaacggtaaaaccggggtaccgttaaaggggtaacggtaaaaccttaaaccggaaaaccgttacgggttacgggtacggtaccgttacgaacccttaccgttaaccg

SEQ ID NO: 160948 - DNA, 692 bp, Homo sapiens
  misc_feature: GYAE6OF01BHMXF.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatgacccagtctccagacctccctggctgtgtctcgtgggcgaggacgggccaccatacaactgacaacgtccacgccagtagtttattttacacgtcctaccaaccaataagacgtactaacgttagtctttcggttaccagaccaaacggaaaccgaggaacctactcccctcctacctactcgccttactactttacggtcgggtccgttacccgtaacccggggtaacgttccccggggtaccctccggtaccgtagttccgaggtcggaccgacgggtccgggtacggtagggacgtagtactttaccgaccttcctacctacctagtaccgacgtccgacgtcctcggacgacggtacaggaagtgtaggtgtaccgtttaagtttacgttcctgtacgacgtaactaatttacgtttacttacttcccctacgacgtaaccggtacggttaccggaacgggtaacggtacggtaaacggtagtaaactaaccggaacgtaagtcggtacgtctacgacctacctgttaccg

SEQ ID NO: 160949 - DNA, 726 bp, Homo sapiens
  misc_feature: GYAE6OF01ANS3S.22.27.C05.1.454.CMB.1.raw
tcagacatacgcgtcacgaccggtgctcgatttagacgcgatcgaaggggtttgggggctacaacaggcaggcaggggcagcaagatggtgttgcagacccaggtcttcatttctctgttgctctggatctctggtcgccgtccgggacatcgtgatcgacccagtcctccgacgtacctcccgtggctgtgtctcggtgggcgaggacgggccaacatacaactcgacgaacgtccgacgccgagtagtttatttttaccgacgtacctaccaacctaaagtaacgtacgtaccttacgttacgttcgtttcggttacccgagtaccgaaacgaaaccgacggacctacctccccttaccttctacgtcgtcttacttaacgtttcggtcggtaccgtacccggtaaccccgggtaaccggtccccgggttaccctacggtaccgtacttaccggtaggtcgggcgacgggttccggtacggtacggtaacgtacggtttaccttcgtaacctccgtaccaccgtacgtacgacgcgtcggacctcgagacgagtagacgtagttggacgtacgttatttcgtagtacgacgatattaactacgtttataccctttccgaccgttccggtacgttaccgacggtaaccggtaaaccgacgggttaaacgtagtaacgtacccggtaaagtcgtaggtaccgtcgtagaccctaacgtcgttaccg

SEQ ID NO: 160950 - DNA, 826 bp, Homo sapiens
  misc_feature: GYAE6OF01C1UYC.22.27.C05.1.454.CMB.1.raw
  modified_base (817)..(817): a, c, t, g, unknown or other
  misc_feature (817)..(817): n is a, c, g, or t
tcagacatacgcgtcacgaccggtgctcgatttagacgcgatcgaagggtttgggggctacaacaggcaggcaggggcagcaagatggtgttgcacgacccaggtcttcatttctctgttgctctggactctcgtggtcgccgtccggggacagtcgtggatcgaccacgtcctaccacgtacctcccgtcggcttggtcgtcgtcgtcgggcgacggacgggaccaccgactacaacgtcgacctaacgtccgacgaccgtaagtaacgtttactttttacgacgtacctaccgaacctaaagtaacgacgtacttaacgttacggtacgttacggtaccaacgaaccgaaacggtaaaccgacggaaccttacttcccgtaccttactaccgtcgtaccttaacgttacgtttaccggtcgggtaccgttaacccggtaccgggtaaccggttcccggggttacctaggtaccgttacgtttaccggagggttccggaacggtacgggtccgggttacggacgggtaacgttacgttaaccgtttccgtaaccgttacccgtaccgtacctaacgtccgtaaaccggtctacggtcccgaggtttaccgacgggtactaaagggtaactcgggttacgtaacgtacgttttacgtttaagtacgtacgtaacgtcgtaactttaattaccgttactacccgttcgttaaccggactaacgggttcccaacggggtaacccgtaggtaaaccggtaacggtaactaaactccggtaaacgttcggacgttacgaccgttaaccgaccttaaccgtntttacccgg

SEQ ID NO: 160951 - DNA, 584 bp, Homo sapiens
  misc_feature: GYAE6OF01ASRQ2.22.27.C05.1.454.CMB.1.raw
  modified_base (578)..(578): a, c, t, g, unknown or other
  misc_feature (578)..(578): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcaagaaaccaggacactcctcctctactgctcatttactgggctcgtacccgggatccgggtcctgaccgattcaggtggcaggcgggtctgggacagtactttcactctacaccatcagcacgtcctgcgaggctagaacgagtggtgtactaggttttatacgtgtacgagtactaagttaacttacgtactttcccgtacctacgaacggttaccgttaccgggaccgtaaaacggggacccgtaaaggggtacgaaacgttacccgaaaacgtacgttagtacggcttaacggccaaccgtnttaccg

SEQ ID NO: 160952 - DNA, 1063 bp, Homo sapiens
  misc_feature: GYAE6OF01AXBCR.22.27.C05.1.454.CMB.1.raw
  modified_base (1035)..(1035): a, c, t, g, unknown or other
  misc_feature (1035)..(1035): n is a, c, g, or t
tcagacatacgcgtcacgaccggtgctcgatttagacgcgatcgaagggtttgggggagctacaacaggcaggcaggggcagcaagatggtgttgcacgacccaggtcttcatttctctgttgctcgtggatctcgtcggtcgccggtccggggacacgtcgtgactccgaccctagtcctccgacgtaccttcccgtggcttgtcgttcgtcggtcggggacgtacggaccgggtcccaaccgtaactaccgtaaacgtgaaccgtaacgtccgaaccggtaccgtaagttaacgtttttaacgttttaccgacgttaccctaaccgtaaaccgtaaagtaacgaccgtaaccgtttaaccgtacgttaccggtttaccggttacccgaacggtaacccgaaaacccggtaaaacccggacggtaaccccttaccctttacccccgttacccgttacctttaccggtcgttaccttaaccggtttaaccggttttccggtcccggggggttaaccgtttaacccccggggttaaacccccgggggttacccgggtttaccccccgggggtttacccttaacccgggtaaacccgttttacggtacccgggttaacgggttaccccgggtacggggtaccggggtttaaccgggttaccgggttaaacggggtactttacgggtttaaccgtttaccccgttaccgttaccccgttacccgtaaaccgttaccggtacccggtaacgtccgttaaccccgtgggtacccggtaacgggtccgtaaaggtacccggtaagggttacggttacgggtttaaccggtagttttttaaacccgttaagtttaccgggttcgttaaacgtaacggttaaccttttaagttttaacccgtttacccgttaccttacccccggttagtaaccggtaaaccggtttcccgggaaccgttaacccggggggtaacccgttaaacgggtaaggttaaaccgttaaacgtaacccgggttaaacgttcgggtccgaacccgggttnttaaaacccgccggtaccggtttaaccg

SEQ ID NO: 160953 - DNA, 842 bp, Homo sapiens
  misc_feature: GYAE6OF01BZCE4.22.27.C05.1.454.CMB.1.raw
  modified_base (473)..(473): a, c, t, g, unknown or other
  misc_feature (473)..(473): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctcgtggtcgcccgtccgggacatcgtgagtcgacccagtctaccacgacctccgtggctgtcgttcgtcgtgggacgaggacgggccaaccataccgaaacgtcgacgtaacgtccgaacgacctaaaggtaagtttttaactttttaaccgcgtacctaacccaaacctaaagtaagactacgttaacgttacgtcgtttcgttacacgacgaaacgaaaccgtacgaactactcctaccgtactacctcgtacttaccttaagtttaccgtcgggtaccgtaccggtaacccggggttaacgtcccgggtacctcggaacccttagttacgtacgggcgngtaccggtaggtcgtaacgactacgtactttcgacttaccgtacaacacttcgacgtacacgtcccgtacggtacggacgtaacgagtaaacgttcggttacggtaacgttaacgttttaagtttaaccgttaacgtttaccggtaagtaacttaacgttaaacgtttaactttaaactccgtttaccctaaccgttacgggtaaacgttaaccccggggtccggtaaaaacccgggttaacgggtaaaccgttaaaaacgggggttaagttaaaaacccggttaaaacccggtaaaaaccggtttccccggttaaagggttacccggtaaaccgttaccggttaaaaccccgaaccgtttaaaccggg

SEQ ID NO: 160954 - DNA, 725 bp, Homo sapiens
  misc_feature: GYAE6OF01ADIBN.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgaggacgggccaccatccaactgacaacgtccagccagtagtttaatttttacgacgtcctacccaaccaaataacgagtccttaacgttacgtcgtttcggttccacggtaccaacggaaaccacggaaccacttcccttccctctacctcgccttactattttacggtcgggtaccgtaccgtaacccggggaacgttccccggggtccctcggaacccgtattcgaggtcggcgaacgggtcgggttcgtgggacgtacgtactttccgacttcctaccgacctactaccacggacaccgtccgtcggcgtacggacgtaggaagtactgggtacgtagtttaacgtttacttacgttacgtctaacgtacttaagttaacttacttaccgttcccttaccgttacgtaacggtccggttacccgggaaccgtaaaccggggtaaccgtaacggggttaacgaaaccgtaaccggtaaaacccgtggttaacggtccggtacctccgtaaccgtaccgtttaacccg

SEQ ID NO: 160955 - DNA, 673 bp, Homo sapiens
  misc_feature: GYAE6OF01BSUPW.22.27.C05.1.454.CMB.1.raw
  modified_base (345)..(345): a, c, t, g, unknown or other
  misc_feature (345)..(345): n is a, c, g, or t
  modified_base (501)..(501): a, c, t, g, unknown or other
  misc_feature (501)..(501): n is a, c, g, or t
tcagacatacgcgtcacgaccggtgctcgatttagacgcgatcgaagggtttgggggagctacaacaggcaggcaggggcagcaagatggtgttgcacgacccaggtcttctatttctctgttgctctggatctcgtggtcgccgtccggggactatcggtgatcgacctagtcctaccacgtaccctcccgtggtctggtcgtctcggtgggcgaggtaccggccacctatcaactgacacgtccacgcagtatttagttttacacgtcctacaacctaatagactaccttattgtacgttacgtacgagtaacgaaccgagtactactccctcctactactcncttacttacttacggcggtaccgtaccggtacccgggtaccgtcccgggtaccacgtaccgtcttcgacggtacggcgtaggtccggtcgtacggtaccagtttaccgttactaccctcctaaccgactacgtaccgacgaccgtacgtcccggtnacggtacgacgtagacgtgtacgtgtactttagtttactacgtctactagattaattactttacgttaccttcctacggtacctagggttcccgtaccgtaacgggaacgtaacggtaaggtaagaaacttacgtaaacggtgtacggtacgtacgactaacctctactacg

SEQ ID NO: 160956 - DNA, 726 bp, Homo sapiens
  misc_feature: GYAE6OF01B3ANG.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatgacccagtctccagactccctggctgtgtctcgtgggcgagacgggccaccatcaactgacaagtccagccagtagttatttttacagtcctccaaccaaataagagtctacttagtcttcggttaccaagacaacgaaaccgacggactacgtaccctccttactacctgtaccttactattttaccggtcgggtccgttaccgtaaccgggtaaccggttccccggggtaccctacggtaccgtacgtacgtaggtacggacgtacggtcgggtcggtacgggtacgtaagttactttccgactacctaccgaaccctagttaccgaacgtccaacgtcccgtacgaccgtaaggtccgtagaaggtacgttagggtacggtacctttaacggttttaacgttacggttcgtaacgttaacaagtttaattaatttacgtaaccttttccctaccgttacgtaaccgttccggttaccggaacggtaaaccgggtaccgtaaagggtaccgtaaaactaacggtaaacgtacgtaggtcgggtacctccggaaatccgttaaccgg

SEQ ID NO: 160957 - DNA, 685 bp, Homo sapiens
  misc_feature: GYAE6OF01EEZUU.22.27.C05.1.454.CMB.1.raw
  modified_base (307)..(307): a, c, t, g, unknown or other
  misc_feature (307)..(307): n is a, c, g, or t
  modified_base (430)..(430): a, c, t, g, unknown or other
  misc_feature (430)..(430): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagacctcctggctgtgtctctgggcgagagggccaccatcaactgacaagtccacgccagtagttattttacagctccaacaataagagcttactagtcgttggttacccagacaagaaaccgaggaactactcctcctntaactcgccttctaatttaccgtcgggccgttaccgtaacccgggacgtcccgggtcctcgaccgtactcgaacggtgcgtaggcggtctgggactagtactttctactctcgactgacgacnctacgcccttaggacacggtacgtaagacgtaggttggtacgggacttacggtttaatttaccgtagtactaagtaactaacgtttagtttaaacctttacttaccccgtacttacgaacgggttaaaccgttccggtaaaccggtaaaaccgggacggtaaacggtaagggtaaaacctaaccccgggtaaaaacggttaccgttcggggttacccgaacggtacccaaccggtaacctaacgggtttaacccg

SEQ ID NO: 160958 - DNA, 811 bp, Homo sapiens
  misc_feature: GYAE6OF01AYZTA.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatcgacccagtctccagactccctggctgtgtctcgtgggcgagacgggccaccatcaactgcaagtccagccagtagttatttttacagcctaccacaataagagctactagcttggtaccagacaacgaacaggacatcctcctactactcgtctactatttacgtgggtccgtaccgtaacccgggtaacgtcccggggtccctacggaaccgtcgttacgtacggtacggacgtacgggtccgggtacgtacggggtaactacggttactttcccgaaccgttcctaaccctacccgtaagttaccgacggtaccctaacggtccccttcgggtaccgaacgggtacctagggtaaacgttacggttacggtacgggttaactttacgggtttttaactttaccgtcggttaacgaaccggttaaccttaaagttttaaccgttaaccttttaaccgttaccccgttaacccgttacggtaaacccggttaccggggttttaaccccgggaaaccgggttaaacccggggttaaaacccggtaaggggttaaaaccggtaaaccgttaaaaccccggaaaaaccgggtttacggttaaaccgggtaccgggttaaccccgttacggtaaaccccgttaccggtttaacccg

SEQ ID NO: 160959 - DNA, 832 bp, Homo sapiens
  misc_feature: GYAE6OF01CIREH.22.27.C05.1.454.CMB.1.raw
  modified_base (147)..(147): a, c, t, g, unknown or other
  misc_feature (147)..(147): n is a, c, g, or t
  modified_base (182)..(182): a, c, t, g, unknown or other
  misc_feature (182)..(182): n is a, c, g, or t
tcagacatacgcgtcacgaccggtgctcgatttagacgcgatcgaagggtttgggggagctacaacaggcaggcagggcagcaagatggtgtgcagacccaggtcttcatttctctgttgctctgatctctggtcgccgtccggganagtcgtgatcgaccctagtctaccgagaccgtccnggctgtgtctcgtggcgagacggacaccagtacaacgtcgacgaacgtccacgtcctagtacgtttaacttttacgacgtcctaacccgaacgtaagtaacgacgtacttaactttcgtaccgtttggtaccagtacgtaacgaaccggagactaccgtccgttaccttctacgtccgaccttacgttaactttccgggagggtcccgtaacccggttaacccggggtccgttacccggggtaccgttaacggtacccggttacgttaccgttagggtaccggtacggtacgggtacccgggtaacggtacggggtaaccttaacggttacgttttaaccctacggtttacccggttaacccaaccgttattaccggaacggttaaccgacggtttaccccgtaggtaaccgtaacggtttaccggaacgttaaaggttaacggtacccgggttttaagaccgtttttaaagggtttaccctttaaagggtaccgttacccggtaaacttaccggttaaatttaccgtttactttaaccctacccgttacccggtagtacgttaccgggtaccgacgggtaaaacgtacgggtaagtaaccgggttaaatccggtaaacgtggtccgaagtacccacgtactacgttccg

SEQ ID NO: 160960 - DNA, 841 bp, Homo sapiens
  misc_feature: GYAE6OF01CMGE0.22.27.C05.1.454.CMB.1.raw
  modified_base (442)..(442): a, c, t, g, unknown or other
  misc_feature (442)..(442): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatcgacccagtctccagacctccgtgctgtcgtctcgtgggcgaggacggccacctactcaacgtcgacacgtccacgcacgtaagtttactttttacgacgcctacctaaccaaagtaagacgtaccttaacgttacgtcggttttacggttaccacgaaccgtaaacggaaaaccgtaacggaacctacctacccttccctactaacttcgacttactaacgttacgtcgggtacgtacccggtaaccgggaccgttcccggggtccctacgaccgtctaccgngtacggcgacgggtcggacggttggacctaagttacttaccgtaccttacgttacccaacctacgtaacgaccgaacgtaccggtccctacggtaccgaacgggttcgtaaggtaaacgtttacgggccgggttaacggtacgttttaaaccggttttacttaacgggttacgttaccggtaacttaaacttaaacgtttaacgttttaaccgtttaccctttaccccgttaccctaaacccggttacgggttaaacccgggtttacccggaaacccggtaaaacggggtaacccgttaaaagggggttaactaaaaaaacccgggttaaccgtaaaaaccgggttaaccgtcgggttaaccgggtacccggtaaaccgtccgttaacccggttaaccg

SEQ ID NO: 160961 - DNA, 604 bp, Homo sapiens
  misc_feature: GYAE6OF01AOZ8N.22.27.C05.1.454.CMB.1.raw
  modified_base (323)..(323): a, c, t, g, unknown or other
  misc_feature (323)..(323): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatccaactgcaacgtccagccagtagttattttttacacgtcctaccaccaataagagcctacttagcttggttccagtcagtaaaccaggacatcctcctctactgctcatttacgnggcgtctaccgggatccgggtcctgaccgatcagtggcagcggtcgtggacagtactttcgacctctccaccgtatccgagcctagccctgacgacggtctaggaagtatggtggtactagtttacttacgtgtacagtactaattacgtttattacgtttccctaccgttacaccggtacgttaccggaccgtaaacgggaccgtaaagggtacggtaaaacgtaccgtaaaacggtacttacgggtaccggtactaccgacctaaaccctcggttaccg

SEQ ID NO: 160962 - DNA, 759 bp, Homo sapiens
  misc_feature: GYAE6OF01EE5Z4.22.27.C05.1.454.CMB.1.raw
  modified_base (492)..(492): a, c, t, g, unknown or other
  misc_feature (492)..(492): n is a, c, g, or t
  modified_base (747)..(747): a, c, t, g, unknown or other
  misc_feature (747)..(747): n is a, c, g, or t
  modified_base (752)..(752): a, c, t, g, unknown or other
  misc_feature (752)..(752): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatcgacccagtctccgacgtacctccgtgtcgtgtcgtctcggtcgggacggagggaccggacccaacctactaacctaacgtcgaaccgtaaccgtaccgaaccgaccgtaaggtttaatttttaacctttttaaccgaccgtacccctaacccaaaacgtaaaacgtaaaggtaccgttaccttttaacgttaccgtttccggtttaccggtacaacgaaccgaaaacgaacgacgtacctaccttcccttaccttactctcgtcttacttacgttcggacggtaccgtacccggtaaccggtaccggtcccggtcctacgtaccgtatccggnggtcggacgtacgggtccggtggaacggtacgtacgtttactacctcctacctacctactactacggacgacgtaccgtcgtaggacggtacgtacaagggtacttggtggttactattttagtttaacgtcgttacgaaccgtacgttaaatttaagttactttaaccttcccttacctacgtacgtacgtacccgggtcgaaaccggtaggaaacgttaggtaacaaacgtaacgtaacgtagtcggtaactnaaccnctactcg

SEQ ID NO: 160963 - DNA, 593 bp, Homo sapiens
  misc_feature: GYAE6OF01EP065.22.27.C05.1.454.CMB.1.raw
  modified_base (241)..(241): a, c, t, g, unknown or other
  misc_feature (241)..(241): n is a, c, g, or t
  modified_base (505)..(505): a, c, t, g, unknown or other
  misc_feature (505)..(505): n is a, c, g, or t
  modified_base (531)..(531): a, c, t, g, unknown or other
  misc_feature (531)..(531): n is a, c, g, or t
  modified_base (577)..(577): a, c, t, g, unknown or other
  misc_feature (577)..(577): n is a, c, g, or t
  modified_base (583)..(583): a, c, t, g, unknown or other
  misc_feature (583)..(583): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatgacccagtctccagactccctggctgtgtctcgtgggcgaggaggccaccatcaactgcaagtccagtcagtagttactttttanagtacctccaaccaaataagagtacttaacttagtctttggttcccagacaacgaaaaccaggaacctacttccctacctccttactcgtcctctattacggtggtcgtaccggtaccgggtacgtccgggtcctacgtacgtattccgaggtcgcgacggtcggtcgaggacgtacgtacttccgtactacctaccaccgtatccgaacgctaacggccctggacacggtacagtaacgtgtaggtcgtcgtagtttatcgtnacgatataattcgttattaccttccngtactcggtcgtacgaccggaatacggaggtacaactacgaacgtngcttanctcatgtacg

SEQ ID NO: 160964 - DNA, 946 bp, Homo sapiens
  misc_feature: GYAE6OF01CYS8D.22.27.C05.1.454.CMB.1.raw
  modified_base (169)..(169): a, c, t, g, unknown or other
  misc_feature (169)..(169): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtcgccgtccggggacatcgtgatcgaccagtcnccagcctcctggctgtgtctcgtgggacgaggacggccaccactacaacgtcgacgtaacgtaccacgacctagttaagtttactttttacacgtcctacccaaacctaaagtaagacgtaccttacgttacgtccgttcgttaccagacaaacgaaccgacgactaccgtacccttcctacctacgtctaccgttaccttacgtttacggtcgggtaccgttacccggtacccggggtaaccggttccccgggtacccgtacgaccgttagttaccggtacgggtccggtacggtacgggttccgggtccggtacggggtaacgtacggtttactttaccgtaacccgttcctaacccgtaacccttacgtacccggtaaacggtccgtaacccgacgttcccgggagtaaaccgggtcgtttaaaccggggaagttacgggttacggttaaccggtttacgttttaaacgggtttttaacctaaccgggttttcgtaaaaccgtaacgggtttaaactttttaaaaacccggttttcttttaaaccgtttaaccccgtttttaccccctaccgggttttaaaccccggtaaaaacccgggtttaccccgggggtttaaacccgggtaaaacgggaaaaccccgggggttaaaaccgggtttaaaacgggtaaaaacgggttaaaaacccttaaacccggggtaaaaaccgtttacggtttaacccgggggaccgtttacccggaaaaccgttcccgttaaaacccgtttcccggg

SEQ ID NO: 160965 - DNA, 848 bp, Homo sapiens
  misc_feature: GYAE6OF01D856U.22.27.C05.1.454.CMB.1.raw
  modified_base (154)..(154): a, c, t, g, unknown or other
  misc_feature (154)..(154): n is a, c, g, or t
tcagacatacgcgtcacgaccggtgctcgatttagacgcgatcgaagggtttgggggagctacaacaggcaggcaggggcagcaagatggtgttgcagacccaggtcttctatttctcttgttcgctctggatctctggtgccgtccggggacntacgtgatgacccagtctcagacctccctggctgtgtctcgtggcgaggcggccaccactacaactcactaacgtccacgccagtacgttactttttaacgacgtccgtaccaaccgtaataagacgtacttacgttacgtcgtttcggtccagaccgtaaacgaaaccgacggacctacctaccttccttactaccgtcgtactaccttacgtttaccgtcgggtaccgtacccgggtaccccgggtaccggttacccgggtcccgtaccgtaaccggtacttacgtacgggtcgcgtacgggccggtacggtagggtactacgttacgttaccgtacccgtaccttaccgaaccctagtaccgaaccggttacccgaccgtcccgtacggtaccggtaacgggaccgttaagggtaaagttcccggttacggggttacgtaacccgttttaagtttttaccggtttaaccgtagttaccgtaaagttacgttaaacgtttttactaaccgtttcccgtttacctacccgttacggttaaaccggttcccgggtttaaacccggaaacccgggttaaaacggggttaaacccgttaaacgggggttaaaccgtaaacgttaaacccccgggaaacggttaacggtccggggtttacggaacccgttaccggaccccgtaaaccggtttcccgg

SEQ ID NO: 160966 - DNA, 698 bp, Homo sapiens
  misc_feature: GYAE6OF01CTGWJ.22.27.C05.1.454.CMB.1.raw
tcagacatacgcgtcacgaccggtgctcgatttagacgcgatcgaagggtttgggggagctacaacaggcaggcagggggcagcaagatgggtgttgcagaccccaggtcttcatttctctgttgctctggatctctggtgcctaccggggacatcgtcgatcgacccagtctccagactcctggctgtgtctcgtgggcgaggcgggccaccgataccaacgtcgcaacgtccagccagtacgttatttttacgacgccttaccaactaaataacgagtacctacttagtcgtttcggttccagacaacgaacgacggactactcctacctctacgtcgtactctatttacggtcgggtccgtaccggtacccgggacggtcccgggtcccgtacgtaccgtacttcgaggtcggcgtaggcgggtcgtcgggactaggtacttcctacctcctcctaaccgactccgagccgacgcctcggcgaaggtccttagggaacgtgttcgggtagttacgtttaacgtttacttacgttgggtaaccaggttaccttaaagtttctttacgttacctttcccgtaccgtacgtacggtacccgggttaccgaccgggtaaaccggggaacggttaacggttacggaaaactaccgtaaacggttacgttacggacgggttcaacggtcctaaccgttacg

SEQ ID NO: 160967 - DNA, 803 bp, Homo sapiens
  misc_feature: GYAE6OF01ER9J8.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtacggggacattgtgagtcgacccagtctccagacctcccgtggctgtgtctcgtcggggcgaggacggaccaccactaccaacgtgaccaacgtccgaacgccgaagtaagttactttttaacgacgtcctaccaaaccaaagttaagtaacggtttaacttaacggtcgttagggttccaagtacgaaacgaaacgaacggtactacgttccgtccgagtcctaagtcgtacgttacttacgtttacggtcggtacgtacccggtaaccgggtaacgttccccgggacctacggccgtagttaccgaaggtcggacgacggtcggttacggacggtacgtacgtaccgtttaccgaccctttaacccgtctaacccgtaatcccggtaaaccgccgacggttaccccggtaagtaccgagaacgtttaccggaagtttcgtacggggttacctaaggtttaagttttaatttcccgggtaagtaccggttaataaaacccttaagttcgttttaaactacccccggtttacgtaacccccttacggttaaacgggtacccgggtttaacgaaacccggtaaaagggtaaccggttaaagtaaacggtaacctaaaggtaaccagggtttacaccggtacgacctaacccgtgttccttacgg

SEQ ID NO: 160968 - DNA, 966 bp, Homo sapiens
  misc_feature: GYAE6OF01B8AVB.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatcgacccagtcctccagacctccctggctgtcgtctcgtgggcgaaggacgggccaaccatacaactgacaacgtccagaccaagtagtttactttttacacgacctaccaaccaaataagacgtaccttaacgttacgtcgtttacggttaccaagtaccaaacgaaaacccgaaggaacctaacttccccgtttacctaccttaacgtcgaccttactaattttacgtcggggtccgttaacccggtaaccccggggtaaaccgttccccgggggtaccctacggtaaccccgtagtttaccgacgggtcggacgaacgggtccgggtacgtacgggaactacggtacttttaccaccgttacttaccaacctacgttaccgacggtaccgaacgtaccgttacgaccggtaacggtaccggtaaggtaaacgtaacggttacgggtacgggttaaccgtttaaggttttttaaccggttttaacgtttaccggtaaccgttaaacgggtaaaccctttaaaactttttaaacgttttaaacccgttttaaaccgtttccccccgtttaaacccggttaacccggttaaaaccgggtttaacccccgggggttttaaacccggggaaaaacccccccgggggttaaaaaaaggggggttaaacccccggtttaaaaaaggggggttaaacctaaaaaaacccggtttaaacccgtaaaaaaacccggggttaaacggtttaccgggttaacggggtaaccccgtaaacggtaacccccctaaaaccgtttaaccggttttaaaccccgg

SEQ ID NO: 160969 - DNA, 634 bp, Homo sapiens
  misc_feature: GYAE6OF01EULCN.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagagttatttttacagtctaccaaccaataagagctacttagcttggttccagacaagaaaccaggaacactccctcctcctactgctctatttacgtgggcgtccgtacccgggaacgttcccggggtccctcggaccgtacttcgagtcggcgtacggtcgggtcgtcggggaactacgtactttaccgacttctaccaccgtatccaacgcacgccgtagaccgtaggcctaggaacgtagttacggtcgtacttagttttacttacgtgtacaacgtactaattacgttaattaccttcccttacctacgtaggtaccggttccggtaaccgaaacgggtaacccgtaagggtaagtaaactacgaaaccgtacttaggtcgtactacgaccctacgtaacgttcg

SEQ ID NO: 160970 - DNA, 640 bp, Homo sapiens
  misc_feature: GYAE6OF01DXIUL.22.27.C05.1.454.CMB.1.raw
  modified_base (609)..(609): a, c, t, g, unknown or other
  misc_feature (609)..(609): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgtttctctggatctctggtgccgtccggggacatcgtgatgacccagtctccagactccctggtctgtgtctcgtgggcgaggacggggccaccataccaactcgacaacgtcccagcccagtagtttaactttttacagtcctaccaccaataagagtctacttagtcttcggttaccagacaagaaaccgaggtacactccctcctctactcgcttctatttcgtcgggcctaccgtacccgggtacggtcccgggtacctcgaccgtattcaggtcggcgacggcgggtcgtgggactagtactttacacgtcctactacactcgacgccacggtcctcgaccgtagacgtagagtgtcggtagtcgtacgttttactcgtagtcaagactaattattactaccgttcctccgtaacggtacgtaccggtccggaacccggtaaacggggtaccgtaaacgggtaacgaaacccgtacgaaaacccggtntacgggacgtactacgaccactcgtcgttcc

SEQ ID NO: 160971 - DNA, 286 bp, Homo sapiens
  misc_feature: GYAE6OF01DEZYI.22.27.C05.1.454.CMB.1.raw
  modified_base (259)..(259): a, c, t, g, unknown or other
  misc_feature (259)..(259): n is a, c, g, or t
  modified_base (261)..(286): a, c, t, g, unknown or other
  misc_feature (261)..(286): n is a, c, g, or t
tcagacatacgcgtcacgaccggtgctcgatttagacgcgatcgaagggtttgggacagatttcactctcaccatcagcagcctgcaggctgaagatgtggcagttttattactgtcagcaatattatattcctcctcagtacgttcggccaagggaccaaggtagaaatcaaaacgactgtaggctagcaccatctgtcttcatccttccgcatctgaacgcgtatgtctgaggcgggctggcaaggcgacagtagcntnnnnnnnnnnnnnnnnnnnnnnnnnn

SEQ ID NO: 160972 - DNA, 734 bp, Homo sapiens
  misc_feature: GYAE6OF01E4MEQ.22.27.C05.1.454.CMB.1.raw
  modified_base (726)..(726): a, c, t, g, unknown or other
  misc_feature (726)..(726): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctcgtggtcgccgtccgggacatcgtagacgtcgaccagtcctccacgacctcccgtggctgtcgtctcggtgggcgaggacgggccaactatacaacgtcgacaacgccacgccgtagttacgtttacttttacacgtcctaaccaacaaacgtacgacgtacttaacgtttacgtcggttacgtacgaacgacgaaaccaaaccggtacgaactcctcctaccttactacctcgtctacgtttacgttaccggtccggtaccggtacccggtacgggtacccggtccggtccgtacgaccgttactaccgggtaggtcgggacgtacgggggtaacccgtcgggtacggtaattaccggttaccttacctacggtaccctacgtaaccgtactcggtacgtaccgccggtacgtcgaacgggtacgtacgtaacgtacgggtcttacggtacgttacgtttacgttaacgttcgtagtactacgttactaattacgtttacttacctaccgtactaccggtacgttacggtaaccgtaccggaacgtacgaacggtaacgtaaactacgaacgtacggtcgtacgtcatacccgtnttacgttc

SEQ ID NO: 160973 - DNA, 777 bp, Homo sapiens
  misc_feature: GYAE6OF01CJFWS.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccgggacatcgtgatcgacccagtcctccgacgacctcccgtggctggtcgtccgtcgtgggcgaggacgggccaccagtcaacgtcgaccgtaacgtaccgacgcccgtaaggtaagtttacttttttacgacgtccctaaccaacctaaattaacggtagtttaaccgttacgtcgtttacggttacccaagtaccgaaacggtaaaccgacggacctagttcccgtacctcgacgtactcgcttaccgtaagttttacggtcgggtaccgttacccggttaaccccggggtacggtaccccgggtcccgtacggtaaccgtagttccgtaggtcggacggtacgggtcggtcggtacgggtaccagttacgtttccgaccttcgtacccgaacctacgtaccgacggttaccacggcctcggaacggtgtaccggttaggaacgggtacgttagggtcgtaacgtttagttttaccgttaagttcgtacgtaacgtaacttaagttaacgtttacttacctttaccgaccgttcgtaacggttacggtacccggaacggtaaccggtaagtaaacgggtactaaacgtaccggtaaacgtacgtcggtacgtacaccgactaccgttgtaaccg

SEQ ID NO: 160974 - DNA, 763 bp, Homo sapiens
  misc_feature: GYAE6OF01D1LKN.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccgggacatcgtgatcgacccagtctccacgtacctccgtggctgtgtctcgtggcgaggacggccacactcaactcgacacgtccacgaccagttagtttattttacacgtcctaccaactaagtaacgacgtacttacgttacgttaccgttcggtaccaacgaccgaaacgaaacccgacggtacctaccgttccctaccttacctacgtcgtaccttactacgtttccggtcgggtaccgtacccggttacccgggtaccggttccccggtaccctacggtaccgtacgtcgtacggcggtacgtcgggtacgggtacggtacggtactacgttaccgttccgtaccttacacctacctacgtacgaccgtcgtaccgtccgtacgacggtacgttacgacggtaacggttaggttacgtacggttaaccgtttacgtttaacgtttctacgggtaactaactacgtttaaactttacgtttaacccttaccgttaccgtacgtaaccgtaaccgggttacccggtaccggtaaaacccgggtaacgggtaaacccgttaaggggaaaccttaacgaaccgtaaggtaccgttggaccggtactaccgtactcggtc

SEQ ID NO: 160975 - DNA, 803 bp, Homo sapiens
  misc_feature: GYAE6OF01CUA64.22.27.C05.1.454.CMB.1.raw
  modified_base (666)..(666): a, c, t, g, unknown or other
  misc_feature (666)..(666): n is a, c, g, or t
  modified_base (675)..(675): a, c, t, g, unknown or other
  misc_feature (675)..(675): n is a, c, g, or t
  modified_base (682)..(682): a, c, t, g, unknown or other
  misc_feature (682)..(682): n is a, c, g, or t
  modified_base (791)..(791): a, c, t, g, unknown or other
  misc_feature (791)..(791): n is a, c, g, or t
tcagacatacgcgtcacgaccggtgctcgatttagacgcgatcgaagggtttgggggctacaacaggcaggcaggggcagcaagatggtgtgcagacccaggtcttcatttctctgttgctctggatctctggtcgcccgtccggggacactcgtgatcgacccgtagtcctccgagacctcccgtggtctcggtcgtcctcggtgggaccgacggacggaccctaactacgtaccaactcggacgaaccggtccgacgtaccgtaagttacgttttaacttttaccgacgtaccctaccaaccgtaaagttaaccggagttacccttacggttacgtccggtttacggtacccaaggtaccgaaacgtaaacccgaggtaacctaccgttaccccgttcccttaacttaccggtcgtaccctttaacgttttaacggttacggtaccggggtacccgttacccgggtaacccggggtaccggtttaccccggggcccttaacggtcccggttaacgtttaccgggaaacgggtttcgggaccgggttacgggtaccgggttaccggacggtaacgtacttaacggtccctacgtacctacgtaaccgtcgtaacgcgcgttacgcctacgacgtacgagtacgaaggtctaggacttaacggttnttacgtaanctaacgntaactacgttactaccgttacttcctacgttcgaccgggtttcaacccggacgtaaggtaccgaaggtactaaccgacgtacgagggtcccgtagaccagtaacccgtnttaagggtaccc

SEQ ID NO: 160976 - DNA, 728 bp, Homo sapiens
  misc_feature: GYAE6OF01BZTQY.22.27.C05.1.454.CMB.1.raw
  modified_base (516)..(516): a, c, t, g, unknown or other
  misc_feature (516)..(516): n is a, c, g, or t
  modified_base (539)..(539): a, c, t, g, unknown or other
  misc_feature (539)..(539): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtcgccgtccggggacagtcgtgatcgacccagtctccacgacctccctggctgtcgtctcgtgggcgagacgggccaccgactccaactgactaacgtccagccagtagtttactttttacgacgtcctacccaacctaaagtaacgtagtttaacgttagtccgtttagttaccagaacctaacgaaaccaggaacacgttccgtacctgactctgctacgtacgttacgtcgggcgtaccggtacccgggtaacggttcccgggtacctcggaccttagtccgagtcggacgaggccggttagacgggactacgtactttcgactcctacacctacgaccgacgacgacgcccgtcggacgtacggtaccgtagaagnggttacggtcgtacttaggtttnttacggttacgtaccgtagtaccgttaagttaacgtttacctttaccgtttaccctaccgttaaccggtaacgtaccggggtttacccgaaacccgggtaacccgggtaaaaccggttaaacgggtaaccggtaaaaacgttacgaaaacccgtacggttcggaacgtccgtacgacctaacggttacc

SEQ ID NO: 160977 - DNA, 686 bp, Homo sapiens
  misc_feature: GYAE6OF01BTR13.22.27.C05.1.454.CMB.1.raw
  modified_base (183)..(183): a, c, t, g, unknown or other
  misc_feature (183)..(183): n is a, c, g, or t
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
tcagacatacgcgtcacgaccggtgctcgatttagacgcgatcgaagggtttgggggaggctacaacaggcaggcaggggcagcaagatggtgtgcagacccaggtcttcatttctctgttgctctggatctctggtgccgtccggggacatcgtgatcgacccagtcctccagacctcccgnggcctgtgtctcgtcgggcgacgagggcctaccatcaactcgacaagtccagccgaagagtttacttttacagtctaccaacgtaagtaacgaagtcctaacgttagacgtttcggtaccagacaaacgaaacccaggaccaatcctactctactacgctactacttacgtgggcctacgtaaccgggtaactcccgggtcctcggactacgtctacgnggcgacggcggtacgagggaccngtacttacgctcgtaacacctagccgaagaccgtacgcgttcgaccgaagtcgtaacgaacggtacgtaggtcgtacggttatttaacgggttactacggtactaaccggtattaaattaacgtttaacgttccttacccgtagtaccgtaacggttaccggtccggtaaacgaaacccggggtaccgttaaggggaacgttaaaacggaaccaaaaccggttaacgttacgcgggttaaccaccggaccttaccgtaacg

SEQ ID NO: 160978 - DNA, 703 bp, Homo sapiens
  misc_feature: GYAE6OF01DVWJ0.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatcgaccagtctccagactccctggctgtgtctcgtgggcgaggacggccaccatacaaactgacaacgtccacgcctagtaagtttactttttacacgtcctaccaactaaagtaagacgtacttaacttacgtcgttcgttccacgacaacgaaacgacggacctactccgtccttactacgtcgtcgtactacgttacggtcggtcgtaccgtacccgggacgttcccgggtcctacggaccgtagtcgtacgtcggacgacgggtcggtccgtacggactacgtttcttctaccgtctaccacctagtaccacggtacgacccgtcgacggtacgacggtcgtaagtaaacgtgggttaccgtagtacccgtttaagttttaaccgttcgtacgacgttaaggaacttattttaacgtttctaaccctttcgtacctaggtccttaccggggttacccggaaggaaacgggtaacccgtaagggttaaacgtaaacgaaaccgtaacgtaaccggttgtacggataccgaccgtaccttacgg

SEQ ID NO: 160979 - DNA, 719 bp, Homo sapiens
  misc_feature: GYAE6OF01BVJJE.22.27.C05.1.454.CMB.1.raw
  modified_base (662)..(662): a, c, t, g, unknown or other
  misc_feature (662)..(662): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatcgaccctagtctccagacctcccgtggctgtgtctcgtggcgagacgggtcccaccataccaacgtcgacaacggtccagacccaaggtagttttaactttttacgacgtcctacccaaacgaaataacggacgtaccttaacttaggtaccttttacggttaccaaggacctaaacgaaaaccggaggtaacctactcccttaccgtcctactgtacctactagtttaccgtgggtccgtacccggtaaccggaacgttcccgggtaccgtacgtaccgttactcgtacggtcggagtacgggcgggttgtcgggaactacgtagttccagtcctaccacgtatcgagtacgaccgtcgtcggcgtacggatacggaacgtaggtccggttacgtagtttacgtttacgttactcgtagaaccgtattaacgtttaacttacttacttcccgtacctagtaccgtaccggttacccgacggaaaccgggtagtaacgggtaanaaaccgtaaaccgtaaaggtacggttacggaccggtagcccgtacgtacccgttacg

SEQ ID NO: 160980 - DNA, 779 bp, Homo sapiens
  misc_feature: GYAE6OF01EWIZ3.22.27.C05.1.454.CMB.1.raw
  modified_base (186)..(186): a, c, t, g, unknown or other
  misc_feature (186)..(186): n is a, c, g, or t
  modified_base (566)..(566): a, c, t, g, unknown or other
  misc_feature (566)..(566): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacctagtctccagacctccctggctgtntctcgtggcgagagggccaccatcaactgacaacgtccagccaggtagtttatttttacacgtccttaccaaccaagtaagacgtacttacttagtcgtttacggttccaacgacgtaacgaaaaccgacggtacaacgttccctccttacgtactcgtcttactacgttttacgtgggtaccgttacccggtacccgggtaaccggtcccggggttacccctggaacccgttacttacgtagtcgggacacggggtccggggtacggtacggggtacgtaagttactttaccgaccgttaccttacccaacccttagtaccgagtacccgtacggtaccccttaggcccgtaagggtacctttagggaaaaccgggttnttcggggtacgtaaccgtttaactttttacgttcgtacgtacgtaacgtactaaaggtttaccttatttaaccgtttccctactacgtaccgggtttacccggtacgtaaacccgggtaagggttaaacccaagggggttaaacgaaacgtaacggaaaaccgtttccggtaaccggtttaggaccggttcttaaaccccggtcttaaacccg

SEQ ID NO: 160981 - DNA, 735 bp, Homo sapiens
  misc_feature: GYAE6OF01DWZEW.22.27.C05.1.454.CMB.1.raw
  modified_base (544)..(544): a, c, t, g, unknown or other
  misc_feature (544)..(544): n is a, c, g, or t
  modified_base (704)..(704): a, c, t, g, unknown or other
  misc_feature (704)..(704): n is a, c, g, or t
tcagacatacgcgtcacgaccggtgctcgatttagacgcgatcgaagggtttgggggagctacaacaggcaggcagggggcagcaagatggtgttgcagacccaggtcttctatttctctgttgctctggatctctggtcgccgtccggggacatcgtgagtcgaccctacgtcctccagcctcccgtggctgtgtcgtcggtgggcgagacggcccacctactacaactcgactaacggtccacgccgtagtagtttactttttacacgtacctaccaacaaagtaacgaacgtaccttacgttacgttcgtttaccggttaccagaccgaaacgtaaaccgacgtaacctaccttccccgtaccgttacctaccgtcgtacttaccgttaggtttaccggtcgggtacccgttacccggtaacccgggtaccggttccccgggtacccgtaacggtaccgtacgttaccgagggtcggtccgtacgggtcgggtcggtaacggacgtacgttacgttacctacgttacccacgtaacctacnccgactacgtccgtcgtcggacgtacgctaagggacttgtcgggtaagtccgtttatttagttccttggatacggtaattatacttcttactcgtcctacggtccgtaaccgggttccgaacgaaacggtacgtaagaacgttaaagaaccggttaaacncgggtacgggtacgacttaccgataccgtcg

SEQ ID NO: 160982 - DNA, 956 bp, Homo sapiens
  misc_feature: GYAE6OF01EKXG9.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatcgacccagtctccagacctccctggctgtgtctcgtgggcgaggacgggcccaccatacaactgacaagtccacgccagtacgttatttttacacgtcctaccaaccaaattaagacgtaccttaacgttagtaccgttttcggttacctaacggaccgtaaacggaaaacccgtaacggggaacctaaccgtttccccgttcccttaccgtttaacccgttcggtaccctttaccttaacgttttttaacccggttcgggggtaccccggttttaacccccgggttaaaccccccgggggggtaaaaccgggtttcccccccgggggggtttacccccgttaaccggggtaaccccggttaactttaccggtaacgggtcgggtaccggtaacgggtccgggggttccgtaaggggggtaccgtacggttaacgttttaccgaccctttacctacccgtaacccgttacgttaccgaccggtacgtaccggtaccccggtcggaaccgtaccgggtcgtaacgggaacggtacgttacggggtcggttaaccgtttagtttttaacggtttaccgttacggtaccgtacgggttaaccctaaaccgttttaaacgtttaaaacttaacccggttccgggtttaccccctaccgggtttaacggtttaccggttttaccggggaaccccgggttaaaccgggggtaaccgtaacgggtaccggttagggaaccggttaacggtaaaaccgtaaaacccggttaacggttcgggttacggtcccgttacgggtaaccccg

SEQ ID NO: 160983 - DNA, 775 bp, Homo sapiens
  misc_feature: GYAE6OF01BDNXF.22.27.C05.1.454.CMB.1.raw
  modified_base (514)..(514): a, c, t, g, unknown or other
  misc_feature (514)..(514): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatcgacccagtctccagacctcccgtggctggtgtctcgtgggcgaggacgggccacgatacaactgacgaacgtccagccgaagtagtttactttttacgacgtacctaccaacctaaagtaacgacgtacttaacttagtcgtttcggttaccacgactaacggaaaccgaggaacctactacccttccgtacctaccgtcggtaccttaccgtacgttttaccggtcgggtaccgttaccggtaacccggggtaacggttcccgggtaccctacggacccgtagttaccgacggtcggacgtacgggtccgggttcggtagggtaacctagtacgttccacgttcgacctaaccngtaccgagtccagtcccgtagggacctagggacctaagggtaacgtcgttcgggtacgtactttaacggttttactaccgggttctacgaacgtacccgttaaattaagttaaccgtacgggttacccgaccgtttaaccgggttgtttaaacggggttcccggaaccgggtaacgggtaacccgagggttcgtaacggggtaaccgtacgtaaaccggtaaaaccggttcggtcggggaccttacccgtaggaacccccg

SEQ ID NO: 160984 - DNA, 718 bp, Homo sapiens
  misc_feature: GYAE6OF01B39ML.22.27.C05.1.454.CMB.1.raw
  modified_base (436)..(436): a, c, t, g, unknown or other
  misc_feature (436)..(436): n is a, c, g, or t
  modified_base (447)..(447): a, c, t, g, unknown or other
  misc_feature (447)..(447): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatcgacccagtctccagacctccctggctgtgtctcgtgggcgaggacgggccaccatacaactgacaacgtccagccagtagttatttttacacgtcctaccaaccaataagactcttaacgttacgtcgttcggttaccagacaacgaaaccgaggactactccctccttctactcgcttactatttacgtggtccgtaccgtaacccggtacgttcccgggtcctacggaccgtagttacgacgtcggcgacggtcgggtcgtgggacagtacttacnctcgtcacctntacgtagccgtacgtccctagccgagggtacctagggtaacgtagtcggttacggtacctttaaggtttttacttaccgtcgttaactaacgtaagttaactttaacgtttaacttcctttaccctacgttacgtaaccggtttaccgggtcccggtaaaccgggtaaacggtaacccggttaaaggaacccgggttaaaaacttacccgggtaaaaccgttaaccggtttacggaacgggttaccctaccgggacctaaccggttacccg

SEQ ID NO: 160985 - DNA, 810 bp, Homo sapiens
  misc_feature: GYAE6OF01A08Y8.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtccttcatttctcttgttgctctggatctctggtcgccgtcccggggacatcgtgatcgaccagtcctccagacctccctggctgtgtcgtcgtgggcgaggacggccaccatcaactcgcacgtccacgacctagtagtttactttttacgacgtcctaccaaccgtaaatacgtaacgtaccttacgtaacgttcgtttcggttaccacgtacaacgtaaaaccgaggtacctaacttcccctaccgttctaaccttcgtccgtactacgttttaacggtcgggtacccgttacccggtaacccgggtaaccggttcccgggtacccctaccggaaccgttacgttaccgacggttacggcggtacgggtccgggttacgggacggtaacccgttcgtttaaccggtttccacccgttacctacccgtaacctaccggtaccaccggacgttacgtcccggtacgacgggaacgtaccgaggtaagtcggtccgtaggtaccgtttacggtttataaccgttgtaacgtaccgtaacttaaattacgttacttaaccgtcccgttaaaccgtggttaacccggtacgttacccgggggtaaccccgaaaaggggttacccgtaaaggggtaaacgtaccgttaaaaccgtaaacggaaccgttcggtaacgtaaccggtacgttacccgtacccgttaaacgg

SEQ ID NO: 160986 - DNA, 663 bp, Homo sapiens
  misc_feature: GYAE6OF01CBJ7U.22.27.C05.1.454.CMB.1.raw
  modified_base (648)..(648): a, c, t, g, unknown or other
  misc_feature (648)..(648): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtcgccgtccggggacagtcgtgatcgacccagtcctccacgacctccctgctgtgtctcgtgggcgaggacggaccaccactcaactcgacaacgtccagaccaagtagtttatttttacacgtcctaccaactaaataacgtactacttacttacgtcgttcggttaccacgacgaaacgaacgacgacctactcctcctactacgtcgtctacttacgttacggtcgggtaccgtaccggtaacccgggtaccgtcccgggtacctcggaccgtcgtacgacggtcgcgacggtcggtacggtacggtactagtacttactacgtctaccgacactcacgtcgacgccgtcggacgtacggcgtaagacgagttcggagtacttagttacttcagtcagtacctaattactttactaccttccgtacctcgaacggttccgttaaccggaccggtaaacgggaacgtaaggtaacccgaagtaaaccgaacggttagtcggtacgacgtacnctaacccgtgtaccg

SEQ ID NO: 160987 - DNA, 970 bp, Homo sapiens
  misc_feature: GYAE6OF01BPZZ3.22.27.C05.1.454.CMB.1.raw
  modified_base (152)..(152): a, c, t, g, unknown or other
  misc_feature (152)..(152): n is a, c, g, or t
  modified_base (170)..(170): a, c, t, g, unknown or other
  misc_feature (170)..(170): n is a, c, g, or t
tcagacatacgcgtcacgaccggtgctcgatttagacgcgatcgaagggtttgggggagctacaacaggcaggcaggggcagcaagatggtgtgcagacccaggtctcattctctgttgctctggatctcgtggtcgtccgtccggggaacntcgtgactcgaccagtcnccgacgcctccgtgctggtcgttctcggtgggcgacggacggcctacgatacaactgacacgtaccagaccagtacgtttactttacacgtcctaccaacaagtaacgacgtacctaccgttacgtacggttcgttaccgacgaacgaacgaacgaacggacctaacgtccctctaacctcgtactctacttacgtacgtcggtccgtaccggtaccggtaccggtccggtagtccccccccgtaagtacgtacgtaggtccggacgtacgggtcggtacggtacggttaacgtacgttaccgttaccgtaccgtacccgtaaccgtaccgtaaccgtaccgtaaccgaccggttaacccgtcccggttacggtccggttaaccgggtacccgggtaaacggttaaaccgggttaacgtaccgggtttaaccgggttaacggttaaccggtttttaacgtaaccggtttaacccggtaccgttaaacgggtttaccttaaaaccggttttaaaccgtttaaccggttttaaccctttaccggttaaccccggttacccgttaaaccgggggtaaaccccgggttaccccgggttaaaaaccgggggttaaaccggggtaaacccgggggtttaaaaccgggttaaaacggggtttaaaaacccccgggttaaaacccgggggttaaaaaacccgggttaaaacccgggtttaaccccggggttaaccccggggttttaaaacccgggaaacccccgggggtttaaccccggtaaacccgggtttttaaaaccccccgggg

SEQ ID NO: 160988 - DNA, 820 bp, Homo sapiens
  misc_feature: GYAE6OF01C6T0O.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccgggacatcgtgatcgacccagtctcagacctcccgtggctgtgtctcgtgggcgaggacggccaccagtacaactcgacaacgtccacgaccgagtacgtttactttttacacgtacctaccaacctaaagtaacgacgtacttacgttacgtacgttcggttacacgacaacgaaacacggacctactcctaccgtactactcgtcgttacttacgtttacgtcgggtaccgttaccggtaacccgggtaccggttccccggggttaccctacggaccgttacgttacggtaacggtcgggtaccgacgggtacgggttacgtacgggtaacgtaacggttctttaccgaccttacctacctaacctacgtacccgacggacctaccgggtccgtacgaccggaaggttacgtaaggtaacgtaggtttaccggtcggtttaacgttttacgttttaaacgacgtttacgtacggaaacttacgtttaaaacgttacgttttaacttacccgttacccctttaccgtacggtaaccggtttaccccgggtaacgggtaaaacccggtaagggttaaaccccggtaaaagggttaaaccggtaaaaccgtaaaaccggtaaacgtttacgggcccggttaagtacccggtacgaaacccgttccgtaacgtttacccg

SEQ ID NO: 160989 - DNA, 729 bp, Homo sapiens
  misc_feature: GYAE6OF01DX6LF.22.27.C05.1.454.CMB.1.raw
  modified_base (150)..(150): a, c, t, g, unknown or other
  misc_feature (150)..(150): n is a, c, g, or t
  modified_base (159)..(159): a, c, t, g, unknown or other
  misc_feature (159)..(159): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggactctcgtggtcgccgtccggganacgtcgtgntacgaccacgtcctcacgcctcccgtggtctgtcgtcgtcgtcgggcgacggacggccacgactacgtaacgcgactaacgtccgaacgacgtaagtaagttttaacgttttacacgtacctaccaaacgtaaataacgtacgtacgttacgttacggtcgtttacgtaccgagtacaacgaaacgacgactactcctctctactcgtctacttacgttcggcggtccgttaccggaccggttaccgtcccgggtactacgacgttcgtacgacggtcggtacgcggtcggtcgacgtacgtacgttacttaccgactccgtactaactacgacgtacgcgtcgtacgtcgacggtcgtacgacgtaagtcgtacggtcgtttaacgtttagttacgttacttacgacgtaagtaaccttaagttaacctttacgtttcctaccgttaccgttacgttaaccgggttaacccgtaccgggaaaccgttaacggtaacgggtaacgtaaaccgttaaacgaaaccgtaaacggtcgttacggaacgtaccgtacaaccttgtcgtttaccg

SEQ ID NO: 160990 - DNA, 829 bp, Homo sapiens
  misc_feature: GYAE6OF01BH7UO.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctcgtggtcgccgtccggggacatcgtgatcggacccagtcctaccagtacctcccgtggcttgtcgtctcggtgggcgaggacggcccacatctaactgacaacgtccagcctaagtagttttaacttttacacgtcctaccaaccgtaaagtaacgacgtaccttacgttgtccgtttcggttaccaacgacgtaaacggaaaccgacggtacctaccttccccgtacccttacgttaccgtcgtaccttacgttacgttttaccggtcgggttacccgttaccccggggtaacccgggtaaccgggttcccccggggttaccctaccggtaacccgttacgttacggtacgggttccgggaccggtacgggttcccggggtacggtacggggtaactaacggtttacctttaccgtaccgttaccgtacccgtaacccgtaacgtaccgaaccgaccgtaccgtccccgtagggcgtaacggtacgttacgaaggttcgttcggtacggttacgtttaagtttagttttcgtacgttaccggtataaacttacgttttaactttaaccttccgtttaccctaacgtaccggtaccggttacccgtaccgggtaacccggaacgggtaaacgtaaccgggtaaggtaacctaaaccggtaacgttaagtcgtacggacctacgtacctacggttacc

SEQ ID NO: 160991 - DNA, 799 bp, Homo sapiens
  misc_feature: GYAE6OF01A2K5T.22.27.C05.1.454.CMB.1.raw
  modified_base (211)..(211): a, c, t, g, unknown or other
  misc_feature (211)..(211): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctgatctctggtgccgtccgggacatcgtgactcgacccagtctccagacctccgtgctgtcgtctcgtggcgaggacggccactanactaatcgactaaacgtccacgacaacggtagttttaactttttacacgtcctaccaacaaataagactaccttaacgtacgtcgttacggtaccaagacgaaacgaaaccgacggtacctaccgttacctccgttaacctactcgtacctaccgttacttttaccggtcgggtacccgttaacccgggtaacccgggtaccggttacccggggttaccctaccggtaaccgttacgttaccgaagggttccggacggtacggtacgggtacgtaacggggtaacaaacgtttacgtttaccgacccgtttacctaaccgaaccgtaagcccttaaacgggccgtaacggttaccccgtaggtaccccgtaagggtaaccggttacgaaacggtttacggagggttaccgttaccgtttaaagggttttttaacctaccggtacttaaccgggtaataacccgttaaatttaccgttaaacttcttacccgtccctaaggtaacccggttacgggaccgtaacggtaaccggaacgtaaggacgtaaaacaacggtaaacgtgtaggtcgacttaccgataaccgtcg

SEQ ID NO: 160992 - DNA, 803 bp, Homo sapiens
  misc_feature: GYAE6OF01A58AH.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctcttgttgctctggatctctggtgccgtccggggacatcgtgatgacccagtcctccagacctccctggctgtgtctcgtgggcgaggacgggccaccatacaactgacaacgtccagacccgagtacgtttaacttttttacgacgtcctacccaacctaaagtaacgacgtactaacttacgtcgtttacggttaccacggacaaacggaaacccgacggaacctacttcccctttaccgtacccgttaacgtcgtaccttacgttaacgttttacggtccggggtccgttaccccggttaaccccggggtaaaccggttcccccggggtaccctacggtacccgtagttccgtaggtcggaccggtacggccgggttacggtgggaactacggtactttccggtacgtacctaccgtaaccgtactaccgtacggccgtaacggtcctaacggcgtaacgggtagtaggaaacgtggttcggttaacgtcgtttaacggttttattcggtacgtaacgtacgtaacttaagtttactttaaccgtttaccgtttacccctacgtaccgtaacgggttacccggttaacggaccggtaaaaccggggaaccggttaagggaaacgtaaacgttaaccggtaaaccgtaaacggtgggtaccacgtaccgtacaacccgtgtttacccg

SEQ ID NO: 160993 - DNA, 909 bp, Homo sapiens
  misc_feature: GYAE6OF01AI4N4.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatgacccagtctccagacctccctggctgtgtctcgtgggcgaggacgggccaccatacaactgacaacgtccagccagagtttactttttacacgtccttaccaccaaataacgacgtaccttaacgtttaagccgtttacgggtttacccaaggtacctaaacggaaaacccgacgggtaacctaaccttaccccgtttccccttaccgttaaccgttcggtaccgttaccttaacgttttaccggtcggggtaccgtttacccgggtaaccccggggtaaacggttccccgggggttacccgtacggtaacccggttacgttaccgtagggttcgggaccgtacggggtaccgggttccggttaaaggggtaccgtaacgtttaacgttttacccggaacctttccccgtaaccgtaaaccccgtagtttacccggaacggttaccccggtaacgtccccggttaggaacccgtaacgggtaccttaaacgggtaacggtacgttttgggaacccgggttaacttttaaggttttaaccgtttccgttacggtaactacggttaacttaaagtttactttaacgtttacctttccccgtaccgtaggtaaaccggttccggtttacccgggaaacccggtaaaccgggttacggtaaaccggtaagggttaaaacccgtacggtaaaaacccggttacggttacgggtaaccggtaccggttaaccgacccgtaacggttaacgtttcccgg

SEQ ID NO: 160994 - DNA, 857 bp, Homo sapiens
  misc_feature: GYAE6OF01CBBZ2.22.27.C05.1.454.CMB.1.raw
  modified_base (845)..(845): a, c, t, g, unknown or other
  misc_feature (845)..(845): n is a, c, g, or t
tcagacatacgcgtcacgaccggtgctcgatttagacgcgatcgaagggttgggggagctacaacaggcaggcaggggcagcaagatggtgttgcacgacccaggtcttctatttctctgttcgctcgtaggactctcgtggtcgccggtccggggaactacgtcggtagacgtaccggaccctacgtcctaccgacgaccgttccgtggcgttggtcgtcgtacggcgggacgacggaccggccaacgtctacaacgtcgaccaacggtaccagaccgtaaggttaacttttaactttaacgacgtacctaacctaaacgtaaagtacggacttaactacgttacgtacgttaccgaccaacggacgtaaccgaaactaccggtaactaccgtacctcctacgtactacgtaccttacggtaacgtttacggcgggtacccgtaccggtaacccggtacggtacccgggtctaaaccgggtacgttacggtaagtacgggtaccggtacggtacgggtcgggtttaccggaaacgggtaaccttacgttaacctaccgtaacccggtccttaaaccgtaccgaacgtacggaaccgtaccggtacgtacccggtagtaccggaaacgggttacgtaaccgggtaaaggttcgggttaacgtacgggttaaacttttaacggttaacgttcccggtaaaggtacctaaaccgttacgttaaacttaaccgtttacgtacccgttacccgtacgtaaccggtaacggttaccggaaaccggtaaccgggaaagtaaccgggtaaagtaccggtaaaacgacggtaaactggacgtaacgcctaacncgttactaccgg

SEQ ID NO: 160995 - DNA, 902 bp, Homo sapiens
  misc_feature: GYAE6OF01BK3TZ.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctcgtggtgccgtccgggacagtcgtgactcgaccctacgtcctaccgactaccgtcccgtcggtcttggttcgttccgttcggtcggggacggaacgggaccgggacccaaccaacgtaccaaacgtacgaccgtaacgtcccgaacgaccgtaaggttagttttaacttttttacgaaccgtacctaaccaaacctaaacgttaaacgaacgtaacctttaacgtttaacggttaccgttttacgggttacccgtaacgtaaccgaaaaccggtaaaaccccggtaacggtaacctacccgtttacccgttacccttaccgttaaccgttccgtacctttacgttaacgttttccgggtacgggttccccgtaacccggggttaaaccccggggtaccccgggttccccggggttcccccgtaacggggtaacccgtacgtttaccgaacggggtcggaccgtacggggtccgggttacgtacgggggaactacgttacgttttaccacctttacccgtaccgtaaccgtaccgttacgaccgaccgtacgtcccgtacggaccggtaacggtcgtaaggaacgttcggttagtccgtaacgtttacgttaacgttcgtacgtactaacgttaataacgttttaacttacgtttaccttacgttaccgtcgtaacggttacccggtacggtaaaccggacgtaacgggtaacgtaagtaaacgtacgtaaaacggttcgttacggacgtactacccgtacgacgttaccg

SEQ ID NO: 160996 - DNA, 776 bp, Homo sapiens
  misc_feature: GYAE6OF01C6PV7.22.27.C05.1.454.CMB.1.raw
  modified_base (763)..(763): a, c, t, g, unknown or other
  misc_feature (763)..(763): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctcccgtggtcctgtcgtcctcgtgggacgaggacgggcccaccactaccaactcgacgaacgtccgacgaccgaaggtacgtttaacttttttaaccgacgaccttacccaactaaacgtaagaacgtccttaacgttaacgtcctttacgggttaccacggtaccaacgaaaccgtacggactaactcccttacctaccttacgtcgtacctacttaactttccggtcgggtaccgttaccggtacccgggtaacgttccccgggtcctaccgtaccgttattccgaggtcggacgacgggtccgggtacggtacgggaccgtaaggtcctttactaccgtccgtaccacctacgtccgacgacgtaccgtccgtacgacggacgggttacctagggaagtacgttgggtaccgttaacgtttagttttaacgttcgtacggtacgaacggttacttaatttacgttaaccttccttttaaccctccgtaacgtaacccgggtttacggaccccggtaaacggaaccgggttaacgtaagggtaacgtaaaaccttaccgaaaaccgttgtacggtaccgtcgtaacncccgtaacttacg

SEQ ID NO: 160997 - DNA, 666 bp, Homo sapiens
  misc_feature: GYAE6OF01DS6TY.22.27.C05.1.454.CMB.1.raw
  modified_base (235)..(235): a, c, t, g, unknown or other
  misc_feature (235)..(235): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccgggacatcgtgatgacccagtctccagactccctgctgtgtctcgtggcgagaggccaccatcaactgacagtccagccagtagttattttacngcctaccaacaaataagagactacgttagtcgttcgttccagctaagaaaccaggacactcctacctactactcgcttactatttacgcgggtccgtccgtaacccgggtaacgtcccgggtaccctggaccgtcttacgacgtcggcgaggtcggtcgtacggactagtactttcgactcgtacaccgataccgacgccgacgtaccctaggacgtaagggtacctaaggtaaaggttacgtggtagtaccgtttaagttttaccgtacgtacgttaacgacgtaaccttaagtttaactttaacgttacccttcccgtaccgtaccgtagttaaccccggttcggaaaccgtaaggggtaccctaaagggtaacggaaacttacgaaaacgtacgtacggtacggtacttaggacctacgtacgttccg

SEQ ID NO: 160998 - DNA, 765 bp, Homo sapiens
  misc_feature: GYAE6OF01DWZZV.22.27.C05.1.454.CMB.1.raw
  modified_base (119)..(119): a, c, t, g, unknown or other
  misc_feature (119)..(119): n is a, c, g, or t
  modified_base (123)..(123): a, c, t, g, unknown or other
  misc_feature (123)..(123): n is a, c, g, or t
  modified_base (125)..(125): a, c, t, g, unknown or other
  misc_feature (125)..(125): n is a, c, g, or t
  modified_base (129)..(129): a, c, t, g, unknown or other
  misc_feature (129)..(129): n is a, c, g, or t
  modified_base (146)..(146): a, c, t, g, unknown or other
  misc_feature (146)..(146): n is a, c, g, or t
  modified_base (405)..(405): a, c, t, g, unknown or other
  misc_feature (405)..(405): n is a, c, g, or t
  modified_base (521)..(521): a, c, t, g, unknown or other
  misc_feature (521)..(521): n is a, c, g, or t
tcagacatacgcgtcacgaccggtgctcgatttagacgcgatcgaagggtttgggggagctacaacaggcaggcagggcagcaagatggtgttgcagaccaggtcttcatttctctgtnctcngntctntggtgccgtccgggacntcgtgatcgaccagtctccagactcccgtggtctgtgtctcgtggcgagacggtccacatacaacgtgaccgataccgacgaccagttactttaatttttacgacgtaccttaccgaacctaattaacgacgtacttaccttagcgttttacgtacacgacgaacaaacgcggtaactacttcctactaccgtaactctacttactacgttttagccggtacgttaccgtacccgggacgttcccggtcctacgacgtntacggtcgcggacgtgtccgggtagtacggactagttcttacgacctcctacttaacgacttaccgaacgttcgaccgttcacggaactaaggtacccggtaactaagggttacgnggttaacgtcgtttaacgttttaacccgttaggttacgaaacgggtactttaaaccctaaaaggttttaccttttaaccgttaccggtttaccctaccgttaaggtaaccgttaaccgggtacccgtaaacgggtaaacccgggtaaacggttaaacggtaaccggtaaacgtaaacccgtaaacggttaaaccggttaccggtacgggttaacctaaccggggttcctaaccggtttaacccg

SEQ ID NO: 160999 - DNA, 706 bp, Homo sapiens
  misc_feature: GYAE6OF01D973S.22.27.C05.1.454.CMB.1.raw
  modified_base (404)..(404): a, c, t, g, unknown or other
  misc_feature (404)..(404): n is a, c, g, or t
tcagacatacgcgtcacgaccggtgctcgatttagacgcgatcgaagggtttgggggaggctacaacaggcaggcaggggcagcaagatggtgttgcagacccaggtcttcatttctctgttgctctggatctctggtgccgtccgggacatcgtgatcgacccagtctccagtacctcccgtggctgttcgtctcgtgggcgaggacgggcccaccactacgaaactgaccgaaacgtccaacgccaagtagtttaacttttttacacgcctaccaacaaataagacgtactacttacgtcgttgttaccagacgaacgaaccgaggtactactcccgtaccctactactcgcttactacgtttacgtcgggtcgtacccgtaaccggtacgtcccgggtccncggtaccgtactcgagtcggacgtggcgggtcgtagggactacgtactttcacctcaccgtacactacacggctacgaccgtgacgacggtagtacgtaaggtcgttaggtacggtaccgttttacgtttaagttacgtggtaactacgtactaaagtttacgtttacttaccgttacccttccgtaacgtcgggttaaccgttcccggggaaaccgtaaacgggaacccggtaaaggttaaccggaaacgtaaaccggtaaaccgtacgttagggtaccgacttccggaaccctagtaccg

SEQ ID NO: 161000 - DNA, 834 bp, Homo sapiens
  misc_feature: GYAE6OF01B4LD7.22.27.C05.1.454.CMB.1.raw
  modified_base (123)..(123): a, c, t, g, unknown or other
  misc_feature (123)..(123): n is a, c, g, or t
  modified_base (707)..(707): a, c, t, g, unknown or other
  misc_feature (707)..(707): n is a, c, g, or t
tcagacatacgcgtcacgaccggtgctcgatttagacgcgatcgaagggtttgggggctacaacaggcaggcaggggcagcaagatggtgtgcagacccaggtcttctatttctctgttgctntggatctcgtggtcgccgtaccgggactatcgtgactcgaccctagtcctaccacgtaccctccgtggtctgtcgtctcggtcgggcggaggacgggacccaaccactaccaacgtcgaactaacgtaccacgtactaaggttaacgttttaacttttaaccgacgtacctacctaaaccgtaaagttaacggtacttaccgttaaccgttacgttaccgtttcggttaaccgaacgtaaaccgtaaacgaaaccgaacgtactaccttcctacctcttacgcgtacctacgttacgttacggaccgggtcccgtaaccgggtacccgggtacccggttacccggtacccgtacggtaccgttacgttacggacggtccggacgtacgggtccgggtaacggtacggtaacgtacgtttacttacccgtactttacctacccgtaacaccggtacgtaacgccgtacgcgtccggaaagtccggtaactaggattccggtaagtaccggtttaacttacggttacacggtaccgtagaacttacgttaaattactttacctaccgttcccgtttaaccgggtanaacggggttaacccgttacccgggaacgggtaaaagttacccggtaaaagggtaaacctaaccgggtaataaacccgggttagtccggtaaccggaccttaaacgtacccctaagtttacgttaccc

SEQ ID NO: 161001 - DNA, 729 bp, Homo sapiens
  misc_feature: GYAE6OF01DLHMW.22.27.C05.1.454.CMB.1.raw
  modified_base (556)..(556): a, c, t, g, unknown or other
  misc_feature (556)..(556): n is a, c, g, or t
  modified_base (563)..(563): a, c, t, g, unknown or other
  misc_feature (563)..(563): n is a, c, g, or t
  modified_base (604)..(604): a, c, t, g, unknown or other
  misc_feature (604)..(604): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtcgccgtccggggacatcgtgatacgaccctacgtcctccacgacctccctggcttgtcgtctcgtcgggcgaggacgggcccacctactaccaactcgacaacggtaccacgaccaagtaagtttactttttacgacgtacctacccaaaccaaagtaaagaacgtaccttaacgttacggttacgtttcggttaccacgaccaaacggaaaccgtacggacctaccttcccttaccgtaccttactcggtcctacgttacgtttaccggtcgggtacccgttaccggtaccccgggtaccggttcccgggtaccgtacggaccgttactaccggtacggtcggtcgtacgggtccgggtcggtacggacgtacgttacgttactcgtacctaccgtactaactcacgtacacgtccgngtaccgngccgtaggaactggtacgtcgtagtttacgttactcgtacncgtaacgtctaattgttaaccttcgttaccctacgtacgtaccggtaccgtaccggtacgaaacgggtacccgaaggttacgaaacgtaccgtaaacgtcgtcgtacgacgtcgacctagttacg

SEQ ID NO: 161002 - DNA, 604 bp, Homo sapiens
  misc_feature: GYAE6OF01BC8FX.22.27.C05.1.454.CMB.1.raw
  modified_base (426)..(426): a, c, t, g, unknown or other
  misc_feature (426)..(426): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgaggagggcccaccatcaactgcaacgtccacgccagtagtttactttttacagtcctaccactaataagacgcttacttagtcttcggttccagcaacgaaaccaggaccactccctcctctactgctctatttcgtggtcgtccgtacccgggacgtcccggggtcctcgaccgtattcgaggtcggcgaggtccgggtcgtgggactagtacgtttcacctctaccaccntacagccagtcctgacgacggacnggaagngttggtcgtgtttaacgttttnttacgtntactaacgtacttaagttattacttaccgtttcctactcgtacggtccgtccggaaccgtaaggtaccgtaggagtaactacggaacgtaacgtgggtacgccaggtacctactgtccg

SEQ ID NO: 161003 - DNA, 886 bp, Homo sapiens
  misc_feature: GYAE6OF01BJNSH.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttcctctgttgctctggatctctggtcgctccggggacatcgtgatgacccagtctccgagactccgtgctgtgtctcgtgggcgagacgggccaccatcactcgcagtccacgccagtagttattttacgacgtcctaccaaccgtaagtaacgtacgtttaacgttaacggtcgtttcggttacctaagaccgaacgaaacccgtaagggtaacctaccgttccgtacccgttcgtaccgtaaccgttcgtaccgtaccgtaaccgttttaccggtaccgggtcccgtttaacccggtaaccccgggggttaaccggtccccgggggttaccctccggtaacccggtaacgttccgtaacgggttacgggaccgtacggggttacccggggttaccgtacggggaacgttaacggttaccgtttaacccgtacccgttacccgtaccctaacccggtagtaaccccgtacggaccgttaaccgtaccccggtgggtaaccggtacgggttaacccgtaacggaaagggttaccggttgggttaacggttaacccgtttagggtttttaacgtacgtttttcggaactcggtaaaccttagtttacgtttacttaccctttcccggtaacttaccggtaaccggttaccggtttcccgggaaacccggttaacggggtaaccgttaaggggtaaacccggtaaaaggttccccgaaaaacggttacggttccggtaacgggtaccgtacttaacccggaaccgtttaacccgg

SEQ ID NO: 161004 - DNA, 676 bp, Homo sapiens
  misc_feature: GYAE6OF01A58MM.22.27.C05.1.454.CMB.1.raw
  modified_base (391)..(391): a, c, t, g, unknown or other
  misc_feature (391)..(391): n is a, c, g, or t
  modified_base (471)..(471): a, c, t, g, unknown or other
  misc_feature (471)..(471): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatcgacccagtcctccagacctcccgtggctgtgtctcgtgggcgaggacggccaccatccaacctgacaacgtccacgaccagtagtttactttttaccacgcctaccaaccaataacgacgcctacttacgcgttcggttccacggacacgaaccaggacactcctcctctactcgctctatttacgtggtccgtcgtacccggaacgtcccgggtcccgtcgaccgtatcgnggtcggcacggtcggtcgtcgggacgtagtacttccacctctcccacactccacgcacgcgtgcgacggtcagaacggtntggtcgtactttagtttactacgtcgtagacgtacctaagttttaacttacgttacctttaccctaccttacgtaccggttcccgttaccggtaacccggtaaaccggggtacccggttaaaggggtaaccggtaaaaccgttaaccgaaaaaccgggtttacgtcgggtttacggtacccgtaccggtaccctaacgttacccg

SEQ ID NO: 161005 - DNA, 598 bp, Homo sapiens
  misc_feature: GYAE6OF01BSVR5.22.27.C05.1.454.CMB.1.raw
  modified_base (372)..(372): a, c, t, g, unknown or other
  misc_feature (372)..(372): n is a, c, g, or t
  modified_base (459)..(459): a, c, t, g, unknown or other
  misc_feature (459)..(459): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgaggacgggccaccatcaactgcaagtccagccagtagttatttttacagtcctaccaccaataagacgctacgttacgtctttcggttccagacaagaaaccaggacatcctcctctactcgctctatttacgcgggtcgtacgtacccgggtaacgtcccggggtccctgaccgtnttacaggtcggacaggtccgggtcgtgggactagtactttacacctcgtacctaccatcagcacgtccctagcaggtctaggaagtntggtcggtcttaagtttactacgtgtacagtactaattaacttattaccttcccgtacttacgacgtaccggttcggaacccgaaggggtaccaagggtacgaaactacgaaacgtacgtggacgtctacgccactacg

SEQ ID NO: 161006 - DNA, 873 bp, Homo sapiens
  misc_feature: GYAE6OF01BWNHB.22.27.C05.1.454.CMB.1.raw
tcagacatacgcgtcacgaccggtgctcgatttagacgcgatcgaagggtttgggggcgtacgaacaggcaggcaggggcagcaagatggtgttgcagacccaggtcttcatttctctgttgctctggatctctggtcgccgtccgggacagtcggtcgagtcgacccagtcctccgacgtacctccgtggtcgtcgtcgtctcggtcgggcgacggacgggccaccgactaccaacgtcgacgaacgtccgaacgaccgtaagtacgttttacttttacgacgtacctaccgaaccgaagtaacggactaccgttaacgttacggtctttacggttaccaacgacgaaacgtaaaccgacggaacctccgttccctaccgttaccgtacgtcgtccttacgttaacggtttacggtacgggtaccgtaccggtaacccgggtacggtccccgggtaccgtaccggtacgttacgtcgacggtacggcggtacgggtcggtcggtaacggtaaccgttacggtaccttaccgtaccgtaccttaccctaaccgtacgtaccggaccgtaccgtaaccgtcgtacccggtaacggcggtaacgtacggtaagttacgggttacgggtaccgtttaggtttaacggtttacgttcgtaacggtcgtaaacgtttaaggttaactttaacggtttaacctttaccttacccggtaccgttaaccgggttaccggtaacccgggtttacccggaaaccgggttaaaccggtaacgggtaaaccgggtaaaccaaaccggttaacccgttaaaaccgggtcggtttaaccggcgggttacccgtaacccgtacccgttaccgttattttaaccccggg

SEQ ID NO: 161007 - DNA, 702 bp, Homo sapiens
  misc_feature: GYAE6OF01AQLQZ.22.27.C05.1.454.CMB.1.raw
  modified_base (416)..(416): a, c, t, g, unknown or other
  misc_feature (416)..(416): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatcgacccagtctccagacctccctggctgtgtctcgtgggcgaggacgggccaccatcaactgcaacgtccagccaagtagttatttttacagtcctaccaacctaaataagacgcttaacgttagtcgtttcggttaccacggtaccgaacgaaaccacggtaccaacttccctcctactacgtcgtctatactttacggtcggtcgtaccgtaccggtacgtccgggtcctcgaccgtctcgagtcgcgcggcggtcgnggactacgtacttaccgactctaccaccgtatacgacgtcacgtacgtcgacggacggtcgtaaacggagtaacgtgggtacgttacgttagttttaacgttacgtacgtacgtaacgtattaaacgttatttaacttactttcccttaaccgtacgttaaccgggttccggttaccgggtaaacccggaaacgggttaaaccgtaacggggttaaacgtaaaacgttaaccgaaaaccggttcggtttacgtacggtactacctaccgttaacctaagtttcccg

SEQ ID NO: 161008 - DNA, 822 bp, Homo sapiens
  misc_feature: GYAE6OF01BK5HT.22.27.C05.1.454.CMB.1.raw
  modified_base (564)..(564): a, c, t, g, unknown or other
  misc_feature (564)..(564): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtcgccgtccggggacatcgtgatcgacccagtctccagacctccctggctgtgtctcgtgggcgaggacgggccaccatcaactcgacaacgtcacgccagtacgtttactttttacacgtcctaccaaccgtaataacggactaccttaacgtttacggtccgttttacgggttcccaaggaccgaaacggaaaaccgacggaacctacttaccccgtaccttaccttaccgtcggtaccttacttaacgttttaaccggtccggggttaccgttacccgggttaaccccggggtaaccggtttcccccgggggtaccctaaccgggtaacccgttacgtttaccgtaacgggttcggaccgtacggggtaccggggtcgtacggggaactacggttactttccgacttcctacaacccgtatcgaacncgaaccgtctacggacgtacggtacgtaggaacgttggtcggtacggtatttaacgtttacgttctacgggtactaggtaactttacttaacgttaaacctttcccgttaccctaccggtacgttaacccggttacccggtacccgggtaaacggaacccgggttaaccggtaaacggttaagggaaaacccgtaaaccgttaacggtaaacggttcggtaacgggacccgtatacccctaaacggttcccttaccgg

SEQ ID NO: 161009 - DNA, 727 bp, Homo sapiens
  misc_feature: GYAE6OF01A7TGB.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatcgacccagtctccagacctccctgctgtgtctcgtgggcgagacggccaccatcaactgcaacgtccagccagtagtttacttttttacacgtcctacccaaccgtaaagtaaacgacgacttaacgttaggccttttcggttacccagtccgaaacgtaaaaccgacggaacctacttccccgttcctacttaccgtcgtaccgtacttaacgttttaccgtcgggtaccgttaccggtaaccccggggtacgttcccggggttacccgtacggaccgttacgttccgtaggtcggtcgtacggtccggggtcgtgggaacctacgttactttaccgacgttcctaccgaacctagtccaggccgacgtcctggaccgtaggtacgtaggaagtacgttggacgtaccgtttatttacgtttacgtacgtactaacgtaacttaattactttaccttaccgtttccctacgtaccgtaacggtcccggttaccgacggtaaacgggtaccgtaaagggttacaaactaccgaaacgtacgttggtacggtcaggtccctacgttgttaccg

SEQ ID NO: 161010 - DNA, 796 bp, Homo sapiens
  misc_feature: GYAE6OF01BHHR8.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttcctctgttgctcgtggtatcctcgtggtcgcccgtaccgggactagtcgtgatcgacccagtcctccacgcctcccgtggtcgtgtgtcgtggtcgggacgaggaccggccaacctacgtaccaacgtgacgtaacgtccgacggacctaaggttacgttttacttttaccgacgtacctacccaaacgtaaagtaacgtctactaacttacgtacgttcggtaccgacgaacgaacgaaaccgtagtacctacctccgttcctactacgtacgtacctttaacgttacgtttaaccggtcggtacccgttaaccggtacccgggtaaccggtttcccgggaccttaaccggtaccgtagttacggcggttaccggcgtaacgggtcgggtacgtacggtaacgtggttacctaccgtccgtacaccgtactaccgtacgacgaccgtacgtaccggcgtaccgtaagtacggtaacggtaagttccggtaggttacggtccgtttaaagttcgttacgtccgtagtaccttaagtaccgttactttacgacccttcggttacccaagggtacgtaccgggttaaccgtaccgggaaaacggttacctaaaggggtaactaaacggtaccgtaaaggttaccggtacggtcggtaaccgaaacggtccctaacgtttacccg

SEQ ID NO: 161011 - DNA, 887 bp, Homo sapiens
  misc_feature: GYAE6OF01C2Y1Q.22.27.C05.1.454.CMB.1.raw
  modified_base (755)..(755): a, c, t, g, unknown or other
  misc_feature (755)..(755): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatggacccagtctccagactccctggctgttcgtctcgtgggacgaggacgggccaccataccaacgtcgactaacgtccacgccagtacgtttatttttacacgtcctaccaacctaaagtaacgacgtacttacgttacggtccgtttacggtaccaacgaccgtaaacgaaaccgtacggaacctaccgttaccccttaccctaccgtttaccgtacgtaccttaccgtttaacgttttacggtaccggggtacccgttaaccccggttaaaccccggggtaacccgggttcccccgggggttacccttaaccgggaacccggtttaacgttacccggtaagggttaccggtaccggtaccggggtaccggggtcggtaacggggaccgttaacgttacgtttaccctaccgttccctaccgtaccctaagttacccgaggtacccgtaaccgtcccgttacgggaccgtaagggtaccttaagggaaacgtttcggttacggccggtttaacgtttttaacgttttaactccgggttataacccgtaataacgttttaaactttaactttacctaacccgttttcccccgttaanaaccggttaccgggtttaacccggtaccggaccgggtaaaaccgggttacggaaacggtttaaccgtaaaacgtaaacccgtaacggtttaacggcggttaacccggctaacccggaaccttcgttaacccg

SEQ ID NO: 161012 - DNA, 711 bp, Homo sapiens
  misc_feature: GYAE6OF01DGJTN.22.27.C05.1.454.CMB.1.raw
  modified_base (596)..(596): a, c, t, g, unknown or other
  misc_feature (596)..(596): n is a, c, g, or t
  modified_base (690)..(690): a, c, t, g, unknown or other
  misc_feature (690)..(690): n is a, c, g, or t
  modified_base (697)..(697): a, c, t, g, unknown or other
  misc_feature (697)..(697): n is a, c, g, or t
tcagacatacgcgtcacgaccggtgctcgatttagacgcgatcgaagggtttgggggagctacaacaggcaggcaggggcagcaagatggtgttgcagacccaggtcttctatttctctgttgctctggatctcgtggtcgccgtccggggacagtcgtgtatcgacccagtcctccagtacctccctggctgtgtctcgtgggcgaggacggcccaccatacaactcgacaaccgtccacgcaagtacgtttactttttacacgtcctacccaaacaagttaacgactccttaacgtttacgtccgtttacggtaccagaccgaaacgaaaaccgaggtacctaccttacccttccctacctaactcgtaccttacgttacttttacgggtcggtacccgtaccgggttaaccccgggaaccggttcccgggtcctacggtaccgtacttaccggagttcggaccgtacgggtccggttacggtacgggaccgttaagtcttaaccgtctaccgttacgaccttacgtctaccgaccgtacgcccgtgaccgtacggtgtacgaaggtacgttggactagtttgtttacttagtntacgtataacttatttaacgtcttaccgttcctagtaccgttacggtaccgtaccgggacgaacgtaacggtaacgagtaaacgtactaaacgntcggtancctacgcattaccg

SEQ ID NO: 161013 - DNA, 684 bp, Homo sapiens
  misc_feature: GYAE6OF01A3HJ0.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagaggccaccatcaactgacaagtccaagccagtagttatttttacagctaccaaccaaataacgtagtttaacttagtcgtttggttaccagactaacggaaaccaggaactatcgtcctcgacactcgctactactttacgtggcgtaccgtaaccgggacgtcccgggtcctgtaccgtattcgagtcgcgaggtcgggtctagggactagtacttcactctacaacctatacgacgcgtaacgtccctaggacgacggtacgtaaggtaaacgtaggttaggtcggtaacctttaagggtttttaatttacgttaccgtacgtaagtaaccgtaaaatttaacgttaacttaacctttaccctacccgttagtaaccgttacccggttaacgggaaccgtaaaacgggtaaccgtaaacgggtaagtaaaactaaccgaaaacggtactcgggttaacgaccttacgaacccttaacgtagttaccg

SEQ ID NO: 161014 - DNA, 771 bp, Homo sapiens
  misc_feature: GYAE6OF01B322M.22.27.C05.1.454.CMB.1.raw
tcagacatacgcgtcacgaccggtgctcgatttagacgcgatcgaagggtttggggggagctacaacaggcaggcaggggcagcaagatggtgttgcagacccaggtcttcatttctctgttgctctggatctcgtggtcgccgtccggggacatcgtgtatacgaccagtctccagtacctcctgcgttgtcgtctcgtgggcgaggacgggaccacactaccaactcacgaacgtccgaacgtaccgaggtaacgtttaactttttacgacgtacctaccgtaaccgaaaataacgaactacgttaacttacgttacgttacgtaccagaacgtaacggaaacccgaggtaactaaccgttcccgttaccgttacctacgttcgtaccttacgttaacgtttcggtcgggtaccggttaaccggttaacccgggtaccggttcccggggtacctacgtaaccgtaacgttgacggttcggacgtacgggtacgggtcgtagggtaacgtacgtaacgttacaccgttactaccgtaactacgtaacgaaccgacaacgtccgacggtacgacggtaagtacgaacgtaaggtcggtacggtactttaagtttaacgtacttacgtaacgtactaaacggttatttaaacgtttaccttacgtttacccttaccgtaacgtaacggtaccggttaccgaaaccggaaaccggtaaacgtaagggtaacaaacgtaccgtaaagtaccggtagtcgaactcgactacgtac

SEQ ID NO: 161015 - DNA, 763 bp, Homo sapiens
  misc_feature: GYAE6OF01COGFH.22.27.C05.1.454.CMB.1.raw
  modified_base (170)..(170): a, c, t, g, unknown or other
  misc_feature (170)..(170): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtcgccgtccgggacatcgtgatcgacccagtcctcncgacctccgtgctgtgtcctcgtgggcgaggacggccacgactcaacgtcgcaacgtccacgccaagtagttttactttttacagtcctaccaacctaagtaacgacgtacttaacgttcgcgtttacggttaccaagtacgaaagaaaccccgaggtaacctacgttaccctaccttcgtaaccgtcgtacctacttacggtttaccggtcgggtacccgtaccgtaaccccggggtaccgtcccgggtacccttaggaaccgtgttacgacgggttcggactacgggcggggtcgtacgggaactcgttaactttcccgactcccgtacgacctaacgctacggaccgtcgttaccgcggtacgaacggtacttacggaagcggttgtaccgggttatttaacgttttcggaccttagggtaccaacgttactaagtttacttaacttccgtttacccgtacccggtattaacccgggttaaccgtacccgggtaaacccgagggttaaaccggtaacgggtaataaaaccggtaactaaaaccgggtcgttcgggtaaccgtcacccggtactaaaccgtcgttaacccg

SEQ ID NO: 161016 - DNA, 1197 bp, Homo sapiens
  misc_feature: GYAE6OF01A7A7H.22.27.C05.1.454.CMB.1.raw
tcagacatacgcgtcacgaccggtgctcgatttagacgcgatcgaagggtttgggggctacaacaggcaggcaggggcagcaagatggtgttgcagaccccaggtcttcatttctctgttgctctggatctctggtgcccgtccggggacatcgtgatgacccagtctccagactccctggctgtgtctcgtgggcgaggagggccaccatacaactcgacaacgtccagcctaagtagttatttttacacgctaccaacaaataagatactacttagcttggtaccagacaagaaaccgagactactcctcctactactctctacgtactttacgtcgggtaccttaccgtaacccgggtaaccgttcccgggggtaccctaccggtaaccgtacgtttacgtaacggttacgggaccgtaacggggtccgggtttacccggtaggggtaaacccgttaaaggttaaccgttttacccggtaaacccgtttacccgtttaaccccggtaaaaccccgttaaccggtttaaaccccggtaaaccggggtaaccccccgtttaaaccccggggtaacccccccggggtttttaaacccggggaaacccccggggtttaaaaccgggggggtttaaaccccgggttttttaaaaacccccggggggttaaaaaaaaaaacccgggggggtttttaaaaaccccccggggggggggtttttttttaaaaccccccgggggggtttttaaaaaccccgggggggggtttttaaaaaaaacccccccggggttttttttttttaaaaaaaccccggggggggttttttttttttttaaaaaacccccccggggttttttttaaaaaacccccgggggttttttttaaaaaaccccccccgggggggttttttaaaaaccccggggggtttttaaaaaaaacccccccgggggttttttaaaaaaacccccggtttttttttaaaaaaaaaaacccgggggggtttttttaaaaaaaacccccccgtttttttttttttaaaaaaaacccccggggtttttttttaaaaaccccccccccggggtttttttttttaaaaacccccccccccccggggggtttttttaaaaacccccccgtttttaaaacccccccccgggggggttttttaaaaaaaaacccccggggggggttttttaaaaa

SEQ ID NO: 161017 - DNA, 781 bp, Homo sapiens
  misc_feature: GYAE6OF01DE8FT.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgaccagtctccagactccctggctgtgtctcgtgggcgaggacgggccaccatacaactgacaacgtccagcctaagtagttactttttacagacctaccaaccaaataaagacgacttactagtcttcgttccaagtacaagaaaccacggactactccctcctactacgtcgactactacgtttaccgcgggtaccgttaccgtaaacccggggaaccgtaccccgggggttaccctacggtaacccgtagtttaccggtaacgggttacggaccggtaggggtccgggttacggtacggggaactagggttaccttactaccgttaccttacaccgtactaccgaacgaccgtacgtacccgtgaccgaacggtaccgtaaggaatacgtgggtaccggatttaacggttttactaacgttggtaccaaaggtactaaagtttaatttaaccgttacttacccgttaccgttacctaacggttaacccgggtttaccggaccccggttaaaaagggaccggttaaaaacggggtaacgtaaaaacggtttaacccgaaaaaacccggtttaacgttcgggaacgggttacccttaagggaaccctaccgttaattaccccggg

SEQ ID NO: 161018 - DNA, 772 bp, Homo sapiens
  misc_feature: GYAE6OF01DWIK8.22.27.C05.1.454.CMB.1.raw
  modified_base (171)..(171): a, c, t, g, unknown or other
  misc_feature (171)..(171): n is a, c, g, or t
  modified_base (556)..(556): a, c, t, g, unknown or other
  misc_feature (556)..(556): n is a, c, g, or t
  modified_base (608)..(608): a, c, t, g, unknown or other
  misc_feature (608)..(608): n is a, c, g, or t
  modified_base (766)..(766): a, c, t, g, unknown or other
  misc_feature (766)..(766): n is a, c, g, or t
tcagacatacgcgtcacgaccggtgctcgatttagacgcgatcgaaggggtttgggggctacaacaggcaggcaggggcagcaagatggtgttgcagacccaggtcttcatttctctgttgctctaggatctcgtggtcgtccgtccggggacatcgtgacgtcgaacccngtcctccagcctcccgtggtctgtgtctcggtgggcgagcggccacatacatgactaacgccagacctaaggtactttacttttacgactacctaccaaacaagttaacgacgttaccttacgttacggtccgtttacgtacccaagactaaacgaaaccgacggtacctactcccttacctaccgttctcgtaccttacgtacgttttaccggacggttccgttaacccgggtaacccgggttaccgtaccccggggtaccgttacgtaaccgttagtaccgtaggtaggacgtaggggtcccgggttacggacggtaaacgtctttaaaccgttcacccttaaccgtcctaacgtagaacccgtacgaaccgttctaccccgngtaaccgtaggttacctaacggttatttaacggtttattacgttaattttanacgttagtaacgtacctaatacttaagttaactaccggttaccttccgttaacgttacggttgttaccggggaacgtaaccggtacgtaacggtcggtaaaggaacgtacgtaacccgaaaacggtacggtaccggtacggttcctacggtacccgtnttaccg

SEQ ID NO: 161019 - DNA, 621 bp, Homo sapiens
  misc_feature: GYAE6OF01ENEDI.22.27.C05.1.454.CMB.1.raw
  modified_base (428)..(428): a, c, t, g, unknown or other
  misc_feature (428)..(428): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgaggagggccaccatcaactgcaagtccagccagtagttattttacagcctaccaacaataagagctaacttagtcttggttaccagtacaagaaaccaggacactcctcctctactgctctatttacgtgggcgtccgtacccgggtagtccccggggtcctcggacctattcgagtggcgaggcgggtcgtaggactaggtatttccgacttcctacacctacgtctacgacncgtacctgcgacggtcgtagaagtgtcggtggtacgttagtttactacgtgtacgagtaaccttaattagttaacttacttcccttacctcgtaacgtaccggtaccggaccggaacgggtaaccgtagggtaacgaaactaaccgaaaaccggtacgtacggtacggtacctacgacctacgtacttaccgg

SEQ ID NO: 161020 - DNA, 594 bp, Homo sapiens
  misc_feature: GYAE6OF01CBWQ2.22.27.C05.1.454.CMB.1.raw
  modified_base (451)..(451): a, c, t, g, unknown or other
  misc_feature (451)..(451): n is a, c, g, or t
tcagacatacgcgtcacgaccggtgctcgatttagacgcgatcgaagggtttgggggagctacaacaggcaggcaggggcagcaagatggtattgcagacccaggtcttcatttctctgttgctctggatctctggtgcctccggggacatcgtgatgacccagtctccagactccctggctgtgtctcgtgggcgaggacgggccaccatcaactgacaacgtccagaccagtagtttatttttacacgctaccaacaataagagctacttagcttaggttccagcagaaaccaggacatcctacctctactgctactatttacgcgggtccgtaccgtacccgggaacgtcccggggtccctcggaccgtattcgaggtggcgaggcgggtctgggactagtacttcacgtcctacaaccatccagcacgcctagacaggtcagaagtntcggaggtcctaagtttacgttactgtaccaggtaactaagtttattaacttcgttccctactacgacgtaccgtaccggaccgaagggaccgtaagggtaggtaaactacaaaacggcgttaggcgtactcgcctacgtacg

SEQ ID NO: 161021 - DNA, 742 bp, Homo sapiens
  misc_feature: GYAE6OF01AU0XN.22.27.C05.1.454.CMB.1.raw
  modified_base (563)..(563): a, c, t, g, unknown or other
  misc_feature (563)..(563): n is a, c, g, or t
  modified_base (710)..(710): a, c, t, g, unknown or other
  misc_feature (710)..(710): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtcgccgtccggggacatcgtgatcgaccagtctccagacctccctggctgtgtctcgtgggcgaggacggccaccactacaactgacaacgtccacgccaagtattacttttacagtcctaccaacaagtaacgacgtacttaacttacgtacgttcggttaccacgactaacgaaaccgtaggtacctacttcctaccgtactaccgtactcctactacgtttacggtacggtaccgtaccggtaccgggtaccggttcccgggtccgtaccgtaccgtcttacgtaggtcggcggtacggcgggtcgtacggtaacgtacggtacttccgaccttactaaccaccgagtacccgacgtaccgtacgcccgttagcggacggtctaaaggactccggtaggtcgtaccgttaagttttccgtaacggnttaacgtagtaacttaaacgtttactttaacccgtaaccttcccgtactaccgggtaaccgtttcggtacccgggaaaacccgggtaacggtaacggtaaacggtaacgtaaaccggttaaaccctaacggtacgttaccggggttnaaccccgtagtaacccttccgaatttcccggg

SEQ ID NO: 161022 - DNA, 943 bp, Homo sapiens
  misc_feature: GYAE6OF01D67KQ.22.27.C05.1.454.CMB.1.raw
  modified_base (713)..(713): a, c, t, g, unknown or other
  misc_feature (713)..(713): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcccgtcgggacatcgtgatcgacccagtcctccgagacctcccgtggcctgtgtcgtcgtcgggcgaggacgggaccacctatccaaacgtcgacgtaacggtcccaagaccgtaaggtaacgtttaacttttttaccaacgtaccgtaacccaaaccctaaagtaagacggttaccttaacgtttaaggtccgttttaacgggttaccaacggaccgttaaaccggaaaccgtaacggggtaaccctaaccgttccccgttacccttccgttaaccgttcggtccttccgttaaaccggttttaccggttacgggggtacccgggttaccccgttaaccccgggggtaacggttcccccgggggttacccgtaccggtaacccggtacgtttaccgtagggtaccgggtacggtacggtccgggttaacggttcggggaaacctgggttaacctttccgtaccgttacctaccgtaacccgacgttaccgacgaaccgtacggtccccgtagggaccacggggtactaccgggaaaggttccgttagggttacggtaccggttaaacggttttnttttaaccccgtaagggtttcaacccggttaattaaacgtttactttaaccgtttacgtttaacccccgttacccggtaacccgtacccggtaacccgggtttacccggtaacccgggtaaaaccggggtaccccggttaaaaggggtaacggggtaaaccttaaaccccgggtaaggtaaaacccggttagggccccggtttaacggaccgtaccggtaaacccctacg

SEQ ID NO: 161023 - DNA, 821 bp, Homo sapiens
  misc_feature: GYAE6OF01BEA9W.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtcgtcccgtccggggacattccgtgtactcggacccctagtcctccacgtacctcccgtggcgtgtcgtctcgcggggcgaggacgggcccaaccagtaccaacgtcgactaacgtcccagccgaagtacgtttactttttacgacgacctacccaaccaaagtaacgtacgaccgtttaacgttacgtccgtttacggtacccgacgtacgaacggaaacccgtacggaactaccgtacccttccgtcttacccgtcgtcccgtacgttacgttttaccggtccgggtaccgttacccgggttaaccccggtacgggttacccgggtacccgtccggtaaccgtacgttaccgacggttcggaccgtcgggtccgggttaccggtacgggtactacgttccgttacctaccggtccctaacgaccctacgtacgacgtaccggtcgtcccgtacggacgtaccggtacgtaccggtaagttacgtacggttacggtacctttaaggtttataaccggttggtaacctacgtaacttaaagtttacttaacttacccgttcccgttacgtaaccggtaccggtacccgttaccggggaacccgtaacgggtaccgtaaaggtaccggaaacgtaaccgtaaaccgttacggtcggtacgggtaccgaccgtacctcgttaacccg

SEQ ID NO: 161024 - DNA, 857 bp, Homo sapiens
  misc_feature: GYAE6OF01APLZ0.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtcggggacatcgtgatgacccagtctccacgctcccgtggctgtcgtcgtcgtgggcgacggacgggccaccataccaacgtcgacacgtccgagccagtagtttactttttacacgtctaccaactaagtaacgacgtacttaacgttacgtcgtttacggttaccacggaccaaacggaaaacccgtaggtaacctacttccccttaccctaccttaaccgttcggtaccttaccgttaacgttttaccggtcggggtacccgttacccggttaaaccccggggtaaccggttccccggggttaccctacggtacccggttacgttaccggacgggttcgggaccggtacggggtcccgggtacggtaccgggaaccgtacgttacgtttacctaccgttcctacctaaccgtcgtacgacgtaccgtaccgtcgtagcccgtaggtacttaagggaaacgttggttcgggtaacgttacgttaactttttacgtaccgtgggtaaccctaagttaaccgtaacttttaacgttaacgtttcccctaccccgttaccgtaacgggtaacccgttaaccggggttacccgggaaaccggtaaaccggggttaaccggtaaacgggttaaccgggtaaaaccgttacgaaaaacccgttacggttacggggtaccttacccgggtaaaggacccccttaaacggttgtttaaccccgg

SEQ ID NO: 161025 - DNA, 968 bp, Homo sapiens
  misc_feature: GYAE6OF01CNYMA.22.27.C05.1.454.CMB.1.raw
  modified_base (404)..(404): a, c, t, g, unknown or other
  misc_feature (404)..(404): n is a, c, g, or t
tcagacatacgcgtcacgaccggtgctcgatttagacgcgatcgaagggtttgggggctacaacaggcaggcaggggcagcaagatggtgttgcagacccaggtcttcatttctcttgttgctctggactctctggtcgcccgtaccgggacagtcgtggatcgacccagtcctaccacgtacctcccgtggtcttggtcgttccgttcggtcggggacgaacggaccgggtacccaacctaactaccgaacgttacgacctaacgtcccaacgtaccgtaagttaacgttttaacgtttttacgacgtaccctaccgaaacctaaaagtaacgttaacggttacttacggtcgtttacgttaccgacgaaccaacgaaaccgagtactacgtccgtccgtacnctacgtcgtacctactaacgtttccgtcgggtaccgtacccggttacccgggtaaccggttccccggggttaccctacggtacccggttacgttaccggaacgggttcggtaccggtacggggtcggttaccggtacggggtaaaccttacgtttaccgtttaccgtacccttaacctacccgtaaccggtaaccgttccggaaaccgttccggtaaccgttcccgggaaccgtaccgggtaaacggttcctaaaagggggtttaacgtaccgggtttaccggggtaccgttttaaggttttaaacggtttttttaacgtaccgttttaaccgggtaaacgtaagtttaaaccctttaacttttaaactttcccttaacccgttttaccccgttcgtaaacgggtcccggggtttacccgtaaaacccggggaaaccccgtaaagggggtaaacccgtttaaaaccggggtaactaaaaaacccggggttaccttaaaacgggtaacccggttttcggacccgggtttaacccgtaccgaacccgttaacgtttggtttacccc

SEQ ID NO: 161026 - DNA, 673 bp, Homo sapiens
  misc_feature: GYAE6OF01CUB8G.22.27.C05.1.454.CMB.1.raw
  modified_base (184)..(184): a, c, t, g, unknown or other
  misc_feature (184)..(184): n is a, c, g, or t
  modified_base (249)..(249): a, c, t, g, unknown or other
  misc_feature (249)..(249): n is a, c, g, or t
  modified_base (475)..(475): a, c, t, g, unknown or other
  misc_feature (475)..(475): n is a, c, g, or t
  modified_base (653)..(653): a, c, t, g, unknown or other
  misc_feature (653)..(653): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccgggacatcgtgatcgacccagtctccagacctccctgctgtntctcgtaggcgagacggccaccatacaactcgacacgtccacgcctaagtagttttatttttacncgtacctaccaaccaaagtaacgactacttaacgttagtcgttcggttaccagactaacgaaaccgcggactaccttccctcctactactcgtcctacttacgtttacgcgggtccgttaacccggtaccgggaccgtccccgggtccctaggacctcgttcgaggtcggacgtacggtcgggtcgacggtactagttacttcacttcaccactatccgagtaccncgtcctagacgacgacgtagagtacgtggtacgtactttacgttttactaccgtgtacgaagtacttaaacgtttaacttcgtttaccttcctaccgtacgtaccggtccgttaccggaaacggtacggtaacgaaggttaacgaacgtaaacgtaacgtacgtacgtcccggtaacncgtaacctcgttcgttaccg

SEQ ID NO: 161027 - DNA, 743 bp, Homo sapiens
  misc_feature: GYAE6OF01BWC35.22.27.C05.1.454.CMB.1.raw
tcagacatacgcgtcacgaccggtgctcgatttagacgcgatcgaagggtttgggggagctacaacaggcaggcaggggcatcaagatggtgttgcagacccaggtcttcatttctctgttgctctggatctcgtggtcgccgtccggggactagtcgtgatcgacccagtcctccagacctcccgtggctgtcgtctcgtggcgaggacggccacatacaatgactacgtccacgaccagtagtttacttttacgacgtcctaccaacaaataacgagtaccttaattacgtcgtttcgtaccgagaccgaacgaaaccacggacactcctcctactactcgtactctaacttacggtcggtaccgtaccgtaaccggggtaccgttccccgggtcccgtacgaccgtacgtacgtcggtacgcgtaggtccgggtacgacgggtactacgttaacttccgaacttccgtacctaaccgtactacgacgaccgtacgcccgttacgacggtacgtaccgtaagtaacggtacgtaggttacgtacgtttaacgtttacgttaccgtaacgtactaacggttaacttaacttacgttaaccttacccgtttacctaccggttagtaccggttaccggttaccgggtaaaccgtaacgggtaaaccggtaacggtaaacggtaaaccgtaaccgtaaaacgtcggttaacgtaccggtaccgtacgtaacccgtacgttaaccg

SEQ ID NO: 161028 - DNA, 965 bp, Homo sapiens
  misc_feature: GYAE6OF01ANO8R.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgataggacccagtctccagacctccctggctgtgtctcgtgggcgagacgggcccaccataccaacgtcgtacaacgtaccacgccaagtaacgttatttttacgacgtcctaccaacctaaacttaaacggacgtacttaaccgttacgtctttacgggttacctagaccaacgaaaacccgaaggtaaccctaacctttacccttacccgttacctaaccttcggtacctttacctaacgttttaccggtacggggttcccgttaaccccggttaaccccggggtacggttcccccgggggttaaccccgttcggtaacccggttacgtttacccgggtacggttccggaacggtaccggggcccggggttacggttaccggggttaacccgtaaacgggtttaaccgttttttaacccgacccgtttaccccgttaacctaacccccgttaacttaacccgggtaaccggtacccgtaaaccgggtaccccggttacggtaccggtaacgggaacccggttttagggtaaacggtacggttacgggttaccgggttaacgttttaaccggtttttaaccgttaacggtttaaccgttaaccggtaacggttaaccttaaaagtttaacgttttaaccttaaccgttttccccggtacttaccgggttaacggtacccgggtttaacccgggtaaacccgttaaacggggaacccgttaaagggttaaaccgggaaacctttaaacccggaaacgttaaccggttacggacggtacccggttaacgtaacccggtaacccgttaacgg

SEQ ID NO: 161029 - DNA, 853 bp, Homo sapiens
  misc_feature: GYAE6OF01CWXCX.22.27.C05.1.454.CMB.1.raw
  modified_base (224)..(224): a, c, t, g, unknown or other
  misc_feature (224)..(224): n is a, c, g, or t
  modified_base (559)..(559): a, c, t, g, unknown or other
  misc_feature (559)..(559): n is a, c, g, or t
tcagacatacgcgtcacgaccggtgctcgatttagacgcgatcgaagggtttgggggctacaacaggcaggcaggggcagcaagatggtgttgcagacccaggtcttctatttctctgttgctcgtggtactcgtcgttgggtcgtcccggtaccggggacagttcgtagactaccggaccctagtcctaccgacgtaccctccgtggtcctgtcgtcgtcggngggacggacggaccggaccaccaacttaccaacgtacgacgtaaccgtccgaacgtaccgtaaggttaacgttttaacttttacacggtaccctaaccgaaacgtaaataacgtacgttacgttaacgtcgttaccgttacggtaccgaagtaccgaaacgaaccgagtaacctccttacctccttacgtacgtcgtactttacgttacgttccggtccgggtacgttacccgggtacccgggttaccggtcccggtccctaagaccgtattacggacgggtcgacggttcggcggttacgaggtactacgttacttcctactacacctacgtanaccgtgtcgtcctacgtagccggaagtgtaaggacgttaggtcgttacgtagtttaacggttctaggtactaacggtacttaacttaaacggtttaacttttaccgttacccgtttaccgttaccgaacccgggtttaccggtaacccggggtaccgttaaaaccggggggaaaaaccggttacgtaaacggggtttaaaaaccgaaaccggttaaacgggttaaaagtttaccggggaaacggttcccggtttaaacggaccccttaaccttaaaaccgtcccggtttttcgg

SEQ ID NO: 161030 - DNA, 706 bp, Homo sapiens
  misc_feature: GYAE6OF01EF0HL.22.27.C05.1.454.CMB.1.raw
  modified_base (509)..(509): a, c, t, g, unknown or other
  misc_feature (509)..(509): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccgggacatcgtgatcgacccagtctccagacctcctggctgtgtctcgtgggcgaggacggccaccatacaactgacaacgtccacgccagtagttactttttacacgtcctaccaacctaaagttaacgtaacgtttacgttagtccgttacggttaccaagactaacgaaaacccgtaggaacctaacttccggttcctcggacctaaccgtcgtaccttacgtacttttaccggtcgggtccgttaccggtaccccgggtaacggtcccgggtaccctaggacccgtattacgaggtcggacgacggtcggtacgagggtacacgttacttccgacttccgacctacgtatacgacgcgtaacncgtagctacggctaggaaggtcgttggtacgttacttagttttattacgttcgtaagaacctattaattaacggtttaactttcctacccgttccaaggttaccggtaccgtacgggtaacccgaacgggtaccgtaaagggtaacgtaataacccggtaaacgtacgttaggacgtacctacggacctacgttacg

SEQ ID NO: 161031 - DNA, 933 bp, Homo sapiens
  misc_feature: GYAE6OF01C99G4.22.27.C05.1.454.CMB.1.raw
tcagacatacgcgtcacgaccggtgctcgatttagacgcgatcgaagggtttgggggagctacaacaggcaggcaggggcagcaagatgggtgttgcacgacccaggtccttcatttctcttgttgctcgtggatctcgtggtcgccgtccggggactacgtcgtgtactcgaccctagtcctaccgagtaccctcccgtgtcgttcggtgttccgtcggtcgggtacggaggaccggccctaccgactaacctaacgtcgactaacgtccacggtaccgagttaacgttttacttttacgaaccgtcctaccgaaacctaacgtacgtaacgttaccgttacgttacgttaccgtttaccgtaaccgaacggtaaccgtaaaaccggtaaaccggtaccgtaaccttacccgttaccccttaccgttaccttaccgttaccgttaccgtttaccgttaaccggtttacgggtccgggttacccggtaacccgggtaccccgggttaccgggttccccgggtaccgtaccggtaaccggtttaccgtacggtcggtaaccggtccgggtacgggtaccggtacggtacggtaccgttacgttacccgttccgtacccgttaccgtacctaaccgttacgtaccgtacggtacccgtacccggttccgtaccggtaaccggtaccgggtaaggtaacggtacggttacgggttcgtaacggtttacgtttaacgtttacgtaccgttacggtaacgttaacgttaccgttaacgttacgtttaccttacccgttacccgtacgttaccgttacccggggttacccggtaaccggtaaccggtaaccgggtaaaccgtaacgggttaacgtaaaccggttaaccgtaaaccgggtacgtacgggtacccgtacgtaaccggtaccctacggtacc

SEQ ID NO: 161032 - DNA, 773 bp, Homo sapiens
  misc_feature: GYAE6OF01B71PQ.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctcttgttgctcgtggatctcgttgggtcgtccgtccggggacagttcgtgatcgacccgtagtcctcacgtacctcccgtggccttgtgtcgtcggtcgggcggaggcgggaccaccatacaacgtgacaacgtccacgaccagtacgtttattttacacgtacctaccaactaagtaacgacgtacttacttagtccgttacgtacacgtacgaacgaacccgaggtaacctcttaccccgtccttactaccgtcgtaccttacgtaacgtttccggtcgggtacccgttaccggtacccgggtaccgtcccgggtacctacggtaactcgtcgaggtcggcgtagggtccggtacggtacggactacgttctttacgacctttccaccgtaccaagtccgacgacgtaccgttcggaggtccaaggtcgtacggaagttcgagggtttacgtattttacgtttaacacgttccgtacaaccgtaagtttaacttaatttaccgttaccgttacctccgtaacgtttaaccggtccgtaacccgggttaccggaaaccgggtaaacgggtaacgtaacgggtaaaacccttacgggaaacccgtttagggaccggtttaacggaccttaaccggaaccctttacggtacgttttccccg

SEQ ID NO: 161033 - DNA, 844 bp, Homo sapiens
  misc_feature: GYAE6OF01AUSN7.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagacctccctgctgtgtctgtggcgagacggccacatcaactcgacacgtcagccagtagtttatttttacgacgtcctaccaacctaaataacgtaggtaccttacgttacggtccgttttcggttacccaagtaccgaaaacgaaaaccgacgggaacctacttcccccgtacccttcgttaccgtcgtccttacctaacgtttaccggtcggggttaccgttacccgggtaaacccccggggtaacggtacccccgggggttacccctacgggtaaccccgttaacttaccggacggttacgggacccggtacgggttaccgggtcggttaccggggtaactaacgggttacttttaaccggacccttccgtaccctaacccgtactaccgaacgtaccgaaccgttcccgaaggtaccgtacgggtaaccttaagggaacgtaccggtttagggtaccggttaacgttttaacggttttaaattttcgggttaccggttaacgaaacggtaaccttaaagtttaaacttacctttacccgttaaccctttccgtacgttaacggtaccggttaccggaacccggtaaaccgggtaacggtaaagggttaaccgtaaacggtaaacgaaacgttaaaccgtcggtacggtactacgtacctaacgtcgttaccg

SEQ ID NO: 161034 - DNA, 789 bp, Homo sapiens
  misc_feature: GYAE6OF01EUU8B.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctgggtgccgtccgggacagtcgtgatcgacccagtcctccagacctccgtggctgtcgtctcgtgggcgagacggccacatcgaatgacaagtccacgccaagtagtttacttttacagtcctacccaactaagtaacgacgtaccttaacgttacgttcgtttacggtaccaagaccaaacgaaccgtaagacctacttcccgttacctacgactcgtacctacgttaacgtttcggtacggtaccgtaccggtaacccgggtaccggttcccgggtcctacgaaccgttcgtcgacggtggacgcgggtcgggtacgtacgggactacgttacttccaccttacctaccgaacctacgtaccgacgacgtacgtaccgtcgacggtacgtacgtaagggtaacgtaggtacggttcggttaagtttacgttttaacgttacgtacgtacgtaagtaaacctttaacgttaacttttaacttccctttacccggtaccttaacgggtacccgtttacccggggttaaaccggaaccccgggtttaaaagggtaaacccgggtaaagggttaaacggtaaaccgttaaaacccggttaaacgtaccgggttttaggaccccgggttaactcccggtaaaacccttcgttaacccgg

SEQ ID NO: 161035 - DNA, 723 bp, Homo sapiens
  misc_feature: GYAE6OF01DZR1N.22.27.C05.1.454.CMB.1.raw
  modified_base (451)..(451): a, c, t, g, unknown or other
  misc_feature (451)..(451): n is a, c, g, or t
  modified_base (517)..(517): a, c, t, g, unknown or other
  misc_feature (517)..(517): n is a, c, g, or t
  modified_base (526)..(526): a, c, t, g, unknown or other
  misc_feature (526)..(526): n is a, c, g, or t
tcagacatacgcgtcacgaccggtgctcgatttagacgcgatcgaagggtttgggggagctacaacaggcaggcaggggcagcaagatggtgttgcagacccaggtcttcatttctcttgttgctctggtatctctgggtgcccgtccggggacagtcgtgatcgacccagtctccagacctccctggctgtgtctcgtggcgaggacggccacataccaactgacaacgtccacgccgaagttaacgtttactttttaaccgacgtcctacccaaacctaaagtaaacgacgtaccttaacttacggttccgtttacggttaccaacgtaaccgaaacgtaaaacccggacggaactaacctccccttaccttaccttaacgtcgtccttacgtacgtttacggcggtccgttaccgtacccgggtaccggtcccggtccgtacgacgtntacgtgtcgcggtaggtccggtcgtacgggactacgtacttccacgtcctacactacgacacggtnaccgtacgngacgaggacctagaagtaggtggtacgtaacgtttatttacgtacgtgtccgtaagtactaagtttacttactttacctacccgttacgtacggttacgttaccggtaccggtaaccggtaaggtaaaccggtaaggttaaacgtaaactaaccggtaaacgtaccggttaggtcggtaactcgaccctggttaccc

SEQ ID NO: 161036 - DNA, 711 bp, Homo sapiens
  misc_feature: GYAE6OF01E2RBW.22.27.C05.1.454.CMB.1.raw
  modified_base (151)..(151): a, c, t, g, unknown or other
  misc_feature (151)..(151): n is a, c, g, or t
  modified_base (513)..(513): a, c, t, g, unknown or other
  misc_feature (513)..(513): n is a, c, g, or t
tcagacatacgcgtcacgaccggtgctcgatttagacgcgatcgaagggtttgggggagctacaacaggcaggcaggggcagcaagatggtgttgcacgacccaggtcttcatttcctctgtgctctggatctctggtcgccgtccggganatcgtgatcgaccagtctccagacctccgtgtctgtcgtctcgtgggcgaggcggccaccgatacactgcaacgtccacgtccgaagtacgtttattttacagtccctaccaaccaataacgatacttacttacgtcgttcgtaccgagacgaacgaaaccgtacgactaccttcctcctacgttaccgtgtacccttacgttaacgttttacggtccgggtacgttaccccggttaacccgggtaccggttccccgggttcccgtaccggtaccgtacttacgacggtcggacgtacgggtccgggtacgtgggaaccgtacgttactcctaccgtccactaccaactaacgaacctacgngacgtacgtcgtaagaagtgttcgtacgtcttaagttctacgacgcgttaaacactttaagttcttaacgtataacccgttccgttacgtacccgggttaccgtacgaaccggtaacgggtaaccgtaaaggtaaccgtaaaagaaccgtaaaccggtcggaagtcccgtactacgacccgttacacgtttcgttacg

SEQ ID NO: 161037 - DNA, 888 bp, Homo sapiens
  misc_feature: GYAE6OF01CXXW0.22.27.C05.1.454.CMB.1.raw
  modified_base (659)..(659): a, c, t, g, unknown or other
  misc_feature (659)..(659): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctcgtggtcgccgtccgggactagtcgtgagtcgacccagtcctaccagacctcccgtggtctggtgtcgtcgtcggggacgaggacgggcccaacatacaacgtcgacacgtccacgaccgaagtacgttttacttttaacacgtacctacctaaccgtaaagttaagaccgtacttaacgttacgtccgttttacgggttaacccaaggtaccaaaaccggaaaacccgtacggtaacctaacctttccccgttacccttacgttaccgttcgtacccttacgttacgttttccggtaccgggtaccgttacccggtaacccgggtaccggtccccggggttaccctaggtacctacgttcgacggtcggaccgtacgggtcgggtacgtagggaacctggtttactaccgtacctccgaacctaccgtatacccgagtacccgtacgcccgttaggaccgtacggttacctaagggtacgttacggttccgggtaaggttacccgtttaaggtttttaaccgttacgngggtttaaccgtaacggtaaacttttaactttaacgtttccctttaaccggttcccctttaaccggtaccggttaaaccgggtttaccccgggttaaccgggtaaccggtaaaaccggggtaaccggttaaacgggtaaccggttaaaaccggttacccgtaaaaaccgggttcccgttaggggtaccccacggtttacccgaacccttaccggtttaccggtttaccg

SEQ ID NO: 161038 - DNA, 785 bp, Homo sapiens
  misc_feature: GYAE6OF01CGWU3.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgtctctggatctcgtggtcgccgtccgggacatcgtgatcgacccgtacgtctcccacgtacctcccgtcggtctgttgtccgtcgtcgggacgaggacgggccaaccctataccgaacgtacgacgaacgtccgacgaccgtaagtacgttttactttttaaccgacgtacctaccgaaacctaagtaacgacgtaccttacgttagttcgttcggttaccgagactaacgaaccgacggtactactccgtccttacgtactacgtcttacctagtttacggtccgggtaccgtcccggtaacccgggtaccggttcccccgggtaccgtaccggtaaccggttacgttaccgtacgggtcggaccggtacggtccggggttacggacggttaacgtagttaccgttccgtacccgtccgtaccaccgtaatcccgacggacctacgtccgtacggccgtaagcgtaagaagtggttcgtacgttacggttttactttaacgttacgtacgttacaagtaacttttaatactttccgttaacctttccggtacccttaggtaacccgggttacggttacccggaaacggaaaccggtacgtaacgggtaagtaaaccgtaacgaacgtagttacgggtacaccggttaacacctcgtagtttccg

SEQ ID NO: 161039 - DNA, 782 bp, Homo sapiens
  misc_feature: GYAE6OF01A1QT2.22.27.C05.1.454.CMB.1.raw
tcagacatacgcgtcacgaccggtgctcgatttagacgcgatcgaagggtttgggggctacaacaggcaggcaggggcagcaagatgggtgttgcagacccaggtcttcatttctctgttgctctggatctctggtgcctccgggacatcgtgatgacccagtctccagactccgtggctgtcgtctcgtgggcgagacgggccaccatcaactcgacacgtccagaccagtacgtttatttttacacgtcttaccaacctaaataaggtacgtaccgttaaccgttaaggtccgtttacgggttaccaacggtaccaaacgtaaaaccgacgggtaacctaaccttccctacccgttacttaaccgtcgtaccttaccgtaacgttttaccggtcgggtacccgttaccggtaaccccgggtaacggttccccggggtacccgtcggtaaccgtactttcgaacggtcggacgtacgggtccgggtacgtacggggaactagtacgtttacctaccgttacgtacccaaccgtataccggacgttaccgaacggtccttacggaccggtacggtacctagggaatacggtggtccgtaagtttgtttaaaccgtgttacgtaacgacgttaactaagtttaacgttccgtttactcccgttacgtacgtaccgggttacgggttaccgaccggtaaacggttaacccggaagggttaacgaaaccgttaccgtaaacggtacgttcggtaacgtccgttccggaaccttacgtcgtttccg

SEQ ID NO: 161040 - DNA, 873 bp, Homo sapiens
  misc_feature: GYAE6OF01EK4GS.22.27.C05.1.454.CMB.1.raw
  modified_base (812)..(812): a, c, t, g, unknown or other
  misc_feature (812)..(812): n is a, c, g, or t
tcagacatacgcgtcacgaccggtgctcgatttagacgcgatcgaagggtttgggggctacaacaggcaggcaggggcagcaagatggtgttgcagacccaggtcttctatttctctgttgctcgtgacttctctggtcgccgtccgggacactcgtgactcgacccagtcctaccagtaccctccgtggtcctgtcgtactcgtacggcgagacggccacactacaacgtcgaaccaacgtccacgtacctagttacgttttaattttacgactcctaccaacgtaaagtagacgtacttacgttagtccgttcggtacctagtacaacgaacctacgactccgttacccctaccgtacttcgtacgtacttacgttaacttaccgggtcggtaccgtaacccggttacccgggtaaccgttccccggggtacctacggtaccgttacttacgacgggtcggacgtaacgggtcgggttaccagggtaactacgtcgttaccgaccttcgtaccaaccctggtacccgacgtacccgtacgtaccgtaggtacgaaccggttaggaacgtaacgggtcgttcggtaacgttaccggtttaaacttttaccggttacgtaccgttaacaaccgttaaacgtttaaacgtttaccttttaaaccggttcccctttccgtaaccggtttaacggacccggttttaccccggggaaaccggtaaaccccgggttaaaaccgggtaaaccgggtaaaccggggttaaaaccggttaaaacccgaaacccggggttaaaacccttttaccgggggtntaaaaccccgggggtttacccaaaggtttcccccttaaaccggttaccgggttttaccccg

SEQ ID NO: 161041 - DNA, 848 bp, Homo sapiens
  misc_feature: GYAE6OF01BB5YM.22.27.C05.1.454.CMB.1.raw
  modified_base (631)..(631): a, c, t, g, unknown or other
  misc_feature (631)..(631): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctcgtggtcgcccgtccggggacagtcgtggtatacgacccagtcctccgacgtacctcccgtggtctggttcgtcgtcggtcgggacgaaggaccggtaccaacctactaccgaacgtcgacgaacgtccacgccgtaagttagtttaactttttacgacgtacctaccgtaaacctaagtaaacggtacgtacttaacgttacgttacgttacggttacgacgtaacgtaaccgaaaccgacggtacctactccctaccgttacacgtcgtccttaactacgttacggtccggtaccgtacccggtaaccggtaacggtccccgggtacctacggtacctgttacgagtcggacggtacggtacggttacggacggtactagttacttacaccgtacgtccaacgtctaacgaaccgcgtacacgtcgaaccggtagtaacggaacgtaggtacgttacgggttaacttacggttaacgttttaacgttcgttaaccgngttaaaacgtaacgtttaagttttaacccgttaattttaccccgtaacccttaccgttaacgggtaacccgtttaaccggggttaaccgtaaaacccgggtaaaaccggggtaaaacggttaaaccggggttaaactaaaaccggttaaacccgtaaacggtaaacggttttaccgggacccgtttaaacgtaccgttaaccggtaacgtttacccg

SEQ ID NO: 161042 - DNA, 730 bp, Homo sapiens
  misc_feature: GYAE6OF01AC8OU.22.27.C05.1.454.CMB.1.raw
  modified_base (187)..(187): a, c, t, g, unknown or other
  misc_feature (187)..(187): n is a, c, g, or t
  modified_base (316)..(316): a, c, t, g, unknown or other
  misc_feature (316)..(316): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctcccgtggctgtntctcgtgggcgaggacgggccacctatcaactggacacgtccagccagtagttactttttacacgtcctaccgaactaataacgagtacctacttacggtctttcggtaccagaccgtaacgaaaccgnggtaacctacgtccctacctaccgtacttcgtacgttcctaacgtttaccggtcggtccgtacccggtaacccgggaaccgttcccggggtccctaggacccgtagttcgagggtacgtggaccggtcggttcggacgggtactacgttaacttcgacctacgtaccacgtactcggaacgcctacggcctagacgtacggtacgagaacgggtcctagggtcgtaccgttaaggttttactacgtacgtaacgaccttacgtaaatttacttaccgtttaccgttacccctacggttaacggaaccggttaccggtacccgggaaacggtaacggtaaaccggtaaggtaccgtaaacgttaaacccggaagtttcgccgggaagtacccgtacgtaccgttccgttaaaccg

SEQ ID NO: 161043 - DNA, 794 bp, Homo sapiens
  misc_feature: GYAE6OF01A3G1V.22.27.C05.1.454.CMB.1.raw
  modified_base (478)..(478): a, c, t, g, unknown or other
  misc_feature (478)..(478): n is a, c, g, or t
  modified_base (627)..(627): a, c, t, g, unknown or other
  misc_feature (627)..(627): n is a, c, g, or t
  modified_base (636)..(636): a, c, t, g, unknown or other
  misc_feature (636)..(636): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctcgtggtcgccgtaccgggacatcgtgactcgaccctagtcctaccgacgacctcccgtggccttgtcgtccgtcgtgggcgacggaacgggccaacgtactaccgaacgtacggaccaacggtccacgtaccgtaacggttaattttaacgtttttacacgtaccttaccaaaccggtaaataagtacgtaccttaacgtttacgtccgtttcggtaccaggtaccaaacgtaaaccggtacaaccgtactccctccgtacttacgtcgtaccttctaacgtttacggtcggtaccgttacccggtacccgggaacgttcccgggtacctgggtaaccctgttaccgnggtacgacggtacggtcgggtacggtacggtacgtaacgtcgtttaccaccgttcgaccctaataccgtaacaccggcgtaccgactggtaccggacgtcggttaacgacggttcgtacgggtaactacgtttaagttacctaggttanaccgttaanaacttaacgttattaacccgttaccttacccgtcttacggtaacggttccggtacgtaaacccgaagggtaaaccgtaaggggtaaccctaaaacggttacctaaacgggttaacgttacggtacgtaccctaaggtaaccctaccgttaggttaccc

SEQ ID NO: 161044 - DNA, 1010 bp, Homo sapiens
  misc_feature: GYAE6OF01BVQLQ.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttctatttctctgttgctcgtggatcgtcgtggtcgacccggtccggggactagtcgtgacgtacgacccgtagtcctaccgacgtaccctccgtggctggtcgtccgtcggtcgggacggacggaccgggacccaaccgtagttaaccgaacgtacgaccgtaacgtaccgacggtaccgtaagttaacgttttaacgttttacgaccgttcctaacccgaaacgtaaaagtaacggacgttaaccgtttaaacgttacggttacgtttccgggtaaccaacgtaaccggtaaacgtaaaacccggtaaccggaacccttaccgttaacccccttacccggttaaccttaccgtacggttacccctttacggttaaaccgtttaccggggtccgggttaaccccggttaaccccggggtttaaaccccggggtaacccggggtttacccccggggtcccttaaaccggggtaacccggtttaacgttaccgggtaaacggggttccgggtaaccggtaaccggggggtcccgtttaacgggtaaacgggtaaccccttaaggggtttacccttttaaccccggtaacctttacccgggtaacccctaaaccgttaacccggtaccggtaacccgacgtacccgggtttccccggaacggtaccgtaccgggtaacggtaacggtacgtacgggtagttacgttaacgttacgttttactaccgtagtaacctacggtaaacttacgttaactcgtttaacctccgttaaccggttaccgtaacggttaccggtacccggtaaacggaacccggttaacggtaaacggggtaaacctaaacgtaaaccgggttaacccgtagtttaccggggtactaccggttaccaccgttcccgttaacgg

SEQ ID NO: 161045 - DNA, 777 bp, Homo sapiens
  misc_feature: GYAE6OF01D9FTI.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatcgacccagtctccagactccctggctgtgtctcgtgggcgagagggccaccatcaactgacaagtccacgccagtagttatttttacacgcctaccaacctaaataacgagtaccttacttagtcgtttacggttaccaacggaccaaacgaaaccgaggtaaccctactcccctccttacctacgtcgtacctacttacgttttacgtcggggtaccgtaccggtaaccccggggtaacgtccccgggggttccctacggtaacccgtcgtttacgacgggttcggacgtacgggtccggggttcgtcggggaactaacggttactttccaaccgttcctacctaaccgtactaccggtaacgtccgacgtccccgtcggtaaccggtacgggtaccgtaagtaaggttaacgttcgggtaggttaccgtttaaggttttaactttcgtacggtaaccgaacggtacttaaagtttaactttaactttaccgtttcccttaccgtacgtaacccggttaccggttacccgggaaccggtaacgggtaaaccgtaagggtaaacgaaacgtaaaccgaaacggtaacggttcggtaagtaccgtacctacgtccttaacg

SEQ ID NO: 161046 - DNA, 1008 bp, Homo sapiens
  misc_feature: GYAE6OF01DNWJ6.22.27.C05.1.454.CMB.1.raw
tcagacatacgcgtcacgaccggtgctcgatttagacgcgatcgaagggtttgggggagctacaacaggcaggcaggggcagcaagatggtgttgcagacccgaggtcttcatttctctgttgctcgtgtatctcgtggtcgccggtaccggggactagttcggtgtacgtcgacccgtagtacctccgaacgtccctcccgtggtcgttgtcggttccgtcggtcggggacggaacggaccgggacccaaccgtaacttaccgaaccgtacgaaccgtaaccggtaccgtaccggtaacccgtaaggtttaacgttttaccgtttttaaccgaccggttaccctaaccccgaaaacgtaaacgtaaacggtacgtaacgtttaccgttacgttacgttaccgtacgaacgaccgtaaacgaaaccgagacctacctcctaccgtctacgctcgtacttacgttacggtccggtaccggtaccggttacccgggtaccgggtacccggtacctaccggtacgtacgtcgtacgggtacggtacggtacgggtccggtacgggtaccggtacgttaccgggtttacttacctacccgttcgttaaccgtacccgtacgttaccgaaccgggtaccgtaccggttaccccggtagggtaaccggtccggttaaggtaaccgggtaaacgggttttcgtaccgggggtttaaacgtttaacccggttttaaacggttttaaccgttaccgggtttaacgtaaccgttaacggttaacccgttttaaaaccgggttttactttaaacccggtttaccctttacccggttacctaaaccggggtttaacccggtaaacccggggttaacccggtaaacccggggttaaaccgggtaaaaccgggtttaaacccggggttaaaactaaaacccggtttaacccgggtaaaacccggttgggtaaaccccgggttacggtaaacccgttccgggtaaaaccttcccgttaaacgg

SEQ ID NO: 161047 - DNA, 797 bp, Homo sapiens
  misc_feature: GYAE6OF01EGGMA.22.27.C05.1.454.CMB.1.raw
tcagacatacgcgtcacgaccggtgctcgatttagacgcgatcgaagggtttgggggagctacaacaggcaggcaggggcagcaagatggtgttgcagacccgaggtcttctatttctcttgttgctctggatctcgtggtcgccgtccggggactatcgtgatcgaccctagtcctccgacgtaccgtcccgtggtcgttgttcgtccgtcggtggggacggaggaccggccaccataccaacgtcgacgaacgtccacgaccgtagttagttttactttttacgacgtacctacctaacgtaacgttaaagttacgttttaaccgttagtccgtttacggttaccgagaaccgtaacgaaaaccgtaggaaccttacgtccgtaccgtacgacctacgtcgtactacgttacgtttacggtcgggtaccgttaccgggtacccgggtaccggttcccgggtacccgtacggtaccgttcgttacgagggtacggacggtcgggtaccgggtacggtagggaccgtacggtttaccttacctacccttaccgtaacctaccgtactaccggacgctccggtaccctggaaccggtaggtacgtaaggtaacgtggtacggtcgttaatttaccgttttagtacgttggactaagttaacttagtttaacttccttccttacccgtacgtaacgtaccgggtaccgttacccggaaaccgggtaacgtaacggaaggttaacggtaaacctacggtaaaccggttctacgggcgaacctttcggaaccttacgttcg

SEQ ID NO: 161048 - DNA, 497 bp, Homo sapiens
  misc_feature: GYAE6OF02HDME9.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtcctgaccgattcagtggcagcgggtctgggacagatttcactctcaccatcagcagcctgcaggctgaagatgtgcagtttatactgtcagcaatattatattcctctcagacgttcgacaagggaccaaggtgaaatcaaacgactgtggctgacactac

SEQ ID NO: 161049 - DNA, 752 bp, Homo sapiens
  misc_feature: GYAE6OF02FSEYT.22.27.C05.1.454.CMB.1.raw
tcagacatacgcgtcacgaccggtgctcgatttagacgcgatcgaaggttgggggagcgtacaacaggccaggcagggcgagcaacggattcggtgttggcagacccaggtcttcattactctgttggctctcggatcgtcttgggtgcctccggggacagtttccgtgtatgtacccttaagtcgtcctacgactcccgtggcgtggtcgtcgtccttggggtcggaggacgggggccgaccgtagtccaacgtcgcgaacgtcccagccagtacgttactttttacgagcctccgaccctaacttaaggagttacctaactttagacttttagggtttaccctaggcctaagtaaacccgacgggtaacctaagtttccccgtccctacggttacctaggcctacggacttttacgtaggggtcggttcgtaccccgggaagttccggggtccctcggtaccgtattcaggtacggaactagcgggtctaggggacctacggtagtttacgacctcgttcaaccctatcctacgccacgaccttcgacaacggcctagtaagttactcgtggcctagtttactacgtcgttcgaagtactaagttacgttaacttacgttcccttacgttacgtacgtaccgtttacggaccgtaacggggtaacccgtaacgggttacgggaaaccttaccgtaaaaccgtaaccttaccgggtaacggaccttacggtacccggtaaccctaaccggg

SEQ ID NO: 161050 - DNA, 506 bp, Homo sapiens
  misc_feature: GYAE6OF02HSJJG.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatccggggtcctgaccgattcagtggcagcgggtctgggacagatttcactctcaccatcagcagcctgcaggctgaagatgtggcagtttatactgtcagcaattattatatttcctctcagacgttcggccaagggacctaaggtggaaatacgaaacgaactggtaggctgcactac

SEQ ID NO: 161051 - DNA, 515 bp, Homo sapiens
  misc_feature: GYAE6OF02F1XV2.22.27.C05.1.454.CMB.1.raw
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggatccggggtcctgaccgattcagtggcagcggtctgggacagatttcactctcaccatcagcagcctgcaggctgaagntgngcagtttatactgtcagctaatattatattcctcctcagtacgttcggaccaagggacccgtaagggtaggaaactccgaaacgtactggtaggcctagacctaccatcg

SEQ ID NO: 161052 - DNA, 519 bp, Homo sapiens
  misc_feature: GYAE6OF02JJLKE.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtcctgaccgattcagtggcagcgggtctgggacagatttcactctcaccatcagcagcctgcaggctagaagatgtggctagtttatactgtcagcaatattatacttcctctcagaccgttcggccaagggtaccaaggttaggaaacttaccgaaaacgaacttggtcggctggaccaccta

SEQ ID NO: 161053 - DNA, 539 bp, Homo sapiens
  misc_feature: GYAE6OF02I8BTL.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatccggggtccctgaccgattcagtggcagcgggtctgggacagatttcgactctcaccatcagcagcctgcaggcctagaagatgtggactagttttactactgtcagtactaattattatactttcctcctcagtaccgttcgaccgtaagggaacctaagggtacggtaaactcgaaaccgtacttacggtacggctacgaccacctacg

SEQ ID NO: 161054 - DNA, 585 bp, Homo sapiens
  misc_feature: GYAE6OF02GR9AC.22.27.C05.1.454.CMB.1.raw
  modified_base (444)..(444): a, c, t, g, unknown or other
  misc_feature (444)..(444): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgaggacgggccaccatcaactgacaacgtccagccagagttatttttacagcctaccaaccaataagagctacttagcttggttccagcaagaaaccaggacactccctcctctactgctctatttacgtgggtccgtccgtaacccgggaacgttcccgggggtccctcggaccgtacttcgaggtggcacgggtcgggtcgtgggacagtactttcactctcacatcagcacgcctgcaggctagaagnttggcggactagtttattacgtgtacagactaagttattacttacttcctcctacgaacgtacgttccggaccgtaagggaccgtaagggtacgaaactaccgaaaacgtacgttggacggtactcgacctacctattccg

SEQ ID NO: 161055 - DNA, 496 bp, Homo sapiens
  misc_feature: GYAE6OF02F3HD4.22.27.C05.1.454.CMB.1.raw
  modified_base (493)..(493): a, c, t, g, unknown or other
  misc_feature (493)..(493): n is a, c, g, or t
tcagacatacgcgtcacgaccggtgctcgatttagacgcgatcgaagggtttggggctacaacaggcaggcaggggcagcaagatggtgttgcagacccaggtcttcatttctctgtttctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatccggggtccctgaccgattcagtggcagcgggtctgggacagatttcactctcaccatcagcagcctgcagctgaagatgtggcagtttattactgtcagcaatattatattcctctcagacgttcgccagggaccaaggtggaaatcaaacgactgtgctgcacatntcg

SEQ ID NO: 161056 - DNA, 520 bp, Homo sapiens
  misc_feature: GYAE6OF02HHOS2.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggcgtctacccgggaatccggggtccctgaccgattcagtggcagcgggtctgggacagatttcactctcaccatcagcagcctgcaggctgaagatgtgctagtttatactgtcagcaatattatagttcctcctcagtaccgttcggaccaagggacccaaggtacggaaattccgaaaacgtacgtggtaggcttacggcacctac

SEQ ID NO: 161057 - DNA, 519 bp, Homo sapiens
  misc_feature: GYAE6OF02IESEL.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggcgtctaccgggaatccggggtccctgaccgattcagtggcagcgggtctgggacagatttcactctcaccatcagcagcctgcaggctgaagatgtggctagtttatactgtcagtcaattattatattcctctcaagtcgttcgccaagggaccaagggtggaaactcgaaacgtaacgttgtacggtcctaggaccaccgattccg

SEQ ID NO: 161058 - DNA, 497 bp, Homo sapiens
  misc_feature: GYAE6OF02HQYOW.22.27.C05.1.454.CMB.1.raw
  modified_base (487)..(487): a, c, t, g, unknown or other
  misc_feature (487)..(487): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtcctgaccgattcagtggcagcgggtctgggacagatttcactctcaccatcagcagcctgcaggctgaagatgtggcagtttatactgtcagcaattattatattcctctcagacgttcgacaagggaccaaggtgaaatcaaacgactgngctgcactac

SEQ ID NO: 161059 - DNA, 572 bp, Homo sapiens
  misc_feature: GYAE6OF02JWJIS.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactggcgtcgtaccggaatccggggtccctgaccgattcagtggcagcggtcgtgggacagtattcactctcaccatcagcacgcctgacaggctagaagagtgtggactagtttagtattcgtacgtacgtataagttatttacttacgtttcccttacctacgtaacgttaccgtttacggaccgtaagggtaccgtaagggttaagaaacgtaccgtaaacgtaacgtcggttacggaccgttacggacctaccgtattaccg

SEQ ID NO: 161060 - DNA, 530 bp, Homo sapiens
  misc_feature: GYAE6OF02GMOSU.22.27.C05.1.454.CMB.1.raw
  modified_base (453)..(453): a, c, t, g, unknown or other
  misc_feature (453)..(453): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtcctgaccgattcagtggcagcgggtctgggacagatttcactctcaccatcagcagcctgcaggctagaagatgtgctagtttatacgtgtcagacaattattatacttcctcctanacgtacgttcgaccgtaagggtaccaaaggtcggaaacttaccgaaacgtaacgtcggtacggactcgccactaacg

SEQ ID NO: 161061 - DNA, 499 bp, Homo sapiens
  misc_feature: GYAE6OF02IP3UA.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctaccgggaatccggggtcctgaccgattcagtggcagcggtctgggacagatttcactctcaccatcagcagcctgcaggctgaagatgtgctagtttatactgtcagcaatattatattcctcctcagacgttcgccaagggcctaaggtgaaatcgaaacgactgtggctgccactacg

SEQ ID NO: 161062 - DNA, 550 bp, Homo sapiens
  misc_feature: GYAE6OF02G56YY.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctggcgagagggccaccatcaactgcaagtccagccagagtatttttacagctccaccaataagagttacttagcttggttccagcagaaaccaggacatcgtcctgcactgctcatttactggctctacccgggaatcccggggtcctgaccgtattccagtggcagcggtctgggaccagatttcgactctcaccatcagcagcctgcaggctgaagatgtgctagtttatagttgtacagtaccaattattagtactttccctaccttactagtaccgtttccggaccctaaggggtaccaagggttacggtaaactaccgaaacgaacgtacggtacgaccgttcggacaccctaacg

SEQ ID NO: 161063 - DNA, 506 bp, Homo sapiens
  misc_feature: GYAE6OF02F3LYY.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcggtctgggacagatttcactctcaccatcagcagcctgcaggctgaagatgtggctagtttattactgtcagcaatattatattcctctcagtaccgttgccaagggacctaagggtgaaatcgaaacgactgtcggactgactacatcg

SEQ ID NO: 161064 - DNA, 500 bp, Homo sapiens
  misc_feature: GYAE6OF02IHUSS.22.27.C05.1.454.CMB.1.raw
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggcgtctacccgggaatccggggtcctgaccgattcagtggcagcgggtctgggacagatttcactctcaccatcagcagcctgcaggctagaagntgngctagtttatactgtcagcaatattatattcctctcagtacgttcggaccaagggaccaaggtgaaatcaaagtactgtggctgcactag

SEQ ID NO: 161065 - DNA, 506 bp, Homo sapiens
  misc_feature: GYAE6OF02F4W5M.22.27.C05.1.454.CMB.1.raw
  modified_base (407)..(407): a, c, t, g, unknown or other
  misc_feature (407)..(407): n is a, c, g, or t
  modified_base (504)..(504): a, c, t, g, unknown or other
  misc_feature (504)..(504): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatcccggggtccctgaccgattcagtggcagcgggtctgggacagatttcactctcaccatcagcagcctgcaggctgaagntgtggctagtttatactgtcagctaatattatacttcctcctcagtacgttcgaccaagggaccaagggtaggaaatcaaacgactgtggctgcacntc

SEQ ID NO: 161066 - DNA, 503 bp, Homo sapiens
  misc_feature: GYAE6OF02GFX99.22.27.C05.1.454.CMB.1.raw
  modified_base (499)..(499): a, c, t, g, unknown or other
  misc_feature (499)..(499): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgtttctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccagggaccaaggtggaaatcaaacgactgtggctgcaccntctg

SEQ ID NO: 161067 - DNA, 504 bp, Homo sapiens
  misc_feature: GYAE6OF02H9GBA.22.27.C05.1.454.CMB.1.raw
  modified_base (406)..(406): a, c, t, g, unknown or other
  misc_feature (406)..(406): n is a, c, g, or t
  modified_base (414)..(414): a, c, t, g, unknown or other
  misc_feature (414)..(414): n is a, c, g, or t
tcagacatacgcgtcacgaccggtgctcgatttagacgcgatcgaagggtttgggggaggctacaacaggcaggcaggggcagcaagatggtgttgcagacccaggtcttcatttctctgttgctctggatctctggtgcctccggggacatcgtgatgacccagtctccagactccctggctgtgtctctggcgagagggccaccatcaactgcaagtccagccagagtatttttacagctccaccaataagagctacttagcttggtccagcagaaaccaggacatcctcctctactgctcatttactgggctctacccgggaatccggggtcctgaccgattcagtgcagcggtctgggacagatttcactctcaccatcagcagcctgcaggctgaagatgngcagtttntactgcagcaatattatattcctctcagtacgttcggccaagggacccaaggtggaaattaccgaaacgaactgtaggctagccactacg

SEQ ID NO: 161068 - DNA, 524 bp, Homo sapiens
  misc_feature: GYAE6OF02G229U.22.27.C05.1.454.CMB.1.raw
  modified_base (407)..(407): a, c, t, g, unknown or other
  misc_feature (407)..(407): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatcccggggtccctgaccgattcagtggcagcgggtctgggacagatttcactctcaccatcagcagcctgcaggctgaagntgtggctagtttatactgtcagtctagtataagttactggtcctggacgttcggaccgaacgggacctaagggtggaacgttacgaaacggtactggtcggctgaccactagtctcg

SEQ ID NO: 161069 - DNA, 510 bp, Homo sapiens
  misc_feature: GYAE6OF02GVYBS.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatcccggggtcctgaccgattcagtgcagcgggtctgggacagatttcactctcaccatcagcagcctgcaggctgaagatgtggcagtttatactgtcagcaattattatattcctctcagaccgttcgaccaagggacctaaggtcggaaatcgaaaacgaactggtaggctgacacctacg

SEQ ID NO: 161070 - DNA, 644 bp, Homo sapiens
  misc_feature: GYAE6OF02IHXY6.22.27.C05.1.454.CMB.1.raw
tcagacatacgcgtcacgaccggtgctcgatttagacgcgatcgaagggtttggggggtcgtacaacaggccaggcaggggcagcaagatggtgttgcaggaccccaggtcttcatttcctcgtgttgctctggatctcgtggtcgccgtcccggggacatcgtgatgacccagtctcccagctccctggcctcgtgtctctgggcgtagagggtccaccatcgaaactgaccaagtccacgtccgacggagttatttttacagcctccaccaataagagtttacttagccttggttccagcagaaaccaggacgactcgccctgcactgctctattacgtggctctaccggatccgggtcctgaccgtgtccagtcggctagcgggtcgcggacagatttcactcgtacaccgtatcacgtcacgcctgcacggcctaggaacgagtcggtaggaccttaagttttacttagtttcgttactaaggttactaaattatttaactactttacccgttaccttactaacggtacccgttttcgggacccgtaacggggtaacccgtaaggggtacggtaaaaccgtaccggaaacggtaaaccgttcggaaccgggttaccttgggacctacccgtagtaccccg

SEQ ID NO: 161071 - DNA, 500 bp, Homo sapiens
  misc_feature: GYAE6OF02F7K58.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgcttatttactgggcgtctacccgggaatccggggtccctgaccgattcagtggcagcggtctgggacagatttcactctcaccatcagcagcctgcaggctgaagatgtggctagtttattactgtcagcactataatactgcctcgtacagtttgccagggaccaagctggagatacgaacgactgtggctgctaccg

SEQ ID NO: 161072 - DNA, 650 bp, Homo sapiens
  misc_feature: GYAE6OF02IS5B8.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatacaactgacaacgtccagccagtagttatttttacagcctccaaccaataagagctacttagctttggttccagcaagaaaccaggacatccctcctctactgctctatttacgtgggctccgtaccgggtaacgtccggggtccctgaccgtattcaggtcggcaggcgggtcgtgggacaggtatttccacgttctccgacctatacgagccaacgcccgtgccgagggtcctaaggaaagcgttggtcgggaccttaaggtttttaacttacgtcggttacgaacggtaacctaaatttaagtttaattacctttcccttacctacgtacggttaaccggtttccggacccggaaagggtaacccgtaagggttaacggtaaaactaccgaaaaaccggtacgttcggtacgggtcctagggaccctaccgtacttaccgg

SEQ ID NO: 161073 - DNA, 526 bp, Homo sapiens
  misc_feature: GYAE6OF02GZZGZ.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggcgtctacccgggaatccggggtccctgaccgattcagtggcagcgggtctgggacagatttcactctcaccatcagcagcctgcaggctgaagatgtggctagtttattactgtcagtcaattattatattccctctactagaactttccgggaccaagggaccctaaggtcggaaattaccgaaagaactggtaggctagtaccgacctacg

SEQ ID NO: 161074 - DNA, 495 bp, Homo sapiens
  misc_feature: GYAE6OF02GV2YM.22.27.C05.1.454.CMB.1.raw
tcagacatacgcgtcacgaccggtgctcgatttagacgcgatcgaagggtttggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggcgtctacccgggaatccggggtcctgaccgattcagtggcagcgggtctgggacagatttcactctcaccatcagcagcctgcaggctgaagatgtggctagtttatactgtcagcaatattatattcctctcagacgttcgccaagggaccaaggtgaaatcaacgactgtagctgcactac

SEQ ID NO: 161075 - DNA, 569 bp, Homo sapiens
  misc_feature: GYAE6OF02FPB9Q.22.27.C05.1.454.CMB.1.raw
  modified_base (418)..(418): a, c, t, g, unknown or other
  misc_feature (418)..(418): n is a, c, g, or t
tcagacatacgcgtcacgaccggtgctcgatttagacgcgatcgaagggtttgggggagcggtacaacaggcaggcaggggcagcaagatggtgttgcagacccgaggtcttcatttctctgttgctctggatctctggtgcctccggggacagtccgtgatgaccccagtctccagactcctggctgtgtctctggcgagagggccaccatcaactgcaagtccagccagagtatttttacagtctccaccaataagagctacttagcttcggttccagcaagaaacccaggacatcctcctctactgctcatttactgggcgttctacccgggaatccgggtcctgaccgattcagtggcagcggtctgggacagtacttcactctcgaccatcagcacgctgcaggctagaagtntgtggctagtttatactgtcagtactaaagttattattattcccgtaccgttcgaacgtaccggtttccggaccgtaaacggggtacccgaaaggtacggaaacttaccgaaaaccgtacttacggtacggtcctacggacctacgtaacc

SEQ ID NO: 161076 - DNA, 534 bp, Homo sapiens
  misc_feature: GYAE6OF02IM3ZZ.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggcgtctacccgggaatccggggtcctgaccgatcagtggcagcggtctgggacagatttcactctcaccatcagcagcctgcaggctgaagatgtggctagtttatactgtcagactaatattatattcctcctcagtaccgttcggacctaagggaacctaaagggtacggtaaaataccgaaaacgtaaccgtaggttacggactacgacctacctaacg

SEQ ID NO: 161077 - DNA, 503 bp, Homo sapiens
  misc_feature: GYAE6OF02GSXY0.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatccggggtccctgaccgattcagtggcagcgggtctgggacagatttcactctcaccatcagcagcctgcaggctgaagattgtggctagtttatattgtcagcaatattatattcctctcagacgttcggcaaggaccaagggtagaaatcaaacgactgtggctggctaccatccg

SEQ ID NO: 161078 - DNA, 562 bp, Homo sapiens
  misc_feature: GYAE6OF02JBG98.22.27.C05.1.454.CMB.1.raw
  modified_base (407)..(407): a, c, t, g, unknown or other
  misc_feature (407)..(407): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggtccagcagaaaccaggacatcctcctctactgctctatttactggcgtctacccgggaatcccgggtccctgaccgtatccagtgcagcggtctgggacagatttcgactctcaccatcagcagcctagcagctgaaagtntggtaggctaaggtttatacctggtctaacgctaaagttattaacttatttccctcctacgtagtaccggttccggacccaaggggaccctaaagggttaggaaacttaaccgaaaaccgtaacgttggtacggacctggacctaccgtattacg

SEQ ID NO: 161079 - DNA, 574 bp, Homo sapiens
  misc_feature: GYAE6OF02G50GR.22.27.C05.1.454.CMB.1.raw
  modified_base (429)..(429): a, c, t, g, unknown or other
  misc_feature (429)..(429): n is a, c, g, or t
tcagacatacgcgtcacgaccggtgctcgatttagacgcgatcgaagggtttgggggcgtacaacaggttaggctaggggcagcaagattggtgttgcagacccagggtcttcatttctactgttgctcgtggatctctggtgccgtccggggactatcgtgatgacccagtcctccagacctccctcggctgttcgtctctggggccgagacgggccaccatcaactgcaagtccagccagacgtatttttacagctccaaccaataagagtctacttagcttggtccagcacgaaaccgaggacactccctcctctactcgctcatttacgtgggtctacgtacccgggaactcccgggggtcccctggaccgtattcgaggtcggcaggcgggtctgggacagatttcactctcacatcagcagcngcaggctgaagtgttgtgctagtttattactgtacagactaaatattacttacttacctccgtacgacgtaccgttacggacgaaggtaccgaaggtaacggaaactacgaaacgactagacggacctagacctactactctacg

SEQ ID NO: 161080 - DNA, 520 bp, Homo sapiens
  misc_feature: GYAE6OF02GGJXQ.22.27.C05.1.454.CMB.1.raw
  modified_base (316)..(316): a, c, t, g, unknown or other
  misc_feature (316)..(316): n is a, c, g, or t
  modified_base (375)..(375): a, c, t, g, unknown or other
  misc_feature (375)..(375): n is a, c, g, or t
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (424)..(424): a, c, t, g, unknown or other
  misc_feature (424)..(424): n is a, c, g, or t
tcagacatacgcgtcacgaccggtgctcgatttagacgcgatcgaagggtttaggggggctacaacaggcaggcaggggcagcaacgatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagtctcaccaataagagctacttagcttggttccagcaagaaaccacggaacatcctctactactgctcatttacngggctcgtaccgggatccggggtcctgaccgtatcagtggcaggcggtctgggacagtnttcactctcacatcngcngctgcngntgagatgngctagtttatctgtnagactaatattatacttctctgtagtacgtcgacgtaacggaccgtaaggtacgaaactacgaacgaacgtggtcggtcgtcgacctacgattccg

SEQ ID NO: 161081 - DNA, 520 bp, Homo sapiens
  misc_feature: GYAE6OF02G1GAL.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggcgtctacccgggaatccggggtcctgaccgattcagtggcagcgggtctgggacagatttcactctcaccatcagcagccctgcaggctgaagatgtgcagtttatactgtcagcaattattatattcctcctcagtaccgttcggaccgtaagggacccaagggttaggaaacttcgaaaacgtaactggtaggcctgaccactac

SEQ ID NO: 161082 - DNA, 500 bp, Homo sapiens
  misc_feature: GYAE6OF02IXC5N.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatccggggtccctgaccgattcagtggcagcgggtctgggacagatttcactctcaccatcagcagcctgcaggctgaagatgtgctagtttatactgtcagcaatattatattcctctcagtcgttcgccaagggaccaaggtaggaaatcgaaacgactgtggctcgcacta

SEQ ID NO: 161083 - DNA, 498 bp, Homo sapiens
  misc_feature: GYAE6OF02HX33S.22.27.C05.1.454.CMB.1.raw
  modified_base (410)..(410): a, c, t, g, unknown or other
  misc_feature (410)..(410): n is a, c, g, or t
  modified_base (450)..(450): a, c, t, g, unknown or other
  misc_feature (450)..(450): n is a, c, g, or t
  modified_base (487)..(487): a, c, t, g, unknown or other
  misc_feature (487)..(487): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggctctaccgggaatccggggtccctgaccgattcagtggcagcgggtctgggacagatttcactctcaccatcagcagcctgcaggctgaagatgngctagtttatactgtcagactaatattatattcctctcancgttcgccgtaagggccaaggtgaatacaacgactgngctcgcactag

SEQ ID NO: 161084 - DNA, 506 bp, Homo sapiens
  misc_feature: GYAE6OF02FV3BG.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagcctccagactccctggctgtgtctctgggcgagagggccaccatcaactgcaagtccagccagagtatttttacagctccaccaataagagctacttagcttggttccagcagaaccaggacatcctcctctactgctcatttactgggcgtctactcgggaatccgggtcctgaccgattcagtggcagcggtctgggacagatttcactctcaccatcagcagcctgcaggctgaacgatgtggctagtttatactgtcagctaatattatattcctctcagtacgttcgaccgaaggaccaaggtagaaatacaaacgtaactgtggctagactaaccg

SEQ ID NO: 161085 - DNA, 561 bp, Homo sapiens
  misc_feature: GYAE6OF02IKV04.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctactagtcttggttccagcaagaaaccgaggacactcctcctactactcgctctatttacgtgggtcgtccgtaaccgggacgtccgggtcctgaccgtattcagtcggcgaggcggtcgtgggacagtacttcactctcaccatcagcacgcctgcgaggtcaggaagtagtggtggtacttagtttactacgtgtacagtactaattattattactttacctcctacagtaccgtacgacgtaacgggaaccgtaaggtacgaaactacgaaacgtacgtaggtacggactacgccactacg

SEQ ID NO: 161086 - DNA, 535 bp, Homo sapiens
  misc_feature: GYAE6OF02J1M8D.22.27.C05.1.454.CMB.1.raw
  modified_base (320)..(320): a, c, t, g, unknown or other
  misc_feature (320)..(320): n is a, c, g, or t
tcagacatacgcgtcacgaccggtgctcgatttagacgcgatcgaagggtttgggggaggctacaacaggcaggccaggggcagcaaggatcggtgttgcagacccaggtcttcatttctctgttgctctggatctctggtgcctacggggacattgtgatgacccagtctccagacctccctggctgtgtctcgtgggcgagacgggccaccatcaacgtgcaagtccagccagagtatttttacagtctccaccaataagagttacttaagcttggttccagcagaaccaggacatcgcctgcactgctcagtttacngggcgtctacccgggaatcccggggtcctgaccgtattcagtggcaggcgggtctggggacagtatttcactctcaccatcagcacgctgcaggctagacatgtgctagtttatagtgtacagctaatacttagtacttcctctacgtagacgttcgaccgtaagggtccaaggtggaaactacgaacgtacgtcgtagactacgcctacctacg

SEQ ID NO: 161087 - DNA, 608 bp, Homo sapiens
  misc_feature: GYAE6OF02IUPPT.22.27.C05.1.454.CMB.1.raw
tcagacatacgcgtcacgaccggtgctcgatttagacgcgatcgaagggtttgggggcggtacaacaggcaggcaggggccagcaagatgggtagttcgcagacccaggtcttcatttctctgttgctctggatctctggtgcctccggggacgatacgtggatgaccagtctccagacctccctggctgtgtctctgggcgaggagggccaccgactccaactcgcaaggtccagccaggagtattttacagctccaccaataagaggctacttagcttaggttccagcagtaaaccaggacactcctctcttactgctcatttacgcggcgtcgtaccggaactccggggtcctcggaccgagttcgacgtaggctacggcgggtcgtgggacagtacttcacgtctaccactatcagcacgcctgccaggctaggaagtagtgtggtctaacgtttatactggtacaagtactaaatatttactcgttcctctacgtacgtaccgtttacggtacccggtaaacgggaaccgtaagggtacggtaaacgtacgtaaaaccggtaacgttacggtacggactacggaccgtaacctagttacccgg

SEQ ID NO: 161088 - DNA, 508 bp, Homo sapiens
  misc_feature: GYAE6OF02I68KW.22.27.C05.1.454.CMB.1.raw
  modified_base (404)..(404): a, c, t, g, unknown or other
  misc_feature (404)..(404): n is a, c, g, or t
  modified_base (445)..(445): a, c, t, g, unknown or other
  misc_feature (445)..(445): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctaccgggaatccgggtcctgaccgattcagtggcaggcggtctgggacagatttcactctcaccatcagcagcctgcaggctgagntgtgctagtttatactgtcagcaatattatacttcctcctnagtacgttcggaccaagggcctaaaggtggaaactcgaaacgacttggtcgctgaccactacg

SEQ ID NO: 161089 - DNA, 505 bp, Homo sapiens
  misc_feature: GYAE6OF02I6KUN.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcggtctgggacagatttcactctcaccatcagcagcctgcaggctgaagatgtggctagtttatactgtcagcaatattatattcctctcagtacgttcgcctaagggaccaaggtagaaatacaaacgtactggtagctgcacctac

SEQ ID NO: 161090 - DNA, 586 bp, Homo sapiens
  misc_feature: GYAE6OF02JQQ0S.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctctctactgctcatttactggctctaccggaatccgggtcctgaccgattcaggtcgcagcgggtctcgggactaggtatttcgactctcacctatcagcagcctgcaggctgaagtgtgtaggctagtttatacgttgtacagtacaaagttacttaacgttaacttcccgtaccttacgtaacggtaaccgtttccggaacccgtaaacggggtaccctaaagggttcggtaaaacttaccgaaaacggtaacgttacggtacgggtaccttacggaccgtaacccttaacgg

SEQ ID NO: 161091 - DNA, 614 bp, Homo sapiens
  misc_feature: GYAE6OF02HCM3N.22.27.C05.1.454.CMB.1.raw
  modified_base (533)..(533): a, c, t, g, unknown or other
  misc_feature (533)..(533): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatgacccagtctccagacctccctggctgtgtctcgtgggcgaggacgggccaccatcaactgacaagtccagccagagttatttttacagcctccaccaaataagagactacttagcttggttccagcaagaaaccaggacactcctcctctactgctctatttacgtgggtccgtccgtaacccgggaacgtcccggggtccctaggaacccgtagttccgagtcggacacggtcggggtctacggggactagtactttccgacgttctaccaacccataccgaagccacgtccctagccgaggcctaggaaagtgttggtcggtactaagttttactacgttgtacagactaaattattaattcttcctacctntacgtacgttccgacgtaacgggaacctaagggtagtaaactaccgaaacgtacttaggtcgtacctacgacctacctacg

SEQ ID NO: 161092 - DNA, 533 bp, Homo sapiens
  misc_feature: GYAE6OF02J0KTD.22.27.C05.1.454.CMB.1.raw
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggtttcagcagaaaccaggacatcctcctctactgctcatttactggcgtctaccgggaatccgggtcctgaccgattcgagtggcaggcgggtcgtgggacagtactttcactctcaccatcagcagcctgcaggctgaagntgnggctagtttatctagtnagtctaattattacttacttcctctacagtaccgttacggacgtaacgggacctaaggtacgaaacttacgaaacgacttagggcgtcgtacgacctacgtacg

SEQ ID NO: 161093 - DNA, 512 bp, Homo sapiens
  misc_feature: GYAE6OF02I6JZG.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggtccagcagaaaccaggacatcctcctctactgctcatttactgggctctacccgggaatccgggtccctgaccgattcagtcggcagcggtctgggacagattcactcgtcaccatcagcagcctgcaggctgaagatgtggcaagtttatactgtcagtcaatattatattcctcgtcagtacgttcggaccaaagggccctaaaggtgaaaactcaaaacgactggtaggctagccacgtaa

SEQ ID NO: 161094 - DNA, 493 bp, Homo sapiens
  misc_feature: GYAE6OF02G28FK.22.27.C05.1.454.CMB.1.raw
  modified_base (401)..(401): a, c, t, g, unknown or other
  misc_feature (401)..(401): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttcagcagaaccaggacatcctctctactgctcatttactggcgtctaccggaatcccggggtcctgaccgattcagtggcagcggtctgggacagattcactctcacatcagcagcctgcaggctgagatgngcagttatactgtcagcaatattatattcctctcagcgttcgcgtaaggaccaaggtgaaatcaaacgtactggtacgacgtacgcactacg

SEQ ID NO: 161095 - DNA, 542 bp, Homo sapiens
  misc_feature: GYAE6OF02IX4IJ.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctacctctaactgctcatttactggcgtctaccgggaatccgggtcctgaccgtattcagtgcagcgggtctgggacaggtacttcactctcacctatcgagcagcctgcaggctagaagatgtggctagtttatacttgcaagcaattacttaattaacttccctactcagtaccgttcggaccgtaagggacctaaagggtacggaaaattaccgaaaacgtaactggtacggactacgacacctaacg

SEQ ID NO: 161096 - DNA, 511 bp, Homo sapiens
  misc_feature: GYAE6OF02FV8MW.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatggtgctagttttatactgtcagcaattattattacttcctctcagtaccgttcgacctaagggccaaggttggaaatcgaaacgactggtgctgacactacg

SEQ ID NO: 161097 - DNA, 563 bp, Homo sapiens
  misc_feature: GYAE6OF02F9HCE.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggcgtctacccgggaatccggggtcctgaccgattcagtggcagcgggtctgggacagactttcactctcaccatcagcacgcctgacctaggcctgaacgatggtcggtactaggttttattacctggtaccagtactaaattagtttaattaactttccctcctaacctagtaccgtttcggaccgaaacgggtaccgaagggttacgaaactacgaaaacgtacgtggtacggactacgacctactacg

SEQ ID NO: 161098 - DNA, 537 bp, Homo sapiens
  misc_feature: GYAE6OF02IP8Z5.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggcgtctacccgggaatcccggggtcctgaccgattcagtggcagcgggtctgggacagatttcactctcaccatcagcagcctgcaggctgaagatggtgctagtttattactgtcagactaattattatattccctctacagtacgttcggaccaagggaccctaaaggtacggaaactaccgaaaacgtaacttcggtacggccttaggacctaccgtattaccg

SEQ ID NO: 161099 - DNA, 526 bp, Homo sapiens
  misc_feature: GYAE6OF02HY5CS.22.27.C05.1.454.CMB.1.raw
  modified_base (407)..(407): a, c, t, g, unknown or other
  misc_feature (407)..(407): n is a, c, g, or t
  modified_base (451)..(451): a, c, t, g, unknown or other
  misc_feature (451)..(451): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtcctgaccgattcagtggcagcgggtctgggacagatttcactctcaccatcagcagcctgcaggctgaagntgtggctagtttatactgtcagctaattattatatttcctcctntagaccgtttcggacctaaggggaccaagggttcggaaaatcgaaaacgacgttaggtcggactagccacctacg

SEQ ID NO: 161100 - DNA, 519 bp, Homo sapiens
  misc_feature: GYAE6OF02HU827.22.27.C05.1.454.CMB.1.raw
  modified_base (346)..(346): a, c, t, g, unknown or other
  misc_feature (346)..(346): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtccctgaccgnttcagtggcagcggtctgggacagatttcactctcacatcagcagcctgcaggctgaagatgtggctagttttatattgtcagctaatattatattcctctactagaccgttcggacctaagggacctaaggtacgaaattacgaaaacgacttgaggtctacgacaccgtac

SEQ ID NO: 161101 - DNA, 587 bp, Homo sapiens
  misc_feature: GYAE6OF02IINX4.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacactcctctctactcgtctactactttacgtcgggtcgtacgtacccgggtaacgtcccgggtcctcgaccgtactacgtagtcggacgacggtcgggtcgtacgggacagtacttcactctcaccatccagcacgccctgaccgaggcctaggaagtagtggtggcttaagttttactcgtgtcagtctaaatttatttataccttccttctacgtaacggtaccggttcgaccgtaacgggacctaaaggtacgtaaactacgaaacgtacgttcggtacgtaccgcgtaccaccttag

SEQ ID NO: 161102 - DNA, 690 bp, Homo sapiens
  misc_feature: GYAE6OF02GB4O1.22.27.C05.1.454.CMB.1.raw
  modified_base (336)..(336): a, c, t, g, unknown or other
  misc_feature (336)..(336): n is a, c, g, or t
  modified_base (655)..(655): a, c, t, g, unknown or other
  misc_feature (655)..(655): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgaggacgggccaccatacaactgcaacgtccacgccagagtttatttttacagcctaccaacctaaataagtagtttacttaagtctttcggttccagcaagaaaccgaggactatcgtcctgaccactgctctatttacgngggcgtccgtacccgggacgtcccggggtcctggaccgtattcaggtcggcgacggtcgggtcgtacgggactagtactttaccgaccttctaccacctaatacgacgtcacgtccctgaccgaagggtcctaaggaaacgtagttcggtcgggtaccttaaggttttttaactttagttacggtacaacggttacctaaaaagttttaacttttaacgttaaccttttcccctaccgttacgtaacggtacccgttttaccgggaccgaaacggggttaacccaaaggggttacgtaaaacctacgaaaaaccggttnttcgggtaccgtacgtacggtaaccacccgttaag

SEQ ID NO: 161103 - DNA, 518 bp, Homo sapiens
  misc_feature: GYAE6OF02GUESY.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagtatttcactctcaccatcagcagcctgcaggctagaagatgtggctagtttattactgtcagcagcgtagccaaccttccctcaccgttcggcggagggaccagggtcggaagataccgaaacgtacgtggtcggctggctaccatccg

SEQ ID NO: 161104 - DNA, 497 bp, Homo sapiens
  misc_feature: GYAE6OF02F6QCZ.22.27.C05.1.454.CMB.1.raw
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcggtctgggacagatttcactctcaccatcagcagcctgcaggctgaagntgngcagtttatactgtcagcaatattatattcctctcagtacgttcgccgaaggaccaaggtagaaatcaaacgatgtggctgcaccatcg

SEQ ID NO: 161105 - DNA, 512 bp, Homo sapiens
  misc_feature: GYAE6OF02JB25Y.22.27.C05.1.454.CMB.1.raw
  modified_base (378)..(378): a, c, t, g, unknown or other
  misc_feature (378)..(378): n is a, c, g, or t
  modified_base (419)..(419): a, c, t, g, unknown or other
  misc_feature (419)..(419): n is a, c, g, or t
tcagacatacgcgtcacgaccggtgctcgatttagacgcgatcgaagggtttggggagctacaacaggcaggcaggggcagcaagatggtgttgcagacccaggtcttcatttctctgttgctctggatctctggtgcctccgggacatcgtgatgacccagtctccagactccctggctgtgtctctgggcgagagggccaccatcaactgcaagtccagccagagtatttttacagctccaccaataagagctacttagcttggttccagcagaaaccaggacatcctctctactgctcatttactgggctctacccggaatccggggtcctgaccgattcagtggcagcgggtctgggacagtatttcacgttcnctaccatcagcagcctgcaggctgaagatgtggctagtttntactgtcagctaagtattatattcctctcagtacgttcgaccaagggccctaagggtggaaactcaaacgacgtgtggactacgtacactacg

SEQ ID NO: 161106 - DNA, 528 bp, Homo sapiens
  misc_feature: GYAE6OF02GAEP4.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctctctactgctcatttactgggctctaccgggaatccggggtccctgaccgattcagtggcagcgggtctgggacagatttcactctcaccatcagcagcctgcaggctgaagatgtggctagtttattactgtcagtctaaatatttatactttcctctcagtacgttcgaccgaagggaccgaaggtacgaaaattcgaaaaccgtacgtggtacggcctacgaccaccgtacg

SEQ ID NO: 161107 - DNA, 505 bp, Homo sapiens
  misc_feature: GYAE6OF02G86UV.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtcctgaccgattcagtggcagcgggtctgggacagtattcactctcaccatcagcagcctgcaggctgaagatgtgctagtttatactgtcagcaatattatacttcctcctcagtaccgttcggaccaagggaccaaggtggaaatcgaaacgactgtggctagcacta

SEQ ID NO: 161108 - DNA, 523 bp, Homo sapiens
  misc_feature: GYAE6OF02GXPUC.22.27.C05.1.454.CMB.1.raw
  modified_base (312)..(312): a, c, t, g, unknown or other
  misc_feature (312)..(312): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacggctccaccaataagagctacttagcttggttccagcagaaaccaggacatcctcctctactgctcatttacngggcgtctacccgggaatcccggggtccctgaccgattcagtggcaggcgggtctgggacagtatttcactctcaccatcagcagcctgcaggctagaagatgtggctagtttattactgtcagcaatattatacttcctctacagtacgttcggaccaagggaccgtaaggtagaaactacgaaacgtacgtaggtggctgacaccatcg

SEQ ID NO: 161109 - DNA, 509 bp, Homo sapiens
  misc_feature: GYAE6OF02HDDVR.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatccggggtccctgaccgattcagtgcagcgggtctgggacagatttcactctcaccatcagcagcctgcaggctgaagatgtgcagtttatattgtcagtcaatattatattcctctcagtacgttcggacctaagggacctaaggtaggaaatcaaacgactggtaggcctagccaccatccg

SEQ ID NO: 161110 - DNA, 691 bp, Homo sapiens
  misc_feature: GYAE6OF02GE3FR.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatcctcgtggtcgccgtccgggacatcgtgatcgacccagtcctccagacctccgtggctgtgtctcgtgggcgaggacggcccaccatacaacgtgacaacgtccacgaccgaagtaagttttactttttaacacgtcctacccaacctaaataagacgtaccttaacttagtcgtttcggttaccacgactaaacgaaaccgaaggactacttcccctccttacctacgtcgtcctactaacttttaccggtgggtaccgttacccggtaacccgggtaaccggttccccggggttaccctacggaacccgttacttcgtacggtcggacgacgggtcgggtcgtaggggactaggtactttcgacctcgtaccactactcgagtcacgtcctcgacgacggactaggaagttgtggtacggacttaagtttactacgtgtacgagtactaaagttattaacttacctttaccctactacgtacgtacgttccgaacggtaacgggaaccgtaaggtacgtaaactacgaaacgtacgttggacgactacgtaccactacg

SEQ ID NO: 161111 - DNA, 528 bp, Homo sapiens
  misc_feature: GYAE6OF02GU38W.22.27.C05.1.454.CMB.1.raw
  modified_base (412)..(412): a, c, t, g, unknown or other
  misc_feature (412)..(412): n is a, c, g, or t
  modified_base (455)..(455): a, c, t, g, unknown or other
  misc_feature (455)..(455): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctctatttactgggcgtctacccgggaatccgggtcctgaccgattcagtggcagcgggtctgggacagtattcactctcaccatcagcagcctgcaggctagaagatggngctagtttattattgtcagactaattattatactttcctcctnagtcgttcggacctaaggggacctaagggtaggaaactaccgaaagtacttggtacgtactggacctactacg

SEQ ID NO: 161112 - DNA, 518 bp, Homo sapiens
  misc_feature: GYAE6OF02JE042.22.27.C05.1.454.CMB.1.raw
  modified_base (452)..(452): a, c, t, g, unknown or other
  misc_feature (452)..(452): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtcctgaccgatcagtggcagcgggtctgggacagattcactctcaccatcagcacgcctgcaggctagaagtatgtggctagtttatactgtcagctaatattatacttcctcctanagtacgttcggaccaacgggtacaaggtaggaaatacgaaacgtacgtggtacgctcgacacgtac

SEQ ID NO: 161113 - DNA, 506 bp, Homo sapiens
  misc_feature: GYAE6OF02FP70E.22.27.C05.1.454.CMB.1.raw
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (502)..(502): a, c, t, g, unknown or other
  misc_feature (502)..(502): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcggtctgggacagatttcactctcaccatcagcagcctgcaggctgaagntgnggcagtttatactgtcagcaatattatattcctcctcagtacgttcggaccaagggaccaagggtgaaactcgaaacgacgtgtggctgcaccntacg

SEQ ID NO: 161114 - DNA, 540 bp, Homo sapiens
  misc_feature: GYAE6OF02IYL6N.22.27.C05.1.454.CMB.1.raw
  modified_base (392)..(392): a, c, t, g, unknown or other
  misc_feature (392)..(392): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggcgtctaccgggaatccggggtcctgaccgatcagtggcagcggtctgggacagatttcactctcaccatcagcactccngcaggctagaagatgtggctagtttatactgtcagactaatattatactttcctcctacagtaccgttcggaccgtaaagggccctaaagggtggaaaactaccgaaaacggtaacttacggtacggtacgtcggtaccaccgtaacg

SEQ ID NO: 161115 - DNA, 524 bp, Homo sapiens
  misc_feature: GYAE6OF02F52OH.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatccctcctctactgctcactttactgggcgtctaccccgggaatcccggggtcctgaccgattcagtggcaggcgggtctgggacagtatttcactctcaccatcagcagcctgcaggctgaagatgtgctagtttattacgtgtccagctaattattattattcctctcagtaccgttcggaccgaagggtaccaaggtaggaaactcgaaacgactggtagcgtcgccacgtac

SEQ ID NO: 161116 - DNA, 508 bp, Homo sapiens
  misc_feature: GYAE6OF02GZ1TR.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgagatgtgcagtttatactgtcagcaatattatattcctcctcaagacgttcgacaagggaccaaagggtcgaaactcaaacgtatggtaggctagacaccattccg

SEQ ID NO: 161117 - DNA, 570 bp, Homo sapiens
  misc_feature: GYAE6OF02IFK6B.22.27.C05.1.454.CMB.1.raw
  modified_base (382)..(382): a, c, t, g, unknown or other
  misc_feature (382)..(382): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctggcgagagggccaccatcaactgcaagtccagccagagtatttttacagctccaccaataagagctacttagcttggttccagcagaaaccaggacatcctcctctactgctcatttactggcgtctacccgggaatccggggtcctgaccgattcagtggcagcggtctgggacagatttcactctcaccntcagcacgcctgcaggctgaagntgnggcagtttatacgtgtaccagtacctaattattatactttccctccttacgacgttaccggttaccggaccgaaacggggtaccctaaaggggttacggaaaacttaccgtaaaaaccggtaacgttacggttagggtacccgtaggtaccctaaccgtaac

SEQ ID NO: 161118 - DNA, 528 bp, Homo sapiens
  misc_feature: GYAE6OF02GA22X.22.27.C05.1.454.CMB.1.raw
  modified_base (404)..(404): a, c, t, g, unknown or other
  misc_feature (404)..(404): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcattactggcgtctaccgggaatccggggtccctgaccgattcagtggcagcggtcgtgggacagatttcactctcaccatcagcagcctgcaggctagaagntgtgctagtttatactgtcagtacaattattatacttcctctcagtacgttcggaccgtaacgggacctaagggtaggaaactacgaaacgtaacgtcggtacggactaggacctacctgtccg

SEQ ID NO: 161119 - DNA, 553 bp, Homo sapiens
  misc_feature: GYAE6OF02G5VOX.22.27.C05.1.454.CMB.1.raw
  modified_base (430)..(430): a, c, t, g, unknown or other
  misc_feature (430)..(430): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggtatccggggtccctgaccgattcagtggcagcgggtctgggacagtattcactctcaccgatcagcagcctgcaggctagaagatgtggctagtttattacgtntcagtacaaagttattaatacgttccctcctacgagtaccgttccggaccgtaagggaccctaaaggttaggaaaaccgtaccaaaacggtactaggtacggacctacgtaccacccttaacg

SEQ ID NO: 161120 - DNA, 521 bp, Homo sapiens
  misc_feature: GYAE6OF02HMK3B.22.27.C05.1.454.CMB.1.raw
tcagacatacgcgtcacgaccggtgctcgatttagacgcgatcgaagggtttggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtcctgaccgattcagtggcagcgggtctgggacagatttcactctcaccatcagcagcctgcaggctgaagatgtggctagtttattactgtcagctaatattaattacttcctcctcagtaccgttcggacctaacgggaccaagggtaggaaatacgaaacgtactagtggactgaccacctaac

SEQ ID NO: 161121 - DNA, 641 bp, Homo sapiens
  misc_feature: GYAE6OF02HZCAM.22.27.C05.1.454.CMB.1.raw
  modified_base (305)..(305): a, c, t, g, unknown or other
  misc_feature (305)..(305): n is a, c, g, or t
  modified_base (463)..(463): a, c, t, g, unknown or other
  misc_feature (463)..(463): n is a, c, g, or t
tcagacatacgcgtcacgaccggtgctcgatttagacgcgatcgaagggtttgggggagctacaacaggcaggcaggggcagcaagatggtgttgcagacccaggtcttacatttctctgttgctctggatctctggtgcctccggggacatcgtgatgacccagtctccagactccctggctgtgtctcgtgggcgaggagggcccaccgatcaactgcaacgtccagccagagttatttttaccagcctccaccaagtaacgacgctacttagcgttcggttccagcagaaaccagacatccncctctactgtcctctactttacgtcggtccgttaccgtacccgggatcccggggtccctcggaccgtagttccgaggtcggcgaggtccggggtctaggggactaggtactttcgactccgtacaccatccacgcacgtcgtcgacaggctagaaagngtaggtcgtacttagtttacttacgttgtactagtaactaaattaactttaattaccttccctccttacgacggttaccgttaccgggaccgtaacgggaacgtaacgggtaacggtaaaccgttaaccgaaacggtaacgttcgggtaacggaccgttaccggtacctaccgtaacg

SEQ ID NO: 161122 - DNA, 537 bp, Homo sapiens
  misc_feature: GYAE6OF02GA5KV.22.27.C05.1.454.CMB.1.raw
  modified_base (420)..(420): a, c, t, g, unknown or other
  misc_feature (420)..(420): n is a, c, g, or t
  modified_base (429)..(429): a, c, t, g, unknown or other
  misc_feature (429)..(429): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctaccgggaatccgggtccctgaccgattcagtggcagcgggtctgggacagatttcactctcaccatcagcagcctgcaggctgaagatgtgctagtttatnttgtcagtntaattattattacttcctctactacgtacgttcggacctaagggaaccctaaggtacggaaacttaccgaaaacgtaacgtaggtacggactacggacctaccgtacg

SEQ ID NO: 161123 - DNA, 558 bp, Homo sapiens
  misc_feature: GYAE6OF02IDB04.22.27.C05.1.454.CMB.1.raw
  modified_base (463)..(463): a, c, t, g, unknown or other
  misc_feature (463)..(463): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatcccggggtcctgaccgtattcagtcggcagcgggtctgggacagtactttcactctcaccatcagcagccctgcacggctaggaagagtggtgtactagtttatactgtcagtactaatagtttatacttcctcctnagtaccgttcggacccgtaaggggtaccctaaaggggtacgaaaataccgtaaaacgtaacgttggtacggtacgtacggacctacctattaccg

SEQ ID NO: 161124 - DNA, 511 bp, Homo sapiens
  misc_feature: GYAE6OF02GD1IL.22.27.C05.1.454.CMB.1.raw
  modified_base (407)..(407): a, c, t, g, unknown or other
  misc_feature (407)..(407): n is a, c, g, or t
  modified_base (450)..(450): a, c, t, g, unknown or other
  misc_feature (450)..(450): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggcgtctacccgggaatccggggtccctgaccgattcagtgcagcggtctgggacaggatttcactctcaccatcagcagcctgcaggctgaagtngtgctagtttattcgtgtcagctaataattatacttcctcctnagtcgttacgccgaaggaccaaggtacggaaatacgaaacgactggtagctgaccactacg

SEQ ID NO: 161125 - DNA, 499 bp, Homo sapiens
  misc_feature: GYAE6OF02GZ75I.22.27.C05.1.454.CMB.1.raw
  modified_base (448)..(448): a, c, t, g, unknown or other
  misc_feature (448)..(448): n is a, c, g, or t
  modified_base (497)..(497): a, c, t, g, unknown or other
  misc_feature (497)..(497): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatcccggggtcctgaccgattcagtggcagcggtctgggacagatttcactctcacatcagcagccctacaggctagagatgtggctagtttattactgtcagcaatattatacttcctctnagtcgttcgccaagggaccaaggtgaaatcgaaacgagtgtgctgcacntc

SEQ ID NO: 161126 - DNA, 541 bp, Homo sapiens
  misc_feature: GYAE6OF02GR0DU.22.27.C05.1.454.CMB.1.raw
  modified_base (427)..(427): a, c, t, g, unknown or other
  misc_feature (427)..(427): n is a, c, g, or t
  modified_base (444)..(444): a, c, t, g, unknown or other
  misc_feature (444)..(444): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcaagaaaccaggacatccctcctctactgctctatttacgtggcgtccgtacccgggaactcccgggggtccctcgaccgtattcacggtggcaggcgggtcgtgggacagtactttcactctcaccatcacgtcacgcctgcgaggctgaagntcggtgtcttaagtttntactgtcaagtcaatttattatacttcctctcagtcgttcgacgagggtacctaaggtactaagacaaacgagttcgtacggctgacctacattccg

SEQ ID NO: 161127 - DNA, 587 bp, Homo sapiens
  misc_feature: GYAE6OF02IKQY5.22.27.C05.1.454.CMB.1.raw
  modified_base (255)..(255): a, c, t, g, unknown or other
  misc_feature (255)..(255): n is a, c, g, or t
  modified_base (447)..(447): a, c, t, g, unknown or other
  misc_feature (447)..(447): n is a, c, g, or t
  modified_base (471)..(471): a, c, t, g, unknown or other
  misc_feature (471)..(471): n is a, c, g, or t
tcagacatacgcgtcacgaccggtgctcgatttagacgcgatcgaagggtttggggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataaganctacttagcttgtccagcagaaaccaggacatcctcctctacgtgctctatttacgtgggccgtaccgtacccgggtaacgtcccgggggtaccctcgaccgtacttccgaggttggaccgaggtcgggttcgtgggacaaggtatttcgactcctcacctatccaacgccagcctgacgaggctagaagtnttggtgactagttttactactgtnagtactaatttataattacttccctcgtactacggtacgttacggacctaagggacctaagggtaacgaactaaccgaacgtaacgttcggacggtctacggacctaccgattccg

SEQ ID NO: 161128 - DNA, 531 bp, Homo sapiens
  misc_feature: GYAE6OF02GWXK2.22.27.C05.1.454.CMB.1.raw
  modified_base (281)..(281): a, c, t, g, unknown or other
  misc_feature (281)..(281): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccnggacatcctcctctactgctcatttactggcgtctaccgggaatccgggtccctgaccgattcagtgcagcggtctgggacagattcactctcaccatcagcagcctgcagctgaagactgtggctagtttatactgtcagtcaagtattatacttcctctacagtaccgtttcggacctaacgggtaccgaaggttacggaaaatccgaaaacgtacttaggtcgggaccttggaccctaccgattccg

SEQ ID NO: 161129 - DNA, 719 bp, Homo sapiens
  misc_feature: GYAE6OF02FGK4X.22.27.C05.1.454.CMB.1.raw
tcagacatacgcgtcacgaccggtgctcgatttagacgcgatcgaagggtttgggggggagcgtacaaccaggcagcagggcagctaagatggtgttgcagacccaggtcttacatttctctgttgcctctgggattcgtctggtgccttccgggggtaccattcgtgtattagacccgagtcctccagacctcccgtggcctagtggtcgtcgtgggcggaggagggccaccgactcaacctggcgaacgtccaggccagtacgtattttttacacgctccacctaagtaagagactaacttagccttttcggtttccacgtacaagaacccaggtaccgactccctacctctacctgcctacgtactttacgtggggtcggttccgtacccgggtaattcccggggtcccgttggacccgtattcgtaggtaggtcgaggcgggtacgtagggtaacgtaggtactttccgtaccgtcgtacgaccctaatccaacggctaccgtccctaggacctacgggactaggaacgatacggtagactagtttaacttacttagtacgacggtaccttaacgttaagttaacgttacgtccccgttacgtacctacgggtaaccgtttccgggaaccgtaacgggtaacccgtaagggttacggaaaacgttcgtaaaaccggtaccgttggtacgggacccgtaggaccctaccgttaccg

SEQ ID NO: 161130 - DNA, 559 bp, Homo sapiens
  misc_feature: GYAE6OF02GEG85.22.27.C05.1.454.CMB.1.raw
  modified_base (362)..(362): a, c, t, g, unknown or other
  misc_feature (362)..(362): n is a, c, g, or t
  modified_base (388)..(388): a, c, t, g, unknown or other
  misc_feature (388)..(388): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatccggggtccctgaccgattcagtggcagcgggtntgggacagattcactctcaccatcancagcctgcaggctagaagtatgtggctagtttacttactgtcagactaaattattaattacttccctaccttcgaacgttaccggttacgaccgtaaacgggtaaccgaaagggttaacggaaacttaccgaaaacggtaactacggtaggtacctaggaccaccgtaacg

SEQ ID NO: 161131 - DNA, 635 bp, Homo sapiens
  misc_feature: GYAE6OF02HOHDS.22.27.C05.1.454.CMB.1.raw
  modified_base (456)..(456): a, c, t, g, unknown or other
  misc_feature (456)..(456): n is a, c, g, or t
tcagacatacgcgtcacgaccggtgctcgatttagacgcgatcgaagggtttgggggctacaacaggacaggccaggggcagcaagatggtgttgcagaccccaggtcttcatttctctgttgctctggtatctctggtgcctccggggacatcgtgatgacccagtctccagactccctggctgtgtctcgtgggcgagagggccaccatcaactgacaagtccagccagagttatttttacagtctccaccaataagacgtcttacttagcttggttccagtcagaaaccaggacatcctcctctactgctctatttacgtggcgtcgtacccggaatcccggggtacctcgaccgtacttcgagtggcaggtcgggtcgtagggactagtatttcactcgtcaccatcaagtccagtcctgcacggctagaagtatggtgactagtttatacngtcatactaaatcgttaactacgtttccctccgtacgtaacgtaccggttacgacccgttaaacgggtaaccgtaaagggttacggtaaaacgttacccgaaaaaacccgggttaacgttaccgggttaaccgggtaacccgttacgggtaaccccttacccggtaagtttaacccggg

SEQ ID NO: 161132 - DNA, 529 bp, Homo sapiens
  misc_feature: GYAE6OF02HXA6O.22.27.C05.1.454.CMB.1.raw
  modified_base (356)..(356): a, c, t, g, unknown or other
  misc_feature (356)..(356): n is a, c, g, or t
  modified_base (395)..(395): a, c, t, g, unknown or other
  misc_feature (395)..(395): n is a, c, g, or t
  modified_base (410)..(410): a, c, t, g, unknown or other
  misc_feature (410)..(410): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagtagtatttttacagctccaccaataagagctaacttagcttggttccagcagaaaccaggacatcctcctctactgctcatttacgtgggctcgtacccgggatccggggtccctgccgtattcagtggcngcgggtctggggacagatttcacttctcaccatcagcancctgcaggctgaagngtgtgctagtttattctgtcagctaattattatacttcctactcagtacgttccggacgtaagggaccgaaggtacgaaacgtacgaaacgtacgtgtacggtactcgaccaccattcg

SEQ ID NO: 161133 - DNA, 703 bp, Homo sapiens
  misc_feature: GYAE6OF02G9SPI.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactcccgtggctgtgtctctgggcgagagggccaccatcaactgcaagtccagccagagttactttttacagtctccaccaataagagctacttagcttggttccagtcaagaaaccaggaacatccctcctctactgcctctactttacgtgggtcgtacgtacccgggtaacgtcccgggggtaccctcggaccgtacttcgacggtcggcgaggcgggtcgtgggactaggtagtttccaacgttctactaccgtattcacgacctacgtccctaggaccgaggtccgttaggaaagtacgttaggtcgggtacttaaggttttaactttaccgtcggttactaacggtaacctaaagtttaactttaactttaaccttttcccgttaccgttaccgtaacggttaccgggtttacccgggaccgtaaaacggggtaacccgtaaaggggttaacggaaaaacttaacccgtaaaaacggtaaccgttcgggttacgggtaccttaccggaccgtaaccctagttacccgg

SEQ ID NO: 161134 - DNA, 512 bp, Homo sapiens
  misc_feature: GYAE6OF02F2EXD.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcggtctgggacagatttcactctcaccatcagcagcctgcaggctgaagatgtgctagtttattactgtcagcaatattatattcctctcagtacgttcggcaagggaccaagggtggaaatacgaaacgactggtacggcttagcctaccattacg

SEQ ID NO: 161135 - DNA, 523 bp, Homo sapiens
  misc_feature: GYAE6OF02I59N3.22.27.C05.1.454.CMB.1.raw
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
  modified_base (454)..(454): a, c, t, g, unknown or other
  misc_feature (454)..(454): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccggaatccggggtccctgaccgattcagtggcagtgggtctgggacagatttcactctcaccatcagcagcctgcaggctgaagntgtggntagtttatagttgtcagctaattattatactttcctcctanacgtacgttcggacaagggtaccaagggtagaaactccgaaaacgactggtacggctacggacactacg

SEQ ID NO: 161136 - DNA, 512 bp, Homo sapiens
  misc_feature: GYAE6OF02F6COX.22.27.C05.1.454.CMB.1.raw
  modified_base (450)..(450): a, c, t, g, unknown or other
  misc_feature (450)..(450): n is a, c, g, or t
  modified_base (502)..(502): a, c, t, g, unknown or other
  misc_feature (502)..(502): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatcccggggtccctgaccgattcagtggcagcggtctgggacagatttcactctcaccatcagcagcctgcaggctgaagatgtgctagtttatactgtcagcaattattatattcctacctnacgtacgttcgaccaagggcccaaaggtggaaattcgaaacgactggtgacnggacactacg

SEQ ID NO: 161137 - DNA, 564 bp, Homo sapiens
  misc_feature: GYAE6OF02GCNAZ.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgctcatttactggctcgtacccggaagtcccgggtcctgaccgtatcgagtggcaggcgggtcgtgggacagatttcactctcaccatcagcagccctgcgaggctagagtatgtcggctagttttatacgtgtacagtctaaattagttaacttctttccctccttacgtacgttaccgttcggaccgaaacgggtaaccgaagggttaacggaaacttaaccgaaacgtaacgtcggttacggacctgaccaaccgttacg

SEQ ID NO: 161138 - DNA, 522 bp, Homo sapiens
  misc_feature: GYAE6OF02H9TPO.22.27.C05.1.454.CMB.1.raw
  modified_base (424)..(424): a, c, t, g, unknown or other
  misc_feature (424)..(424): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccacaataagagctacttagcttggttccagcagaaaccaggacatcctcctctactgctcatttactgggctctacccgggaatcccggggtccctgaccgattcagtcggcagcgggtctgggcagtagtttcactctcaccatcagcagcctgcaggctagaagactgtgactagttttanactgtcaagctaaatattatactttcctcctcagtacgttcgctaaggaccaaaggtggaaatccgaaaacacgtagcggactagaccacgattaccg

SEQ ID NO: 161139 - DNA, 556 bp, Homo sapiens
  misc_feature: GYAE6OF02H1YWN.22.27.C05.1.454.CMB.1.raw
  modified_base (255)..(255): a, c, t, g, unknown or other
  misc_feature (255)..(255): n is a, c, g, or t
  modified_base (415)..(415): a, c, t, g, unknown or other
  misc_feature (415)..(415): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagngctacttagcttggttccagcagaaaccaggacatcctcctctactgctcatttactgggcgtcgtacccgggaagtcccggggtccctgaccgtattcagtggcaggcgggtctgggacagatttcactctcaccatcagcagcctgcaggctagaagntgtgatagtttatacgtgtactagactaattattaattactttcctacctcgacgtaccgtttaccggaccgtaagggaaccgtaaagggtacggtaaactaccgaaacgtacgtaggtacggtacttacggaccactacg

SEQ ID NO: 161140 - DNA, 525 bp, Homo sapiens
  misc_feature: GYAE6OF02IM5YU.22.27.C05.1.454.CMB.1.raw
  modified_base (409)..(409): a, c, t, g, unknown or other
  misc_feature (409)..(409): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaccaggacatcctcctctactgctcatttactggcgtctacccgggaatcccggggtcctgaccgattcagtggcagcgggtctggacagattcactctcaccatcagcagcctgccgaggctagaagtntgtggacttagtttatacttgtacagtcaaagttattattacttcctactcagtaccgtcgaccgaggaaccaaggtacgaaatacgaaacgtacttggtcgactcgactactacg

SEQ ID NO: 161141 - DNA, 602 bp, Homo sapiens
  misc_feature: GYAE6OF02JPB8E.22.27.C05.1.454.CMB.1.raw
  modified_base (298)..(298): a, c, t, g, unknown or other
  misc_feature (298)..(298): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccgggacatcgtgatgacccagtctccagactccctggctgtgtctctgggcgagagggccaccatcaactgcaagtccagccagagtatttttacagctaccaccaataagagctacttagcttggttccagcagaaaccaggacatcctcctctacngctcatttacgtggtcgtctacccgggaactccggggtccctcgaccgattccgaggtcgcaggcgggtctgggacagtatttcactctcaccacttcagcagccctgccgaggctagaagagtgtaggctagtttaattactgtacagtactaagttatttacttaacttcccttacctacgtaacggtaccgtttaccggaccgtaaacggggaacccgtaaagggttacggaaaagttaacccgaaaacggtaaccgttagggttacggaccgttacggacccgtaccgtacgttacccgg

SEQ ID NO: 161142 - DNA, 540 bp, Homo sapiens
  misc_feature: GYAE6OF02I9EQL.22.27.C05.1.454.CMB.1.raw
  modified_base (400)..(400): a, c, t, g, unknown or other
  misc_feature (400)..(400): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatcccggggtcctgaccgattcagtggcagcgggtctgggacagtatttcactctcaccatcagcagcctgcnggctagaagatgtgctagtttatactgtcagtctaatattatatttccctactcagtaccgttcggaccgaacgggaccgtaaaggtacggaaattaccgaaaacggtaacttaggtacggactacggtaccaacctacg

SEQ ID NO: 161143 - DNA, 509 bp, Homo sapiens
  misc_feature: GYAE6OF02GAICM.22.27.C05.1.454.CMB.1.raw
  modified_base (309)..(309): a, c, t, g, unknown or other
  misc_feature (309)..(309): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttacnggcgtctacccgggaatccggggtcctgaccgattcagtggcagcggtctgggacagatttcactctcaccatcagcagcctgcaggctgaagattgtggctagtttattactgtcagacaatattatatttcctcctacagtacgttcgaccgaagggaccaaaggtggaaactcgaaacgactgtagctgcaccatcg

SEQ ID NO: 161144 - DNA, 552 bp, Homo sapiens
  misc_feature: GYAE6OF02FW3O1.22.27.C05.1.454.CMB.1.raw
  modified_base (413)..(413): a, c, t, g, unknown or other
  misc_feature (413)..(413): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggctctacccgggaatcccggggtccctgaccgattcagtggcaggcggtctgggacaggtatttcactcctcacctatcagcagcctgcaggctgaagngtgtggactagttttactacgtgtcagtctaagtatttatactttcctcttacacgttaccgtttacgacccgtaacgggaacccgtaagggtacggtaaattaccgaaacgtacgtggtacggactgaccacgtaacg

SEQ ID NO: 161145 - DNA, 538 bp, Homo sapiens
  misc_feature: GYAE6OF02H3GR5.22.27.C05.1.454.CMB.1.raw
  modified_base (367)..(367): a, c, t, g, unknown or other
  misc_feature (367)..(367): n is a, c, g, or t
  modified_base (428)..(428): a, c, t, g, unknown or other
  misc_feature (428)..(428): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttacgtggcgtcgtaccggaatccgggtcctgaccgattcagtgcagcggtctggacagntttcactctcaccatcagcagcctgcaggtctagaatagtgtggacttagtttatacgttntcagctaaattattattacttcctcttacgacgttacgttccggaccgtaacgggacctaaaggtcggaaaattaccgaaacgtactggtacggctacgactacctaacg

SEQ ID NO: 161146 - DNA, 524 bp, Homo sapiens
  misc_feature: GYAE6OF02I0LO2.22.27.C05.1.454.CMB.1.raw
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggctctacccgggaatccggggtccctgaccgatcagtggcagcgggtctgggacagatttcactctcaccatcagcagcctgcnggctgaagntgtggctagtttatacttgtcagcaattattatacttcctcctcagtacgttcggcctaaggggacccaagggtacggaaacgttacaaacggtaactggtaggctggaccaccgtaac

SEQ ID NO: 161147 - DNA, 583 bp, Homo sapiens
  misc_feature: GYAE6OF02IM4C5.22.27.C05.1.454.CMB.1.raw
  modified_base (412)..(412): a, c, t, g, unknown or other
  misc_feature (412)..(412): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggcgtctacccgggaatcccggggtccctgaccgattcagtggcaggcgggtcgtgggactagattcactctcaccatcagcagcctgcaggctgaagttntttgactactttattactgtacagactaattataattagtaaccttggttacttacggacttaccgtacccgtttacggacccgtaacgggtaaccctaccggtaacgtgggtaaacgttaacgtttaaaaaccgggacgtttacgggtacggtaccgtacggtaaccccg

SEQ ID NO: 161148 - DNA, 552 bp, Homo sapiens
  misc_feature: GYAE6OF02FNDJD.22.27.C05.1.454.CMB.1.raw
  modified_base (372)..(372): a, c, t, g, unknown or other
  misc_feature (372)..(372): n is a, c, g, or t
  modified_base (416)..(416): a, c, t, g, unknown or other
  misc_feature (416)..(416): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatccctcctctactgctcatttactgggcgtcgtacccgggaatcccggggtccctggacctagttcagtggcaggcggtctggacngtactttcgactctcacctatcagcagccctgcaggctgaagtntgtgctagtttatactgtcagactaatattatacttccctctacagtaccgttacggaccgaagggaccctaaagggtagaaaacttacgaaaaccgtaacgttggtaccggtactacgacctaccgtattcccgg

SEQ ID NO: 161149 - DNA, 509 bp, Homo sapiens
  misc_feature: GYAE6OF02FOVCY.22.27.C05.1.454.CMB.1.raw
  modified_base (364)..(364): a, c, t, g, unknown or other
  misc_feature (364)..(364): n is a, c, g, or t
  modified_base (398)..(398): a, c, t, g, unknown or other
  misc_feature (398)..(398): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (504)..(504): a, c, t, g, unknown or other
  misc_feature (504)..(504): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcggtcngggacagatttcactttcaccatcagcagctgcngctgagntgngcagtttatactgtcagcatattatattcctctctagaccgttcgccaaggaccaaggtcggaaatccgaaacgtaactggtcggactgacacctntaccg

SEQ ID NO: 161150 - DNA, 586 bp, Homo sapiens
  misc_feature: GYAE6OF02H10DD.22.27.C05.1.454.CMB.1.raw
  modified_base (361)..(361): a, c, t, g, unknown or other
  misc_feature (361)..(361): n is a, c, g, or t
  modified_base (422)..(422): a, c, t, g, unknown or other
  misc_feature (422)..(422): n is a, c, g, or t
  modified_base (448)..(448): a, c, t, g, unknown or other
  misc_feature (448)..(448): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccacaataagagctacttagcttggttccagcagaaaccaggacatccctcctctactgctcatttacgtgggctacgtacccgggtaagtcccggggtcctcgaccgtattcgagtcggnacggcgggtctgggactagtactttcactctcaccatcgagcacgcctgcaggctagaagngtaggtcgatagttttatacgtgtanacgtactaaattaatttaatactttccctacctcgaacgtaccgttacgggacccgaaagggtaccgtaaagggtacggtaaacttaccgaaaacgtaccggttacggtacggtaccgtacggactaccgtagtaccg

SEQ ID NO: 161151 - DNA, 574 bp, Homo sapiens
  misc_feature: GYAE6OF02JCHUR.22.27.C05.1.454.CMB.1.raw
  modified_base (407)..(407): a, c, t, g, unknown or other
  misc_feature (407)..(407): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgctcatttactggctctaccgggaatccgggtcctgaccgattcagtggcaggcggtcgtgggacagtattcactctcgaccatcagcagcctgcaggctagaagngtgtgactagtttactactgttacagtactaattacttaacttactttcccttacgtactacggtaccggtttaccggaccgtaaaccggggtaccgtaaagggtacggtaaaacttaccgaaaaaccggttacgtaggttaacggcctaggaccctaccttaacgg

SEQ ID NO: 161152 - DNA, 529 bp, Homo sapiens
  misc_feature: GYAE6OF02FKAKA.22.27.C05.1.454.CMB.1.raw
  modified_base (459)..(459): a, c, t, g, unknown or other
  misc_feature (459)..(459): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacaggactttcgactctcaccatcagcagcctgcaggctgaagatggtgctagttttatacgtgtcagtacaagttattatacttcctcctnagtacgttcggaccaagggtacccaagggtcggaaataccgaaacgactggtagccgttagaccactacg

SEQ ID NO: 161153 - DNA, 494 bp, Homo sapiens
  misc_feature: GYAE6OF02G1PZH.22.27.C05.1.454.CMB.1.raw
  modified_base (407)..(407): a, c, t, g, unknown or other
  misc_feature (407)..(407): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtcctgaccgattcagtggcagcgggtctgggacagatttcactctcaccatcagcagcctgcaggctgaagntgtgcagtttatattgtcagcaatattatattcctctcagtcgttcgccaagggaccaaggtggaatcaacgactgtgctgcactac

SEQ ID NO: 161154 - DNA, 532 bp, Homo sapiens
  misc_feature: GYAE6OF02FHDGV.22.27.C05.1.454.CMB.1.raw
  modified_base (310)..(310): a, c, t, g, unknown or other
  misc_feature (310)..(310): n is a, c, g, or t
  modified_base (411)..(411): a, c, t, g, unknown or other
  misc_feature (411)..(411): n is a, c, g, or t
  modified_base (520)..(520): a, c, t, g, unknown or other
  misc_feature (520)..(520): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccacaataagagctacttagcttggttccagcagaaccaggacatcctcctctactgctcatttacngggctctacccgggaatccgggtccctgaccgattcagtggcaggcgggtctgggacaggtatttcgactctcaccatcagcagccctgcaggctagaagntggtggctagttttatacgtgtcagctaagttattatacttccctactcagtaccgttcgacgtaaggggaaccaagggttacggaaactcgaaaacgtactggtcggntcggacacctag

SEQ ID NO: 161155 - DNA, 610 bp, Homo sapiens
  misc_feature: GYAE6OF02IZP1J.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtggcgagagggccaccatcaactgacaagtccagccagtagttatttttacagctccaaccaataagattactagcttggtcagcaagaacaggacatcgtctgcactgctcattacgtgggctacgtaccgggtaacgtcccggggtcctacgaccgtattcgacgttggcgaggcgggtcgtacgggtacaggtacttcgacgtccttaccaactctaaacagtaccacggtcctcgacgtacggtccgtagaacgtagttggacggtacttaacggttttaatagttcgtacacgtacgtaaattagtttaactactttccctacctacgacgttaccgttccgggaaccgtaagggtaaccaacgggtagaaaacttaccgaaacgtacgtacggtagccttagacctacgtaacg

SEQ ID NO: 161156 - DNA, 533 bp, Homo sapiens
  misc_feature: GYAE6OF02I8K7D.22.27.C05.1.454.CMB.1.raw
  modified_base (442)..(442): a, c, t, g, unknown or other
  misc_feature (442)..(442): n is a, c, g, or t
  modified_base (461)..(461): a, c, t, g, unknown or other
  misc_feature (461)..(461): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgaccccagtctccagactccctggctgtgtctctgggcgagagggccaccatcaactgcaagtccagccagagttatttttacagctccaccaataagagctacttagcttggttccagcagaaaccaggacatccctctctactgctcatttactggctcctacccgggaatccggggtcctgaccgattcagtggcagcggtctagggacagtactttcactctaccacctactcagcagcctgcaggcctagaagtatggtggctagtttatacgtgtcagntaatattatacttctcctnagtcgttcggacctacggaaccgaaggtacgaaactacgaaacgtactggtacgtctacggaccaccgtacg

SEQ ID NO: 161157 - DNA, 519 bp, Homo sapiens
  misc_feature: GYAE6OF02IQC2Y.22.27.C05.1.454.CMB.1.raw
  modified_base (407)..(407): a, c, t, g, unknown or other
  misc_feature (407)..(407): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatcccggggtcctgaccgattcagtggcagcgggtctgggacagatttcactctcaccatcagcagcctgcaggctgaantgtgctagtttatactgtcagcaattattatactttcctctcagtacgttcgacctaagggacctaaggtcggaaatcaaaacggacttcggtaggactacggcctactacg

SEQ ID NO: 161158 - DNA, 521 bp, Homo sapiens
  misc_feature: GYAE6OF02G1P0S.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatccctcctctactgctcatttactgggcgtctacccgggaatccgggggtccctgaccgattcagtggcagcggtctgggacagattcactctcaccatcagcagcctgcaggctgaagatgtgcagtttatactgtcagcaatattatatttcctcctcagtacgtttcggacctaagggaccaagggtaggaaactaccgaaacgtactcggtaggcctggcctaccattccg

SEQ ID NO: 161159 - DNA, 634 bp, Homo sapiens
  misc_feature: GYAE6OF02IS0DA.22.27.C05.1.454.CMB.1.raw
  modified_base (370)..(370): a, c, t, g, unknown or other
  misc_feature (370)..(370): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctaccaccaataagagctacttagcttcggttccagcaagaaaccaggacatccctcctactactgctctatttacgtgggcgtccgaccggtaacgtccggggtccctgaccgtatcgagtgcagcggtntgggacagtactttcacgtcctacaccctataccgaacgtccgacgtccgtacggaccgtacgggtacgtacggaaacggtagttacggtacgggtaccttaaggtttttaactttacctaggttactacggtactaaagtttaattattaaccttcttaccctacgtacgtacggtttccggacctaacggggtaaccaaggggttaacgaaactaaccgaaaacgtaacgtgggtacggacgttacggcctaccgtattccg

SEQ ID NO: 161160 - DNA, 559 bp, Homo sapiens
  misc_feature: GYAE6OF02GB81C.22.27.C05.1.454.CMB.1.raw
  modified_base (458)..(458): a, c, t, g, unknown or other
  misc_feature (458)..(458): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctaccgggaatccggggtccctgaccgattcagtggcagcgggtctgggacagatttcactctcacctatcagcagcctgcaggctagaagatgtggctagttttatacgtgtcagctaaattattatacttccctacctnacgtaccgtttcggaccgtaacgggaccctaaagggttacggaaaacttaccgaaaacggtaacgttacggtacgggaccttacggacctacccgttaacg

SEQ ID NO: 161161 - DNA, 531 bp, Homo sapiens
  misc_feature: GYAE6OF02H0D2A.22.27.C05.1.454.CMB.1.raw
  modified_base (411)..(411): a, c, t, g, unknown or other
  misc_feature (411)..(411): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttattttttacagctccaccaataagagctacttagcttggttccagcagaaaccaggacatcctcctctactgctcatttactgggctcgtacccgggaatcccggggtcctgaccgattcagtggcagcgggtctgggacagatttcactctcaccatcagcagcctgcaggctagaaangtgtggctagtttatactgtacagactaattattattattccctctactagtaccgttcgaccgaagggacctaaggtaggaaactacgaaacgtactaggtcgactacgaccacctacg

SEQ ID NO: 161162 - DNA, 519 bp, Homo sapiens
  misc_feature: GYAE6OF02F6SOT.22.27.C05.1.454.CMB.1.raw
  modified_base (407)..(407): a, c, t, g, unknown or other
  misc_feature (407)..(407): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtcctgaccgattcagtggcagcggtctgggacagatttcactctcaccatcagcagcctgcaggctgaagtnttttgctactttattactgtcagctaatataatgactggttctgatcaccgttcggaccaagggaccacgtacgtacggagtaacttaaacggaacttaggtcgtcgtgacc

SEQ ID NO: 161163 - DNA, 580 bp, Homo sapiens
  misc_feature: GYAE6OF02JAFZH.22.27.C05.1.454.CMB.1.raw
  modified_base (256)..(256): a, c, t, g, unknown or other
  misc_feature (256)..(256): n is a, c, g, or t
  modified_base (458)..(458): a, c, t, g, unknown or other
  misc_feature (458)..(458): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataaganctacttagcttggttccagcagaaaccaggacatcctcctctactgctctatttactgggcgtccgtacccgggaatcccggggtcctggaccgtattcgagtggcaggcgggtcgtcgggacagtattcactctcaccatcagcagcctgcaggctagaacgtagtgtagctagtttatacgttcgtacagtactaaattnttaacttactttccctcttacgtaacggttacgttccggaaccggtaaacgggaccgtaaagggttacgtaaaacgttaccgaaaacgttaaccgtcggtacgtactcggtacctacctacg

SEQ ID NO: 161164 - DNA, 606 bp, Homo sapiens
  misc_feature: GYAE6OF02HUS2N.22.27.C05.1.454.CMB.1.raw
  modified_base (424)..(424): a, c, t, g, unknown or other
  misc_feature (424)..(424): n is a, c, g, or t
  modified_base (454)..(454): a, c, t, g, unknown or other
  misc_feature (454)..(454): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctggcgagagggccaccatcaactgcaagtccagccagagttatttttacagctccacaataagagctacttagctttggttccagcagaaaccaggacatccctctcctactgcctcatttactgggccttcgtacccgggaacttcccgggggtccctggaccgattccgagtcggcagcgggtctgggacagtcttcgactctcactatcagcagccctgcgaggcgtagaacgntcgtggacttaagttttacgttacgtgtanaacggtactaaagttacttaacgttacccttccgtccctaacgtacgtaccggtttaccggacccgaaacgggtaccgaagggttacgtaaaaccgtaccgttaaaacggacgttaggtacccggagtaccggacctaaccgactttacccg

SEQ ID NO: 161165 - DNA, 569 bp, Homo sapiens
  misc_feature: GYAE6OF02IKMTS.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgctcatttactgggcgtctacccgggaatccggggtccctgaccgtattcgagtcggcagcgggtctgggacagtatttcactctacaccatcagcagcctgcaggctagaagagtgtggctaagtttatacgtgtacagtactaagttattacttacttcccttacctacacgttaccggtttccggaccgtaacgggtaaccgtaaaggttaggaaaacttaccgaaaacggtacgttcggtacggaccgtgacccgaaccttacg

SEQ ID NO: 161166 - DNA, 596 bp, Homo sapiens
  misc_feature: GYAE6OF02GYL7V.22.27.C05.1.454.CMB.1.raw
  modified_base (575)..(575): a, c, t, g, unknown or other
  misc_feature (575)..(575): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgctcatttactgggctcgtacccgggaatcccggggtcctggaccgattcagtggcaggcggtcgtgggacagatttcactcttaccactatcagtcagccctgcagcgtagaagtgtggtcggcttagttttaattccgttagtcaagaccttaaattagttaattacgtttccctcgtaacctacggtccgtttaccgggaccgtaaacggggtaccctaaagggtacgggtaaaaccttacgaaaaccggtaacgttacggtcgggtaacncgggtaacctacccttaacgg

SEQ ID NO: 161167 - DNA, 495 bp, Homo sapiens
  misc_feature: GYAE6OF02GOGHI.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatccggggtccctgaccgattcagtggcagcgggtctgggacagatttcactctcaccatcagcagcctgcaggctgaagatgtggctagtttatactgtcagcaatattatattcctctcagtcgttcgacaaggaccaaggtgaactcaacgatgtggctgcaccatcg

SEQ ID NO: 161168 - DNA, 527 bp, Homo sapiens
  misc_feature: GYAE6OF02F74PB.22.27.C05.1.454.CMB.1.raw
  modified_base (309)..(309): a, c, t, g, unknown or other
  misc_feature (309)..(309): n is a, c, g, or t
  modified_base (403)..(403): a, c, t, g, unknown or other
  misc_feature (403)..(403): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttacngggcgtctaccgggatccggggtcctgaccgtatcagtggcagcgggtctggacagatttcactctccacatcagcagcctgcaggctagaagnttagtggctagtttacttactgtcagtctaatattatacttcctctcaacgtcgttcgaccgaagggtacctaagggtacgaaagtaccgaaacgtaacgtggtacggctacgccaccattccg

SEQ ID NO: 161169 - DNA, 508 bp, Homo sapiens
  misc_feature: GYAE6OF02FT5M1.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagattgtggcagtttattactgtacagcaatattatatttcctcctcagtacgttcgccaagggacccaaggtcgaaatcaaacgactgtggctgccaccatccg

SEQ ID NO: 161170 - DNA, 855 bp, Homo sapiens
  misc_feature: GYAE6OF02I62Q3.22.27.C05.1.454.CMB.1.raw
  modified_base (53)..(53): a, c, t, g, unknown or other
  misc_feature (53)..(53): n is a, c, g, or t
  modified_base (272)..(272): a, c, t, g, unknown or other
  misc_feature (272)..(272): n is a, c, g, or t
tcagacatacgcgtcacgaccggtgctcgatttagacgcgatcgaagggtttngggggcgtacaacaggcaggcagggcagcaagatggtgttgcagacccaggtcttcatttctctgttgctctggatctctggtgccgtccgggacagtcgtgagtcgacccagtctccacgacctcccgtcgcgtgtcgtcgtcgtcggcgaggacggaccgaccactacaacgtacgacgaacgtaccgacgagacctaagttaacgtaacttttaanccgtaacgtaccgtaaccgtaaaccgaaacgttaaagacgtaccgttaaccgtttaacggtaccgtttacggttacccgtaacggtaaccgtaaaccggtaaaaacccgtaacggtaaccgtaaaccgttaccccgttaaccccgttaaccgttaaacccgttaccggtaacccgttaaccgttaaaccgttttaaaccggttaccggggtaacccggttaacccggttaaacccccggggtaaacccggttaccccggggttaccccggttaaccggtaacccggtaacgtttaccggtaacggtacggtacgtacggtaccgggtaccggtacgggtaacgtaacgtaacgtttaccgtaccgtaccgtaccgtaacctaacgtacgtacgaccgtacgtaccgtacgacgtacggtacgtacgaagtagtacggtacgacgttaagtttaacgttaacgtacgtacgtacgtaacgtaaacgttaacttaagttacttaccttactacgtaacggtaccgttaccgtaaccggtaacggtaaccggtaacggtaacggtaacgtaacgtaaaccgtaacg

SEQ ID NO: 161171 - DNA, 554 bp, Homo sapiens
  misc_feature: GYAE6OF02G3RED.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcaagaaaccaggacatcctcctctactgctcattactggctcgtaccggatccggggcctgaccgattcagtggcaggcgggtctgggacagtactttcgactctacaccatcagcagcctgcaggctagaagagtggtgacttagtttacttactgtcagtacaattattactacttccctaccgtactagtaccgttccggactaaacggggacctaaagggtacgaaacgtacgaaaaccgtacttacggtacggaccgttcgacctaccgtattaccg

SEQ ID NO: 161172 - DNA, 544 bp, Homo sapiens
  misc_feature: GYAE6OF02I77C3.22.27.C05.1.454.CMB.1.raw
  modified_base (368)..(368): a, c, t, g, unknown or other
  misc_feature (368)..(368): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctcaccaataagagctactagcttgtccagcagaaaccaggacatcctcctctactcgctcatttactgggtcgtcgtaccgggaatcccggggtccctgaccgattcagtcgcagcggtctggacagtnttacactctacaccatcgagcagcctagcgacgcgtagaagtacgtggagtctagtttatttactggtacagactaatatttatactttccactcacgtacgttcgactaaacgggacctaaggtaggaaactaacgaaaccgtaactggtccggacttcgacctacctattaccg

SEQ ID NO: 161173 - DNA, 531 bp, Homo sapiens
  misc_feature: GYAE6OF02GJPP3.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatccggggtccctgaccgattcagtgcagcgggtctgggacagatttcactctcaccatcagcagcctgcaggcctgaagatgtaggctagttttatacgtgtcagtctaaattattatacgtttcctcctacgagtaccgttcggaccaagggaccaaagggtagaaactacgaaacgtactaggcggactggacctaccattacg

SEQ ID NO: 161174 - DNA, 539 bp, Homo sapiens
  misc_feature: GYAE6OF02HQCR4.22.27.C05.1.454.CMB.1.raw
  modified_base (309)..(309): a, c, t, g, unknown or other
  misc_feature (309)..(309): n is a, c, g, or t
  modified_base (392)..(392): a, c, t, g, unknown or other
  misc_feature (392)..(392): n is a, c, g, or t
  modified_base (429)..(429): a, c, t, g, unknown or other
  misc_feature (429)..(429): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatccctctctactgctcatttacnggcctctaccgggatccggggtcctgaccgattcagtggcagcgggtctgggacagtattcgactctcaccatcagcagcctncgaggctaggaagatggtgacttagtttattactgtnacgtacaattattatacttcctcctcacgtacgttccggacgtaacgggaccaaagggtacgaaatacgtaaaccgtaacgtggtcggacttacggacctacctataccg

SEQ ID NO: 161175 - DNA, 566 bp, Homo sapiens
  misc_feature: GYAE6OF02IWNJI.22.27.C05.1.454.CMB.1.raw
  modified_base (311)..(311): a, c, t, g, unknown or other
  misc_feature (311)..(311): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatccctcctctactgctcatttacnggcgtctacccggatccggggtcctgaccgattcagtcggcagcgggtctgggacagtatttcactctcaccatcagtcagcctgcgagctagaagtagtggtggcttagtttattactgtacagactaatattatactttcctcctacacgtaccgtttccggaccgtaacgggaccgtaaaggttacggtaaaacgtaccgaaaaaccgtacgttacggtacggtaccgtagacccgtaccgtagtttacccg

SEQ ID NO: 161176 - DNA, 500 bp, Homo sapiens
  misc_feature: GYAE6OF02FYHB3.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacaatcctcctctactgctcatttactgggcgtctacccgggaatccggggtccctgaccgattcagtggcagcgggtctgggacagatttcactctcaccatcagcagcctgcaggctgaagatgtgcagtttatactgtcagcaattatatatcctctcagcgttggccaagggaccaaggtcgaaatcaaacgacttgtggctgaccactac

SEQ ID NO: 161177 - DNA, 624 bp, Homo sapiens
  misc_feature: GYAE6OF02I0EM0.22.27.C05.1.454.CMB.1.raw
  modified_base (261)..(261): a, c, t, g, unknown or other
  misc_feature (261)..(261): n is a, c, g, or t
  modified_base (372)..(372): a, c, t, g, unknown or other
  misc_feature (372)..(372): n is a, c, g, or t
tcagacatacgcgtcacgaccggtgctcgatttagacgcgatcgaaggggtttgggggagctacaacaggcaggcgaggggcagcaagatggtgttgcagacccaggtcttcatttctctgttgctctggatctctggtcgccgtccggggacatcgtgatgacccagtctccagcctcctggctgtgtctcgtgggcgagagggccaccatcaactgcaagtccagccagagttatttttacagctccaaccaataaganctacttagcttcggttaccagcaacgaaaccaggactatcctcctactactgctctatttacgtcgggtccgtaccgtaaccgggtaacgtccggggtccctggtaccgtntaccgaggttcggcgaggcgggttcgtacggggaactaggtaactttccaactcaccactactcaaggccacgtcctgcgaacgggctagaacgtgttggcgtagtagtttactacgtgtaccagtactaattacttaatcttcctcgtacgacgtaccgtaccggacgaaacggggaccgttaaaggacgggtaaaacttaaccggaaacgttaagttcgggtacaccggttaccacctaccgttaaccgg

SEQ ID NO: 161178 - DNA, 550 bp, Homo sapiens
  misc_feature: GYAE6OF02F2IIW.22.27.C05.1.454.CMB.1.raw
  modified_base (406)..(406): a, c, t, g, unknown or other
  misc_feature (406)..(406): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagaggccaccatcaactgcaagtccagccagagttatttttacagctccaccaataagagctacttagcttggttccagcagaaccaggacatcctctctactgctcatttactgggctctaccgggaatccgggtcctgaccgattcagtggcagtcgggtctgggacagtactttcactctcaccatcagcagcctgcaggctagaagntgtgactagtttatactgtacagactaattattacttactttccctcttacacgttaccgttccggaccgtaacgggtaaccctaagggtacgtaaactaccgaaaacgtacttagggtaccggactacgtacccacgttaccg

SEQ ID NO: 161179 - DNA, 636 bp, Homo sapiens
  misc_feature: GYAE6OF02J2PUP.22.27.C05.1.454.CMB.1.raw
  modified_base (197)..(197): a, c, t, g, unknown or other
  misc_feature (197)..(197): n is a, c, g, or t
tcagacatacgcgtcacgaccggtgctcgatttagacgcgatcgaagggtttgggggcgtacaacaggcaggcaggggcagcaagatggtgttgcagacccaggtcttcatttctctgttgctctggatctctggtgcctccggggacatcgtgatgacccagtctccagactccctggctgtgtctctgggcgagngggccaccatcaactgacaacgtccagccagagttatttttacagtcctccaaccaataagagctacttagctttcggttccagcaacgaaccaggaacactccctcctactactgctctactttacgtcgggtccgtaccggtaacccgggtaacgttccccgggggtcctacggaccgtacttacgacgggtcgcgtacggcgggtcgtcgggacagtacgtttccacgttctccaccgtactcacgtcacgtccctagccgagtcgtagagacgttcggtcggtacttagtttacgtacgtcgttacagttaccaaatttacgttacttaccttccctacttacgaacgttccgtaccgaccggtaacggtaaccgtaacgggtaaggaaactaaccgtaacgtacgttacggcgtacgtcgtaccactacttccg

SEQ ID NO: 161180 - DNA, 542 bp, Homo sapiens
  misc_feature: GYAE6OF02JDRBC.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctactagcttggttcagcagaaaccaggacatcctcctctactgctcatttactggcgtctaccggaatccgggtcctgaccgtatcagtcgctaggcggtcgtgggacaggtattaccacgtctacacctatcagcagcctgcaggtctagaagatggtgactagtttatactgtcagactaattattatacttcctacctacacgtaccgttacggaccgtaacgggacgtaaaggttaggaaacttaccgaaaaccgtagttcggtggactcggaccactaacg

SEQ ID NO: 161181 - DNA, 615 bp, Homo sapiens
  misc_feature: GYAE6OF02IY5YW.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctccctggctgtgtctcgtgggcgagagggccaccatcaactgcaagtccagccagtagttatttttacagctaccaccaaataagagctacttagcttggtccagcagaaaccaggacatcctctctactgctctactttactgggccgtaccgtacccgggaagtcccggggtccctcgtacccgtagttccgaagtcggacgaggccggggttctagggggacctacggtatttaccgaccttcgtccaacccgtatccaagccacgccttgccgtaggctagaagtacgtggtggtactagttttactacgtcgtcgaagtactaaagttagtttaattcttacccttacctacgagtttaccgtccggaccgaacgggtaacgtaacggtaaggaaactaccgaaacgtacgtcgggttagcgtacaccgacctacg

SEQ ID NO: 161182 - DNA, 567 bp, Homo sapiens
  misc_feature: GYAE6OF02FG4KX.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctcgtacccgggaatccggggtcctgaccgattcagtgcagcgggtctgggacagatttcactctcacatcagcagcctgcaggctgaagatgtggctagtttatacgtgtcagctaaattattaattactttcccttacctactaacgtaccgtttccgggacccgtaaacggggtaacccgaaaggggttacggaaaacttaccgtaaaaaccggtaacgttacgggtacggacctcggacctacctaacg

SEQ ID NO: 161183 - DNA, 269 bp, Homo sapiens
  misc_feature: GYAE6OF02H6Y2V.22.27.C05.1.454.CMB.1.raw
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatgacccagtctccagactccctggctgtgtctctgggcgagagggccaccatcaactgcaacgtccagccagagttatttttacagtctccaccaataagagctactgntcgtn

SEQ ID NO: 161184 - DNA, 739 bp, Homo sapiens
  misc_feature: GYAE6OF02IA1CK.22.27.C05.1.454.CMB.1.raw
  modified_base (263)..(263): a, c, t, g, unknown or other
  misc_feature (263)..(263): n is a, c, g, or t
tcagacatacgcgtcacgaccggtgctcgatttagacgcgatcgaagggtttgggggcgtacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccgatcaactgcaagtccagccagagtatttttacagctccacaataagagttacttagnttggttccagctaagaaaccaggacatcgtctgcactgctctatttacgtcgggtccgttaccgtaacccggggtaacgttccccgggggttccctacggtaacccggtactttaccgaacggttcgggacgtaacgggtccggggtacgttagggggaacctaaggttaacttttccgtaaccgttcctaccgtaaccccgtaagttacccgacggaccctaaccgggtccctttcggaccgaacggggtccttaagggaaaccgtgttacgggtcggtaacttacgggtttttaacttacggacgttcgaaccggtacgttaagttaaacttaaacgtttaccgtacgggtcccggttaacggtacccgttcgggtaacccgaacggggttaaccgaaggggtaacggtaaacggtccgaaaacggttaaaccgtgttcgggtacgtacgaaccgtacgtaccgttcgtttccg

SEQ ID NO: 161185 - DNA, 637 bp, Homo sapiens
  misc_feature: GYAE6OF02GON6U.22.27.C05.1.454.CMB.1.raw
  modified_base (497)..(497): a, c, t, g, unknown or other
  misc_feature (497)..(497): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgacaagtccagccagagttatttttacagctaccaccaataagagttacttagtcttggttccagacaacgaaaccaggacatccgtcctgcactgctctatttacgtcgggtcgtaccgtacccgggaacgttcccggggtccctacggacccgtattcgaggtcggcgtagggtcgggtcgtacggggactagtacgtttcaccttcctacctaccatcgacgcgacgtccgtgacgacgggtacgaacgtgtaggtcggtacttaggttttattagttcgtanacgtactaattattacttactttcctacctagtacgtaccggttccggaaccgtacgggtaacccgaagggttaccggaaatacccggtaaaagaccgttaggacgtaccgtacgtaccgtaaccgttactccggttacg

SEQ ID NO: 161186 - DNA, 618 bp, Homo sapiens
  misc_feature: GYAE6OF02FZM8C.22.27.C05.1.454.CMB.1.raw
  modified_base (311)..(311): a, c, t, g, unknown or other
  misc_feature (311)..(311): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagcctccaccaataagagctacttagcttggttccagcagaaaccaggacatcctcctctactgctcatttacnggtcgtctaccgggacgtccggggtccctgaccgattcagtcggcaggcgggtcgtgggactgtactttcacgtctccacctatcagcagtccctgcacgggtctaggaagtcgtggtacggtacttaaggtttacttacgttgtactaggtactaattaatttacgttactttacccttccctagtaccgttacggttcccggaccgtaacgggtaccctaaaggggtaacggaaacttaacccgtaaaaggttaaccggttaggttaccgggtaccgttacggaccctaacccgtagtttacccg

SEQ ID NO: 161187 - DNA, 646 bp, Homo sapiens
  misc_feature: GYAE6OF02I002P.22.27.C05.1.454.CMB.1.raw
  modified_base (324)..(324): a, c, t, g, unknown or other
  misc_feature (324)..(324): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactcctggctgtgtctctgggcgagagggccaccatcaacgtgcaagtccacgccagagttactttttacagctaccaccaataagagctacttagtcttcggttccagacaagaaaccaggtaacactcctcctactactgctacatttacnggcgtacgtaccggaagtccgggtcctacgaccgtacttcgacgtcgcgtacggtcggtcgtgggaacgtacgtacgtttcactcgctaaccgataccgaagtccacgtccgtagcgaggtccgtagaacgagttcggtacgggtaccttaagttttactaccgttacggtacaacggttactaaagtttacgttaactttccgtttaacctccgtaacgttaacgtacccggtttacggacccgtaaaggggtaccgttaaacggtaagggtaaaacttaccgaaacggtacttcggtagtaccgtacgaccgtaactacg

SEQ ID NO: 161188 - DNA, 629 bp, Homo sapiens
  misc_feature: GYAE6OF02FSPEF.22.27.C05.1.454.CMB.1.raw
  modified_base (366)..(366): a, c, t, g, unknown or other
  misc_feature (366)..(366): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggcgtctacccgggatccggggtccctgaccgattcagtggcaggcggtctgggacngtatttcactctcacatcagcagcctgcgaggtcctaggaacgtagtggtacggtctaacggttttattaccttggttccaaggtacctaaagtttacgtttaatttaacctttccgttacccttcgtaacggtacccgggttttaccgggacccgtaaacggggtacccgttaaaggggtaacggtaaaaacccgtttaccgaaaaaccggtaacgttcggttaacgggtaccgtacgtacccggtaaccctacggtttacc

SEQ ID NO: 161189 - DNA, 614 bp, Homo sapiens
  misc_feature: GYAE6OF02HVFZP.22.27.C05.1.454.CMB.1.raw
  modified_base (373)..(373): a, c, t, g, unknown or other
  misc_feature (373)..(373): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccacatcaactgcaagtccagccagagtatttttacagctccaccaataagagctacttagcttggtccagcaagaaaccaggacatcctcctctactgctcatttactgggcgtcctaaccccgggtaatcccgggggtccctggaccgacttccgagtcggcacggcgggtntacggggacaggtactttcacctctccacctatccagtcacgcctgcaggctagaagtagtggtcggtactagttttaatctaggtcagtactaattatttaactactttcccttcctacgtaacgtccggtttaccggacccgaaaggggtaaccgtaaagggttagtaaaacggtacctaaaaacggtaccgttacgggttacggtaaccgttaccggtaccgtaaccctagttacccg

SEQ ID NO: 161190 - DNA, 257 bp, Homo sapiens
  misc_feature: GYAE6OF02FH71J.22.27.C05.1.454.CMB.1.raw
  modified_base (252)..(257): a, c, t, g, unknown or other
  misc_feature (252)..(257): n is a, c, g, or t
tcagacatacgcgtcacgaccggtgctcgatttagacgcgatcgaagggtttgggacagatttcactctcaccatcagcagcctgcaggctgaagatgtggcagtttattactgtcagcaatattatattcctcctcagacgttcggccaagggaccaaggtggaaatcaaacgaactgtggctgcaccatctgtcttcatcttcccgcatctgaacgtcgtatgtctgagcgggctggcaaggcgcatagnnnnnn

SEQ ID NO: 161191 - DNA, 510 bp, Homo sapiens
  misc_feature: GYAE6OF02GXIDI.22.27.C05.1.454.CMB.1.raw
  modified_base (410)..(410): a, c, t, g, unknown or other
  misc_feature (410)..(410): n is a, c, g, or t
  modified_base (496)..(496): a, c, t, g, unknown or other
  misc_feature (496)..(496): n is a, c, g, or t
  modified_base (507)..(507): a, c, t, g, unknown or other
  misc_feature (507)..(507): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgctcatttactgggcgtctacccgggaatccggggtccctgaccgattcagtggcaggcgggtctgggacagatttcactctcacctatccagcagcctgcaggctgaagntgtggactagtttatactgtcagacaattattatacttcctctcagtcgtcggaccaagggacaaggtaggaatacgaaacgatgngactgccactntcg

SEQ ID NO: 161192 - DNA, 557 bp, Homo sapiens
  misc_feature: GYAE6OF02HGS0N.22.27.C05.1.454.CMB.1.raw
  modified_base (417)..(417): a, c, t, g, unknown or other
  misc_feature (417)..(417): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatcccggggtccctgacccgattcagtgcagcgggtctgggacagtatttcactctcaccatcagcacgcctgcaggctaggaagagtgnggctagtttactacttgtcagacaattatttagtacttcctcctactagtaccgttaccggaccgtaacggggtaacctaagggttagaaaacgttaccgaaaaccgtacgttggtacggcttacggacctaccgtaacg

SEQ ID NO: 161193 - DNA, 686 bp, Homo sapiens
  misc_feature: GYAE6OF02G6NR4.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgacaacgtccacgccagagttatttttacagtcctaccaaccaataagtagttacttagtcgttggttccagcaacgaaaccaggactactcgtctcgcactgctctacttacgtcgggtcgtccgtacccgggtacgtcccggggtcctacggaccgtatcgaggtcggcgtacggcgggtcgtacgggacgtagtacttccactctaccacctactacgacgtcctaacgtcccgtaggaccgagggtcctaaggtaaacggtcggttgtacgggtacctttaaggttttactttacgttacgactaacggttacttaaagtttaactttaagttacctttcccgttactaacgtacggtacccggttacgggaacccggtaacggggtaaaccgtaaggggtaacggtaaaaccttacccggtaaaaggtacgttcgggtaccgtaacgtcggaccctacgttaccg

SEQ ID NO: 161194 - DNA, 534 bp, Homo sapiens
  misc_feature: GYAE6OF02HGLO7.22.27.C05.1.454.CMB.1.raw
  modified_base (343)..(343): a, c, t, g, unknown or other
  misc_feature (343)..(343): n is a, c, g, or t
  modified_base (438)..(438): a, c, t, g, unknown or other
  misc_feature (438)..(438): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgctcatttactgggctctaccgggaatccgggtcctgaccgntcagtgcagcgggtcgtgggacagatttcacttctcacctatcagcagcctgcaggctaggaagtatggtgacttagtttacttacgtgtcagtntaattattattcttccctactctagtaccgttcgaccgtaagggacctaaggtagtaaactacgaaacgtacgtacggtgacgtacgaccacctac

SEQ ID NO: 161195 - DNA, 588 bp, Homo sapiens
  misc_feature: GYAE6OF02G7MQL.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatccctcctctactgctctatttactgggcgtccgtacccgggaacgtcccggggtccctgaccgtattcgaggttcggcacggcgggtcgtgggacagtactttcactctcacctatcagcagcctgcaggctagagagtggtggacttagttacttcgtgtacagactaatacttaattaccttcccttaccgtacgaacgttccgttaccggacccgtaagggtaccctaagggtaacgtaaacgtaccgtaaaacgtaccgttaggtaccggtcctacggaccctaccgtattaccgg

SEQ ID NO: 161196 - DNA, 626 bp, Homo sapiens
  misc_feature: GYAE6OF02HBLEP.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagtagttatttttacagtctaccaccaataagagctacttagcttggttccagcagaaaccaggacatcctcctctactgctcatttacgtggcgtcgaccggtacgtcccgggtcctcgaccgtatcagtggcaggcggtcgtgggacagtactttcactctccactactcgagtcacgtcctaggccacggtctaggaacgtagttcggtgtacgtaagttttactacgtcgttacgagtaccttaaagtattaacttactttccctactacctaacgggttaccgtttaccggacccgtaaaggggtacccgtaaagggttaacgggaaaaccttacgaaaaaccggttaccgttggggtaccgtaaccggtaccgtaccgttacccgtaagtttcccgg

SEQ ID NO: 161197 - DNA, 534 bp, Homo sapiens
  misc_feature: GYAE6OF02IV9PQ.22.27.C05.1.454.CMB.1.raw
  modified_base (291)..(291): a, c, t, g, unknown or other
  misc_feature (291)..(291): n is a, c, g, or t
  modified_base (393)..(393): a, c, t, g, unknown or other
  misc_feature (393)..(393): n is a, c, g, or t
  modified_base (462)..(462): a, c, t, g, unknown or other
  misc_feature (462)..(462): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaccagacatccncctctactgctctatttactgggctcgtacccgggatcccggggtcctagaccgattcagtggcagcgggtctgggacagtacttcgacttctcaccatcancagcctgcaggtcctagaagtgtgtcggactagttttatactgtcagctaatattatacttcctactanacgtacgttcgaccgtaagggaccgtaaggtcggaaactcgaaacgtactggtcggactcgaccgaacctcg

SEQ ID NO: 161198 - DNA, 624 bp, Homo sapiens
  misc_feature: GYAE6OF02ILU8K.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgtttctctggatctctggtgcctccggggacatcgtgatgacccagtctccagactccctggctgtgtctctgggcgagagggccaccatcaactgcaagtccagccagagttacttttttaacagcctaccacctaataagagctacttagcttggttaccagcagaaaccaggacatcctcctctactgctctatttacgtgggcgtccgtacccgggacgttcccggggtccctaggaccgtattcaggtcggacgaggtccgggtcgtcggggaactagtactttcacttctccaacctactcgacgcacgtacctgacagggctaggaagtattggtcggtactaagtttttaacttacgtacggtacaaggtacctaaatttatttaactttacttcccttcccttagtacgtaaccggtttcgaaccgtagggaacctaaggggtagtaaactacgaaaaccgtaacgtggtacgtacgtcgaacctaccgtatcttacgg

SEQ ID NO: 161199 - DNA, 675 bp, Homo sapiens
  misc_feature: GYAE6OF02JR5FK.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagacgggccaccagtcaactgacaagtccagccagagttatttttaccagctaccaccaataagagactacttacgtcttacggttacctagactaagaaaccaggaacctaactccttacctacctactcgtctactactttacgtcggtaccgtaccgtacccgggtaacgttcccggggtaccttcggaacccgttacttacgtacggttcggcgtacgggtcgggtcgtagggaacgtagtacgtttccgacttccgtaccgtaacctaattccgaacggtcgtacgaccttcggacgtacggtacgtagaaaggtacttggtacggtacgttacgtttattacgttgtacgtagtacctaagttaattctaactttcctcgttaacgagttaccggttacgaccggtaacggaaccgtaaggttaacgtaaacgtaccgaaagttaccgtgtacggtctaagtacctaagtaccg

SEQ ID NO: 161200 - DNA, 574 bp, Homo sapiens
  misc_feature: GYAE6OF02IM9QK.22.27.C05.1.454.CMB.1.raw
  modified_base (435)..(435): a, c, t, g, unknown or other
  misc_feature (435)..(435): n is a, c, g, or t
  modified_base (555)..(555): a, c, t, g, unknown or other
  misc_feature (555)..(555): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagacagaaaccaggacactcctcctctactgcctctatttactgggcgttcgtacccgggagtccgggtccctgaccgtattcgagtcggctaggcgggtcgtgggactagtactttccactccgtcaacctataccagcacgcctgcaggctaggaaacgngtcggtaggtacttaagtttacgtaccttgtactaagtactaagttacttattacttcctcgtacacgtacgttacggaccgtaagggaccaaagggtgaaaactcgaaacggacgttgnggaccgtagacctaacgtc

SEQ ID NO: 161201 - DNA, 563 bp, Homo sapiens
  misc_feature: GYAE6OF02FYDEA.22.27.C05.1.454.CMB.1.raw
  modified_base (418)..(418): a, c, t, g, unknown or other
  misc_feature (418)..(418): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccatcatcaactgcaagtccagccagagtatttttacagctccaccaataagagctacttagcttggttccagcagaaaccaggacatcctcctctactgctcatttactgggcgtctacccggaagtcccgggtccctgaccgattcagtggcaggcgggtctgggacagtatttcacgtcctacaccatccagcagccgtgcaggctaggaacgngtggtggactagttttacttacgtgtacagtactaagttattacttacttcctcctacgtacgtacgttaccggaccgtaaagggacctaaagggtacgaaacttaccgaaacggttacgtaggtacggacgtcgacctaacccg

SEQ ID NO: 161202 - DNA, 571 bp, Homo sapiens
  misc_feature: GYAE6OF02HCAIQ.22.27.C05.1.454.CMB.1.raw
  modified_base (311)..(311): a, c, t, g, unknown or other
  misc_feature (311)..(311): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcaagaaaccaggacatccctctctactgctcatttacngggtctcgtaccgggagtccggggtccctgaccgattcgagtggcaggcggtcgtgggactagtacttcactctcacgtatcagtcacgcctgcgaggctagaagntggngacttatttatactgtacagactaagttacttaattacttacctccgtacaacggttaccgttacggacccgtaaagggtaccgtaaaggttacggaaacttaaccgaaacgtaacgttacggtacggtactacgacctacgattaccgg

SEQ ID NO: 161203 - DNA, 898 bp, Homo sapiens
  misc_feature: GYAE6OF02IR67X.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctcggggacatcgtgatgaccagtctccagactcctggctgtgtctctggcgagacgggccaccatcaactgacagtccagccagacgttatttttacagctccaccaataagagctacttagcttggttccagcagaaccaggacatcctcctctactgctctatttacgtcgggtcgtaccgtacccgggtaacgtcccggggtcctcggtaaccgtgttacgacggttcggactaacggtccggggttcgtacggggtaacctacggtacgtttaccgaccgtttacctaccgaaccgttactccgaacggtccgtaacggtcccgttacggaccgtacgggtacccttagggaaaccggttacgttacgggttaccgggtaccgtttaacggtttttaaccgttaccggtttacggttaccgtaaaccggttacgtttaaaccgttttaacgttttaaccggtttaaaccgttttttcccccgtaacccgggttttaaacccgtaacgggggtttttaaccccgggtttacccggggaaaccccggtttaaaacccgggggtaacccgggttttaaaaacccggggggttttaaaccggggttaaaaaaaccccggttttaacccccggggtttaaaaaaaacccgggtttaaccccggggttttttacgggggttaaacccccgggggtttaaccccggggtttaaaccggtttaccccccggggtttaaaccccgtttttaaacccccggggg

SEQ ID NO: 161204 - DNA, 555 bp, Homo sapiens
  misc_feature: GYAE6OF02H20OT.22.27.C05.1.454.CMB.1.raw
  modified_base (256)..(256): a, c, t, g, unknown or other
  misc_feature (256)..(256): n is a, c, g, or t
  modified_base (435)..(435): a, c, t, g, unknown or other
  misc_feature (435)..(435): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagcctccaccaataagngctactagcttggttccagcagaaaccaggacatcctcctctactgctcatttactgggcgtcgtacccggaagtcccgggtccctgaccgattcagtggcaggcgggtctgggacagtagtttcactctccaccatcagcacgcctgcaggctagaagatgtggcttagttatacgtntcagctaattattactactttcctactacagtaccgtttacggacgtaaacgggaccgtaagggtaggaaacgtaccgaaaacgtacgtaggtacggtacgtacgccgtaacccttaacg

SEQ ID NO: 161205 - DNA, 535 bp, Homo sapiens
  misc_feature: GYAE6OF02FPNQC.22.27.C05.1.454.CMB.1.raw
  modified_base (420)..(420): a, c, t, g, unknown or other
  misc_feature (420)..(420): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccacaataagagctacttagcttggttccagcagaaccaggacatcctcctctactgctctatttactgggctcgtacccgggtaagtcccggggtccctgacccgtattcagtcggcagcgggtctgggacagtatttccactctcacctatcagcagcctgccaggctagaagtntgtgctagtttatctgtacagactaatagttatacttcctctctagtaccgttcgaccgaacgggtaccaaggtacgaaatacgaaacgtactaggtaggctacgacctactacg

SEQ ID NO: 161206 - DNA, 594 bp, Homo sapiens
  misc_feature: GYAE6OF02F3ZFO.22.27.C05.1.454.CMB.1.raw
  modified_base (268)..(268): a, c, t, g, unknown or other
  misc_feature (268)..(268): n is a, c, g, or t
  modified_base (323)..(323): a, c, t, g, unknown or other
  misc_feature (323)..(323): n is a, c, g, or t
  modified_base (452)..(452): a, c, t, g, unknown or other
  misc_feature (452)..(452): n is a, c, g, or t
tcagacatacgcgtcacgaccggtgctcgatttagacgcgatcgaagggtttgggggctacaacaggcaggcaggggcagcaagatggtgtttgcagacccaggtcttcatttctctgttgctctggatctctggtgcctccggggacatcgtgattgacccagtctccagactccctggctgtgtctctgggcgagagggccaccatcgaactgcaacgtccagccgagagttatttttacagcctccaccaataagagctacttancttggttaccagcagaaacaggactagtccctcctactactgactcgatttacgngggtcgtcgtacccgggaactccgggggtccctaggaccgtattacgagtacggcaggcgggtactgggacagtactttcgactcgtacacctatacacgacacgcctgacacgggctagaagtattgnggtactagtttaactactcgtacagtacctaagttaattataccttctacctatacgtacgttacgaccgaagggaccctaagggtacgaaacgtacgaaacgtacgtggtaggtacctacggacccgtacgtacgttaccg

SEQ ID NO: 161207 - DNA, 758 bp, Homo sapiens
  misc_feature: GYAE6OF02JC37Z.22.27.C05.1.454.CMB.1.raw
  modified_base (327)..(327): a, c, t, g, unknown or other
  misc_feature (327)..(327): n is a, c, g, or t
  modified_base (519)..(519): a, c, t, g, unknown or other
  misc_feature (519)..(519): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgaggacgggccaccatcaactgcaagtccagccagtacgttatttttacagctaccaccaatagagtctacttagtcttcggttccagacaacgaaaccaggacactcctcctactactgctctatttacgngggtacccgttaccgtacccggggtaacttcccgggggtccctacggacccgtattcgaaggttcggccgtagggccggggttacgtacgggggacctaacggtacttttcccgaccgttaccgtacccaccctactaccggtacgaccgtaacgtcccgttgaccgtacggtaccggttacgtaaaacggngttacgggttacgggaccttaacggttttaacttacgttcggtaccgacgtaacgttaacttaacgtttaacgttacctttcccgtacccttacgtaaccgggttaacccggttaccgggtaaccggtaaacggggtaaccccggttaaaggggtaaccggttaaaacgttaacccgttaaaaacccggtaacgggttacggttaacgggacccgttacggtaccccggacttaaccgg

SEQ ID NO: 161208 - DNA, 556 bp, Homo sapiens
  misc_feature: GYAE6OF02F6RSW.22.27.C05.1.454.CMB.1.raw
  modified_base (309)..(309): a, c, t, g, unknown or other
  misc_feature (309)..(309): n is a, c, g, or t
  modified_base (391)..(391): a, c, t, g, unknown or other
  misc_feature (391)..(391): n is a, c, g, or t
  modified_base (411)..(411): a, c, t, g, unknown or other
  misc_feature (411)..(411): n is a, c, g, or t
  modified_base (436)..(436): a, c, t, g, unknown or other
  misc_feature (436)..(436): n is a, c, g, or t
  modified_base (548)..(548): a, c, t, g, unknown or other
  misc_feature (548)..(548): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttacngggcgtctacccgggaatcccgggggtccctgaccgattcagtggcagcgggtctgggacagatttcactctcgaccatcancagcctgcagggctgaagtntggtggctagtttatactgtcacgntaatatttatactttccctctacaagttaccggttccgaccgtaacgggacctaaaggggtcgaaaatacccgaaaacgtaaccgttggacgggtacctaggacctaaccgntttacccg

SEQ ID NO: 161209 - DNA, 575 bp, Homo sapiens
  misc_feature: GYAE6OF02GR4F1.22.27.C05.1.454.CMB.1.raw
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaaccaataagagactacttagcttggttccagcagaaaccaggacatcctcctctactgctcatttactgggcgtctacccgggactccggggtccctgaccgattcgagtggcagcggtctgggacagtattcactctcaccatcagcagcctgcaggntgaagntggtcggtctagtttatacgtgtacgagactaattattactatttacccttcctcgtaacgtaccggtttacggaccgtaaacggggaccgtaagggtacggtaaaacgtaccgaaaaccggtaacgttacggttcgggaccttacggacctaaccagttacccgg

SEQ ID NO: 161210 - DNA, 580 bp, Homo sapiens
  misc_feature: GYAE6OF02FGPCB.22.27.C05.1.454.CMB.1.raw
  modified_base (308)..(308): a, c, t, g, unknown or other
  misc_feature (308)..(308): n is a, c, g, or t
  modified_base (370)..(370): a, c, t, g, unknown or other
  misc_feature (370)..(370): n is a, c, g, or t
  modified_base (485)..(485): a, c, t, g, unknown or other
  misc_feature (485)..(485): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcagtccagccagagttatttttacagctccaccaataagagctacttagcttggtccagcagaaccagacatcctcctctactgctcatttacngggtcgtcgtacccgggtaatccggggtccctgaccgtattcgaggtggccaggtcgggtcngggacacggtatttccactctccacctatcagtcagccctggaccaggctagaagtatggtcgacttagtttattacgttcgtacagtactaattattacttacttcctaccgtntacggtaccgtttcggaaccgtaacgggaacctaagggtaacgtaaactaccgtaaaaccggacgttaggtcggtactaccggtacaccttaacg

SEQ ID NO: 161211 - DNA, 700 bp, Homo sapiens
  misc_feature: GYAE6OF02I0XQX.22.27.C05.1.454.CMB.1.raw
  modified_base (317)..(317): a, c, t, g, unknown or other
  misc_feature (317)..(317): n is a, c, g, or t
tcagacatacgcgtcacgaccggtgctcgatttagacgcgatcgaagggtttgggggagctacaacaggcaggcaggggcagcaagatggtgttgtagacccaggtcttcatttctctgttgctctggatctctggtgcctccggggacatcgtgatgacccagtctccagactccctggctgtgtctctgggcgagagggccaccatcaactgacaagtccagccagagtatttttacagtcctccaacaactaagagactactagcttggtccagcagaaaccaggacactcctctctactgcctactatttacngggtactcgttaacccgggaagtcccggggtcctcggaccgtacttcgagttcggcgaggtcgggtcgtacgggactaaggtactttaccacgttctaccgtaccagttccaaggcctaacggcccgttaggaccgaggggtcctttacgggaaaggtattcggggttacgtacgttaaggttttaactttaacgcgggttacaacgaccttaaactttaaatttacttaaccttttcccgttaccctaaggtaaaccggttacccggtttaccgggaaccgtaacggggtaaacccaaaggggttaaaccgtaaagtaaccggaaaacccgtaggttaccggttacgggaccttacgggaaccgtaaccctaagtttcccgg

SEQ ID NO: 161212 - DNA, 684 bp, Homo sapiens
  misc_feature: GYAE6OF02FFMFI.22.27.C05.1.454.CMB.1.raw
  modified_base (119)..(119): a, c, t, g, unknown or other
  misc_feature (119)..(119): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
  modified_base (446)..(446): a, c, t, g, unknown or other
  misc_feature (446)..(446): n is a, c, g, or t
tcagacatacgcgtcacgaccggtgctcgatttagacgcgatcgaagggtttgggggagctacaacaggcaggcaggggcagcaagatggtgttgcagacccaggtcttcatttttctnttgtctctggagtctctggtgctccgggtacgatcgtgatgtaccacgtctcctagactccctcggctgtgtctctgggtcgagagggccaccactcaactcgcaacgtaccgacgccgacgagttaatttttttaactacgaccttcctaaccaaagttaaagagccttaactttagtcttggttttacccgacgcaacggaaaaccacgggacacttacctccctctaactgtctcctattttacgtcggggcgtacctaacccggggatacccgggggtcctgaccgngtttacnggtggtccagtcggggtctcgggactagntttccactcctcaaccctatcgacgcacgtcctcggacacggtcgtacgaaggtattggtacggtactaagtttatttaacgtcgtactagtactaagttaactttattaacttttccctccttacgacggttaaccggttcccggttaccggaaaccgggtacggtaaacgggtaaggtaaaaccgttacgaaaccgttaacgtcggttcggtaccgttcgtacctaccgtattacg

SEQ ID NO: 161213 - DNA, 749 bp, Homo sapiens
  misc_feature: GYAE6OF02JNFOI.22.27.C05.1.454.CMB.1.raw
  modified_base (510)..(510): a, c, t, g, unknown or other
  misc_feature (510)..(510): n is a, c, g, or t
tcagacatacgcgtcacgaccggtgctcgatttagacgcgatcgaagggtttgggggaggcgtacaacaggcaggcaggggcgagcaagatggtgttgcagacccaggtcttcatttctctgttgctctgatctctgtgcctacgggacattgtgatgacccagtctccagactccctggctgtgtctctggcgagagggccaccatcaactgcaagtccagaccagagttatttttacagtctccaccaaataagtaagttacttagtcttggttccagtcaagaaaccaggaactatcgtctgccactgcctctaatttaccgtgggtccgtcgtaaccccgggaacgttcccggggtaccctcggacccgtacgttccgtaacggttggacctagggccggggttaccgtagggggacctaagggtcttttaaccgcgttactacccgaacctacgtcctaacggtcctaacggcccttagaccgaacgggtctacgggaaaacggnttttacggggcggtacttaacggtttttaagttaactttcgaccggtaactaccggtaaaattttagtttaaaccgttttcccttcttaaccccgttagaacccgttaacgggttttacccgggaaccgtaaaccgggggtaacccttaaaggggtaaccggaaaactttaacccggaaaaaccgttaaccgtttgggtaccgttaacccggtacggtaacccgtaaccgttaacccgg

SEQ ID NO: 161214 - DNA, 797 bp, Homo sapiens
  misc_feature: GYAE6OF02I6W5P.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgaggacgggccaccatccaactgcaagtccagccagtattattttacacgcctaccaacctaataagtagttacttagtctttacggttccagactaacgaaaacctaggaactacttccgtaccttgacctacgtcgtcctactaacgttttaccggtcggggtaccgttacccggttaaccccggggtaaccggttcccccgggggttaccctacgggtaaacccgtacgtttaccggaaggtcggggtaccgtacggggtccggggttacggtacgggggaaccgtaaggttaacgttttcccgaacgttacccgtacctaaacccgtacgtaccgtaacggtaccgaaccggtcccgttacggaccgtaacgggtaccgtaaggtaaacgtaaggttcgggtcggtaacgtttaacgttttaatttacgtacggttacgaacgtacgttaaaagtttactttaacgttacctttcccgttacctaacggtaacggttaccggtttaccggaccggtaaacgggtaacccgtaagggtacgaaacgttaaccgaaaacggtacgttacggtacggacctaggaccctacgtgtttaaccgg

SEQ ID NO: 161215 - DNA, 590 bp, Homo sapiens
  misc_feature: GYAE6OF02G81SE.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagttacttagcttggttccagcagaaaccaggacatcgtctgcactgctctatttacgtgggtcgtccgtacccgggaacgttccccggggtccctggaccgtattcgaggtcggcaggcgggtctgggacagtattccgactctacaccatcagcagcctgcgaggctaggaagtgttggtgtacttagtttacttagttcgtacagtacttaattaattattaccttcctcctactacggtccgttacggaccgtaacgggtaccgtaagggttacggtaaactaccgtaaacgtaccgttacggtacggaccttacgaccctaccgtagttacccg

SEQ ID NO: 161216 - DNA, 609 bp, Homo sapiens
  misc_feature: GYAE6OF02JDJX5.22.27.C05.1.454.CMB.1.raw
  modified_base (413)..(413): a, c, t, g, unknown or other
  misc_feature (413)..(413): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttattttacagctccaccaataagagctacttagcttggttccagcagaaaccaggacatcctcctctactgctcatttacgtggcgtaccgtaccgggaatcccggggtcctgaccgtatcagtggcagcggtctgggacagtattcactctacacatcgagcagcctgcacggctagaagtntggtacgtactagttttaactaccgttagtacgtagactaaagttacttataaccttccctaccctagtaacgttaccggtttaccggaaccgtaaacggggtaacccgtaaaaggggttacggtaaaaacttacccgaaaaacggttacgttaccgggttaacgggtaccctacgggttacccaaccgttaaccg

SEQ ID NO: 161217 - DNA, 546 bp, Homo sapiens
  misc_feature: GYAE6OF02ILPZO.22.27.C05.1.454.CMB.1.raw
  modified_base (316)..(316): a, c, t, g, unknown or other
  misc_feature (316)..(316): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgaggagggccaccatcaactgcaagtccagccagagttatttttacagctccaccaataagagctacttagcttggttccagcaagaaaccaggacatcctcctctactgctctatttacngggtcgtccgtaacccgggaagtcccggggtccctgaccgtatcgagtcggcaggcggtctgggacagtacttcactctacacatcagcagcctgcaggctaggaatagtgtgactagtttactatgtacagtactaattattatacttcctcgtacagtccgttacgaccgtaacggacaacggtagtaaacgtacaaaaccgacgtagtaggacctgacctacgtacg

SEQ ID NO: 161218 - DNA, 791 bp, Homo sapiens
  misc_feature: GYAE6OF02IGHZL.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagagttatttttacagtcctccaaccaataagagctacttagtcttggttccagcaagaaaccaggacactcctcctctactgctactatttacgtggtccgtcgtaccccgggtaacgttcccggggtacccctggacccgtagttccgaggtcggcgtacggccgggttcgtcggggtaactacgtacttttccgacttcccgtaccaccgtattccgaacgtccgtaacgccgttacggaccgtacgggtacctaaggaaacgttacgtttacggtcggggtaccttttaaggtttttaacgtttaccgttacgggttaaccgaacggtttaaccctaaagtttttaaatttaacttttaaacccgttttaccccgttaacccgtttaccgttaaccgggttaacccgggtttacccgggtaaccccgggttaaaaccgggggtaaaccccggttaaagggggttaaaccgggtaaaaacgttaaaccccggtaaaaacggttacccggtttaagggttaccgggtaacccgttaccgtacccgtaaacccgtttaacccgg

SEQ ID NO: 161219 - DNA, 559 bp, Homo sapiens
  misc_feature: GYAE6OF02G53MS.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagtctccaaccaataagagctacttagcttggttccagcaagaaaccaggacatcctcctctactgctctatttctgggcgtacgtacccgggaatcccggggtcctcgaccgtattccgagtggcgtaggcgggtcgtggggactagtactttcgactctacaccgatcagcagccctgcaggcctagaagtatggtagctagtttactactgtacagtcaattatattacttcctactactacgtaccggttcgacgtaaacgggacctaagggtacgaaacgtacaaacggtactcggtacgctacgacctactacg

SEQ ID NO: 161220 - DNA, 716 bp, Homo sapiens
  misc_feature: GYAE6OF02FS5TI.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagacgggccaccatcaactgacaacgtccacgccagtagttactttttacacgtcctaccaacctaataagacgtactacttagtccgtttggttaccaggacaacgaaaccgaggaacctactccctaccgtcctactcgtcctcctacgtttacgtcgggtccgttaccggtaacccgggtacgtcccggggtcctacggtaccgtacgtcgaggtcggcgtacggtccgggtcgtacgggtactaggtactttccgacctccgtaccgtacctagtccaacgtcgaccgtcctggactacgggtacgtaggaaggtacgtcgggttacggtaacgtttacgtttttaatacgttacgttaacgagttacctaaaatttactttactttaccgtttccctacgttaacgaccggtttaccggttacggaacccggtaagggtaaacccgtaagggtaaacctaaacgttaaccgtaaaccggtacggtcggtaccggtactacgaaccttccgttacg

SEQ ID NO: 161221 - DNA, 537 bp, Homo sapiens
  misc_feature: GYAE6OF02IRHQW.22.27.C05.1.454.CMB.1.raw
  modified_base (348)..(348): a, c, t, g, unknown or other
  misc_feature (348)..(348): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
  modified_base (389)..(389): a, c, t, g, unknown or other
  misc_feature (389)..(389): n is a, c, g, or t
  modified_base (410)..(410): a, c, t, g, unknown or other
  misc_feature (410)..(410): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccacaataagagttactagcttaggtccagtcagaaaccaggacatcgtcctgcactgctcatttactgggcgtcgtacccgggaagtccggggtccctgaccgnttcagtgcagcggtntgggacagtattcactcncacatcancagcctgcaggctagagatgngctagtttatacgttgtctagactaattattactatttccccgtctacgtagtacccgttgggacccaagggacctaagggtacggaaactcgaaaacgtacgtggtacgcgttagaccacgtaacg

SEQ ID NO: 161222 - DNA, 498 bp, Homo sapiens
  misc_feature: GYAE6OF02IYS6U.22.27.C05.1.454.CMB.1.raw
  modified_base (406)..(406): a, c, t, g, unknown or other
  misc_feature (406)..(406): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttactggcgtcgtaccgggaatccggggtccctgaccgattcagtggcaggcgggtctgggacagatttcactctcacatcagcagcctgcaggctgaagntgtgctagttntattgtnagcaattattatattcctctcagtacgttcgcaagggccaaggtagaatacgaacgactggtgactgcacgtac

SEQ ID NO: 161223 - DNA, 783 bp, Homo sapiens
  misc_feature: GYAE6OF02IE161.22.27.C05.1.454.CMB.1.raw
  modified_base (344)..(344): a, c, t, g, unknown or other
  misc_feature (344)..(344): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatcgacccagtctccagacctccctggctgtgtctcgtgggcgaggacgggcccaccatcaactgacaacgtccagccagtagttactttttacagcctaccaaccgaataagagcttaacttagtcgttaggttccccaggtacaaacggaaacccaggtaactacctacccttcccgttacttaccncgtcctaccttaacgttttaccgtcgggtaccgttacccggtaccccggggtaaacgttccccgggggtacccctacggacccggttacgttaccggtacggttcgggacctacgggtccggggttacgtacggggacctaaacgttacgtttccacgtttcctaccaacccgtactaccgacgtaccgaacggtcctacggaccgggtaggaccgttaacggaaaggttacgttagggttacggtaaccgttaaggtttttaaacttaccgttcgggttacctaacgggtactaacgtttaacgtttacttacctttacccgtcgttaaccgtaacggttacccggtttacgggaacccgttaaacggggaacctaagggttaacgaaacgttaccgaaaagttaccggttgtaccggtaccgtaggaccaccctacg

SEQ ID NO: 161224 - DNA, 597 bp, Homo sapiens
  misc_feature: GYAE6OF02I8HTY.22.27.C05.1.454.CMB.1.raw
  modified_base (163)..(163): a, c, t, g, unknown or other
  misc_feature (163)..(163): n is a, c, g, or t
  modified_base (224)..(224): a, c, t, g, unknown or other
  misc_feature (224)..(224): n is a, c, g, or t
  modified_base (256)..(256): a, c, t, g, unknown or other
  misc_feature (256)..(256): n is a, c, g, or t
  modified_base (315)..(315): a, c, t, g, unknown or other
  misc_feature (315)..(315): n is a, c, g, or t
  modified_base (374)..(374): a, c, t, g, unknown or other
  misc_feature (374)..(374): n is a, c, g, or t
  modified_base (400)..(400): a, c, t, g, unknown or other
  misc_feature (400)..(400): n is a, c, g, or t
  modified_base (410)..(410): a, c, t, g, unknown or other
  misc_feature (410)..(410): n is a, c, g, or t
tcagacatacgcgtcacgaccggtgctcgatttagacgcgatcgaagggtttgggggagctacaacaggcaggcaggggcagcaagatggtgttgcagacccaggtcttcattctctgttgctctggatctctggtgccgtccgggacatcgtgatcgacccngtctccagactcccgtggctgtcgtctcgtggcgagacggccaccatcacgtgacacgcanccagtattacttttacagtctaccaccaaganagtacctagtacgtcttcggttaccaggacacgaaccacggtacacgtcctcctctacncgctctattacgtcgtcgaccgtacgtaccggtccggtcctatcccggtatcgacgtgngtcgtagtcggacgctagtcgttccnctctctacgncgcgacgtcgtcgtcgtcgacgtacgtacgtacgtagtcgtacgtacgttacgttacgtacgtcgtacgtacgtaacgtacgtacgttaacgtacttacgtacgtacgtacgtcgtacgtacgtaccggtaacgtaacggtacgtacgtaacgtacgtacgtacgtacgtcgtacgtactacgtacg

SEQ ID NO: 161225 - DNA, 585 bp, Homo sapiens
  misc_feature: GYAE6OF02IOHRF.22.27.C05.1.454.CMB.1.raw
  modified_base (407)..(407): a, c, t, g, unknown or other
  misc_feature (407)..(407): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctccctggctgtgtctcgtgggcgagagggccaccatcaactgacaagtccagccagtagttatttttacagctccaacaataagagttacttagcttggtccagcaagaaaccaggacatcctcctctactgctctatttacgtgggccgtcgtacccgggaatcccgggggtcctcgaccgtattccgaggtcggcgaggcggtcgtgggacagtattcactctacactacncagcacgcctgacacgggcttcggaaatcgttggtcgactagttttactacgtgtacagtactaatattattaccttcctacctacgtaacgtaccgttacgaccgtaagggtaccgaaagggtacgtaaactaccgaaacgtaacgttgacgggtactcggacctaccgtattaccg

SEQ ID NO: 161226 - DNA, 634 bp, Homo sapiens
  misc_feature: GYAE6OF02GM7LS.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgaggacgggccaccatcaactgcaagtccagccagagttatttttacagcctccaccaataagagctacttagcttggttccagcaagaaaccaggaccatcctcctctactgtcctctatttacgtgggtcgtaccgtacccgggtaacgttccccggggtccctacggacccgtattacgaggttcgcgtacggcggtcgtagggacagtacttcactctacacactcagcacgtcctgcgacggctagaagtactggtacggtacgttagtttacgttacgttcgtacgtaacgtactaaatttaacgtttatttacctttccttacccttacgtacgtaccggttaccggaaccgtaaccgggtaacgtaaacgggtacggtaaaacttaccgaaaccggtacgttggtacgtccgtacgtaccgtaccgttacg

SEQ ID NO: 161227 - DNA, 591 bp, Homo sapiens
  misc_feature: GYAE6OF02I8VWC.22.27.C05.1.454.CMB.1.raw
  modified_base (584)..(584): a, c, t, g, unknown or other
  misc_feature (584)..(584): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgaaccagtctccagactccctggctgtgtctcgtgggcgaggagggcccaccatcaactgcaagtccagccagtagttatttttacagcctccaccaataagagctacttagcttggttccagcagaaaccaggacactccctcctctactgctcactttactgggcgtccgtacccgggtaacgtcccggggtccctcggaccgtattcgaggtgcaggcgggtcgtgggacagtacttccactcctccaccatcagcaacgtcctgacgaggcctagaacgagttggtacgtacgtaagttttacttaacgtgttaccaagtacctaaattattacttacttcccttacctcgtagtaccggttcgacccgaacggaaccgaagggtaacgaaactaacgaaacgacgtcgtagcctagacctaccngttaccg

SEQ ID NO: 161228 - DNA, 780 bp, Homo sapiens
  misc_feature: GYAE6OF02IBKTK.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccacatcaactgcaagtccagccagagttatttttacagcctccaccaataagagctacttagcttggttccagacacgtaaacaggacactccctctctactgctctatttacgtgggcgtccgtacccgggaacgttcccggggtccctaggacccgtacttcgaacggttcgggactacgggtccggggtacggtcggggaacgtagttactttccgaaccgtttcctacccgaaccgtaacttccgaaacgtcccgtaacggtcccgttcggtacccggaagggtcccgttaaggaaaacggttacggttcgggttacgggtaccgttttaaaggtttttaacgttaaccgtttggttaaccgtaaggtaacccttaaaagtttaaccttttactttaaaccgtttcccctttaccgttaaccgtaacggttaccccggtttccggggaacccgtaaaccgggggaaccgttaaacggggttaaccgggtaaaacgttaaacccccggtaaaggttaacccggtttagggttaaccgggtaacccgttacggtacccccgtaacggtttaacccg

SEQ ID NO: 161229 - DNA, 623 bp, Homo sapiens
  misc_feature: GYAE6OF02H09FB.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgacaagtccagccagagttatttttacagcctccaaccaaataagagctaacttagcttggttccagcagaaaccaggacatcctcctctactgctcattttacgtgggtccgttcgtacccggggtaacgtcccgggggtcccctggtaacccgattcgaaggtcggcaggcgggtcgtggggacagtatttcactctcaccatcagcacgcctgcagggtctaggaagatggtggacttagtttacttacgtcgttacgacgtactaaatttacgttaattacctttccttccctacgtaacggttaccggttacgacccggtaaagggaacccgttaagggtaacggtaaaacttacccgaaaaccggtaacgttcggtacggtaccgtacggacctaaccgttacg

SEQ ID NO: 161230 - DNA, 517 bp, Homo sapiens
  misc_feature: GYAE6OF02H3CKV.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgctcatttactgggcgtctacccggaatcccggggtcctgaccgattcagtggcagcgggtctgggacagatttcactctcacatcagcagcctgcaggctagaagatgtggactagtttactacgtgtcagctaattattatacttcctctacagtacgttcgaccgaagggacctaaggtgaaatacgaaacgtacgtgtacgctgccactacg

SEQ ID NO: 161231 - DNA, 658 bp, Homo sapiens
  misc_feature: GYAE6OF02JBN0O.22.27.C05.1.454.CMB.1.raw
  modified_base (311)..(311): a, c, t, g, unknown or other
  misc_feature (311)..(311): n is a, c, g, or t
  modified_base (430)..(430): a, c, t, g, unknown or other
  misc_feature (430)..(430): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgacaagtccagccagagttatttttacagctaccaaccaataagagtctacttagtcttggttccagacagaaaccaggacactccctcctctactgctntatttacgtgggcgtcgtacccgggacgtcccggggtccctgaccgtattcgagtcggcgtaggcgggtcgtggggactaggtatttccgacttcctcaccatcaacgcacgcctgacncgggtctaggaaacgtgttggtcggtacttaggtttattagtcgttcgtaagtactaaagtttattaactaccgttttacccttccgtaccgtaacgttaccgggttacccggaccgtaacgggtaacccggtaaaggggttaaccggtaaaacgttaaccggtaaaaccgttaacggttcgggttaaccggtactaacccgggtacctacccggtaactttacccgg

SEQ ID NO: 161232 - DNA, 623 bp, Homo sapiens
  misc_feature: GYAE6OF02IYK16.22.27.C05.1.454.CMB.1.raw
  modified_base (364)..(364): a, c, t, g, unknown or other
  misc_feature (364)..(364): n is a, c, g, or t
  modified_base (450)..(450): a, c, t, g, unknown or other
  misc_feature (450)..(450): n is a, c, g, or t
  modified_base (474)..(474): a, c, t, g, unknown or other
  misc_feature (474)..(474): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgacaagtccagccagagttatttttacagtcctaccaccaataagagctacttagcttggttccagcagaaaccaggacatcctcctctactgctactatttacgtcggtcgtccgtacccggtaacgtccggggtccctcggtaccgtnttcgaggtcggcgtaggcgggtcgtgggactagtacttcactctacgacctactacacgctacgtccgtgcgtaggcctagaagtntcggcgtacttaagtttactacgngttaccgagtaccttaaattactttacttaactttcccgttacaacgtacgtttaccgtccgaaccgttaagggaacccgtaagggttaacgaaaccttaaccggaaaccgtagttcgggtaccggtacttacggaccctaccgttacg

SEQ ID NO: 161233 - DNA, 580 bp, Homo sapiens
  misc_feature: GYAE6OF02JKBLP.22.27.C05.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
  modified_base (320)..(320): a, c, t, g, unknown or other
  misc_feature (320)..(320): n is a, c, g, or t
  modified_base (390)..(390): a, c, t, g, unknown or other
  misc_feature (390)..(390): n is a, c, g, or t
  modified_base (458)..(458): a, c, t, g, unknown or other
  misc_feature (458)..(458): n is a, c, g, or t
tcagacatacgcgtcacgaccggtgctcgatttagacgcgatcgaagggtttgggggaggctacaacaggcaggcaggggcagcaagatggtgttgcagacccaggtcttcatttctctgttgctctggatctctggtgcctccggggacatcgtgatgacccagtctccagactccctggctgtgtctcgtgggcgagngggccaccatcaacctgcaagtccagccagtagttactttttacagctaccaccaataagagctacttagcttcggtcagcacgaaaccngactactcctcctctactgctcatttacgnggctacgtacccgggatcccggggtcctggaccgtattcgagtcggacaggtccggtcgtagggacagtntttaccacgtctacaccatcaacggcacgtctgcaggtctagaagtagtcggtagtacttaagttttntaacctgactacgtatattaattaccttattcccgtctaccgacgttaccggttacgaaccggacggtaacgtaagtacgtaactactaaacggctttaggcctgtaccgtaccacgttacg

SEQ ID NO: 161234 - DNA, 690 bp, Homo sapiens
  misc_feature: GYAE6OF02JED0W.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatgacccagtctccagacctccctggctgtgtctcgtgggcgagacgggccacatacaactgacaacgtccacgaccaagtaagttatttttacacgtcctaccaaccaaataagacgactacttagtcgttcggttaccaagacaacgaaaccacggaacactcctcctctactcgcctactacttacgtcgggcgtaccgtacccgggtacgtccgggtccgtacgaccgtactacgaggtcggacgacggtacgggtacgtacgggaacgtagtacgttactacctaccgtaccaaccgtactacgacgcctacggtacccgtagaccggaggtaccgtaaggtaacgtagttagggtcggttaacgttaacgttttactacgtaacgtacgtaaacgtactaaagttacttacgtttaacccttccgtacctacgtacggtaaccgtaccggaaccggaaacgggtaacgtaaaggtacggtaaaacgtaacgaaacgtcgtacgacggtaccgtacgtacctacgtacg

SEQ ID NO: 161235 - DNA, 716 bp, Homo sapiens
  misc_feature: GYAE6OF02JQ9X0.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccacgatcaactgcaagtccagccagagttatttttacagcctccaaccaataagacgtctacttagtcttggttccagtacaagaaaccaggacacttcctcctctacgtgtcctactactttacgtcggtccgtaccgtacccgggtaacggtcccgggtaccctcggaaccgtcgttacgagttcggacgtacggccgggttacgtcggggaactaggtacctttacgaccgttccgttaccgaacctaacggttacaaacggtcccgacgtacccgttcggaacgttacgggccgttaaggtaacggacgtttgggtaaccgtgttaaacgtttttacgtacttcgggttacaacggtacctaaatttacgtttaacttctttacccgtacttacgacgttaacccggttcggaacccgtaaacgggacccgtaaaggggttaccaaaacgttaacccaaacgggtaacgttaccgggtacgacccgttacgggaccctaacccgtttag

SEQ ID NO: 161236 - DNA, 534 bp, Homo sapiens
  misc_feature: GYAE6OF02FKXS0.22.27.C05.1.454.CMB.1.raw
  modified_base (410)..(410): a, c, t, g, unknown or other
  misc_feature (410)..(410): n is a, c, g, or t
  modified_base (442)..(442): a, c, t, g, unknown or other
  misc_feature (442)..(442): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggtccagcagaaaccaggacatcctcctctactgctcatttactggcgtctaccgggaatccgggtcctgaccgattcagtcggcaggcggtctgggacaggtattcactcgtcacctatcagcagcctgcaggctgaagatgnggcagtttatactgtcagtcaaattgttaatnttaccctctactagtaccgttcggaccgtaacgggtaccaaggttacggaaataccgaaacggtacttggtacggtactacgactacgtacg

SEQ ID NO: 161237 - DNA, 533 bp, Homo sapiens
  misc_feature: GYAE6OF02FOTGH.22.27.C05.1.454.CMB.1.raw
  modified_base (311)..(311): a, c, t, g, unknown or other
  misc_feature (311)..(311): n is a, c, g, or t
  modified_base (413)..(413): a, c, t, g, unknown or other
  misc_feature (413)..(413): n is a, c, g, or t
tcagacatacgcgttcacgaccggtgctcgatttagacgcgatcgaatggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgctcatttacngggcgtcctaccgggaatcccggggtcctgaccgtattcgagtggcagcgggtctgggacagtatttcacgtctcaccatcagcacgcctgcaggctagagntgtggtactagtttatagttcgacagactaattattaattacttcctactgacgtacgttacggaccgaagggtaccaaggtaggaaactacaaacgtactggtaggactgaccactacg

SEQ ID NO: 161238 - DNA, 603 bp, Homo sapiens
  misc_feature: GYAE6OF02IXN7J.22.27.C05.1.454.CMB.1.raw
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcaagaaaccaggacatcctcctctactgctcatttactgggcgtctacccgggatcccggggtccngaccgnttcagtggcagcgggtctgggacagactttcgactctcaccatcagcacgccgtgcaggactggaagtacgtgttcggcttaaggttttacttacgttggtacctagtacctaaagttattttactacgtttccttacccttacacggttacccgttacgggacccgtaaacggggtacccgtaaaggttacgggtaaaacttacccgaaaacgggtaacttacgggtcggtaccttacggacccgtacctaacgg

SEQ ID NO: 161239 - DNA, 605 bp, Homo sapiens
  misc_feature: GYAE6OF02ICQ7C.22.27.C05.1.454.CMB.1.raw
  modified_base (289)..(289): a, c, t, g, unknown or other
  misc_feature (289)..(289): n is a, c, g, or t
  modified_base (384)..(384): a, c, t, g, unknown or other
  misc_feature (384)..(384): n is a, c, g, or t
  modified_base (418)..(418): a, c, t, g, unknown or other
  misc_feature (418)..(418): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagactacttagcttggttccagcagaaaccagganactcctcctactactgctctatttacgtggccgtcgtacccgggaagtcccggggtcctggaccgtattcgagtggcagcgggtctgggacagtnttcactctcaccatcagcagcctgcagctagagntggtggcttagtttactacgtgtacagtcaaagtttattattacgttccctaccgtacgtaaccggtacgtttaccggaacccgtaacggggtaacccgtaaagggttaccggaaaactttaaacccggtaaaaccggtaccttaacgggttacggtacccgttacggacccggtaacccttaacgg

SEQ ID NO: 161240 - DNA, 632 bp, Homo sapiens
  misc_feature: GYAE6OF02FUEAW.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctccctggctgtgtctcgtgggcgagagggccaccatcaactgcaagtccagccagagttatttttacagctccaccaataagagctacttagctttcggttccagcaagaaaccaggacatccctcctctactgctctatttactgggcgtaccgtacccgggtaacgtcccggggtccctcggaccgtattcaggtggcaggcgggtctgggacagtacttcactctcaacctactcagccacgcccgttgacgtacggcctaggaacgtacgtgggtggtaccgttaagttttactttaccgtcgttacgagtaccgtaaagttatttacttaactttccctacttcgtaaccggttaccgttaccgggaccgtaaaccggggtaaccgtaagggttacggtaaacgttaccgaaaaccgtacgttacgggacggtactcggtacctacgttaccg

SEQ ID NO: 161241 - DNA, 597 bp, Homo sapiens
  misc_feature: GYAE6OF02IKI73.22.27.C05.1.454.CMB.1.raw
  modified_base (315)..(315): a, c, t, g, unknown or other
  misc_feature (315)..(315): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaaccaataaagagttacttagtcttggttccagacaagaaaccaggacatcgtctgcactgctcatttacgnggtccgtcgtacccgggaacgttcccggggtccctacggaccgtattcgagtggcgaggcgggtcgtgggacagtatttcactcctcacatcagcacgcctgcaggctagaagtagtgtaggcttaagtttattattagtacgaagtactaaattattaacttacttacccttacctacgacgtaccggttacccggacgtaaacgggtaccgtaaacgggttaacggaaacttaaccgaaaccgtaacgttcggtacggtcctacggaccacgtacgtccg

SEQ ID NO: 161242 - DNA, 805 bp, Homo sapiens
  misc_feature: GYAE6OF02III0T.22.27.C05.1.454.CMB.1.raw
  modified_base (263)..(263): a, c, t, g, unknown or other
  misc_feature (263)..(263): n is a, c, g, or t
  modified_base (313)..(313): a, c, t, g, unknown or other
  misc_feature (313)..(313): n is a, c, g, or t
tcagacatacgcgtcacgaccggtgctcgatttagacgcgatcgaagggtttgggggaggctacaacaggcaggcaggggcagcaagatggtgttgcagacccaggtcttcatttctctgttgctctggatctcgtggtgccgtccggggacatcgtgatgacccagtctccagactccctggctgtgtctcgtgggcgaggagggccaccatcaactgcaacgtccagccagagttatttttacagcctccaacaataaganactacttagtcttggttccagcaagaaaccaggacactccctcctctacngcctactacttttacgtcgggtaccgtaccgtaacccgggtaacgttcccgggggttcccctacggaacccgtacgttccgaggtcggccgtacggtcgggggtccgtaggggaactaggtactttaccacctttcctacgaccctaattcccgaagacctaacggtccgtacggtaccgacgggtccgttaagggaaacggtaacggtttcgggtacgggtaacgttttaaacggtttttaacgtttaaccggtttggttaacccgtaaacggtaaacctttaaaagtttaaacgtttaattttaaccccggttttaccccttaacccgttacccgttaacggttaaccccggggtttacccgggaaacccgggttaaaccggggtaaacccgggttaaagggttaacgggtaaaaaccttaaacccggaaaacggttaccggtttacgggtacggtacccgtttacggtaccctaacccgtttaacccgg

SEQ ID NO: 161243 - DNA, 716 bp, Homo sapiens
  misc_feature: GYAE6OF02GA4WZ.22.27.C05.1.454.CMB.1.raw
  modified_base (310)..(310): a, c, t, g, unknown or other
  misc_feature (310)..(310): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgaggagggccaccatcaactgcaagtccagccagagttatttttacagctccaccaataagagctacttaagctttcggttcctagcacgaaaccaggacactcctcctctactnctactattacgtcggtcgtaccgtaccgggaacgtcccgggtcctacgaccgtattcagtcggcacggcggtcgtagggactaggtactttcgaccgtcctaccgacctacgtaccgtacggccgtacgtacccttgggaccgtacgggtacttaacgggaagttaaggttccggttagggtacccgtttaaggttttactttaccggttcgtacccgtaaagtaccttaaatttaacggtttaacctttaacgtttcccctacccgttaacgttaaccggtacccgggtttacccgggaaccggtaaacggggtaacccggtaaaacggggtttacgaaaaccttaacggtaaaacccggtacgtacgggttaccgttacggttaccgaccctaaccgttaaccg

SEQ ID NO: 161244 - DNA, 711 bp, Homo sapiens
  misc_feature: GYAE6OF02GXC9V.22.27.C05.1.454.CMB.1.raw
tcagacatacgcgtcacgaccggtgctcgatttagacgcgatcgaagggtttggggggcgtacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccagtcaactgcaagtccagccagtacgtatttttacagtctccacaataagagactacttacgcgttcggttaccaagtcaacgaaccgaggtacactccctcctctactcgctctattacgtgggtctccgtaccggtacgtcccggggtcctagaccgtattcgaggtcggcgaggtccgggtcgtcgggactaggttacttaccgacttctaccacctactccgacgtccaacgtccctagtccgtacgttccgtaggtaacgttactttttacggacctttaacgttttactttaacgtcgttactaacggtaccttaaattacgttaagtacgttacgtttacggtttaccttaacggttaaccgtttacccgtaacccggtttacccgggaaccggtaaacggggtaccgtaaccggttaacggttagggtaaaccgttaaacggtttaaaacccggtacgtttacgggttaccggtaccgttacggacccttaacccgg

SEQ ID NO: 161245 - DNA, 633 bp, Homo sapiens
  misc_feature: GYAE6OF02GW8ID.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagacctccctggctgtgtctctgggcgagagggccaccatcaactgacaacgtccagccagagttatttttacagtctccaaccaataagacgctaacttagcttggttccaagcaagaaaccaggacaatccctacctctactcgtctctactttaccgtgggccgtaccgtacccggggtaacgtccccgggggtccctagacccgtattcgaggtcggcaagggtcgggtactgggacagtactttacactcctacaccataccgagccgtacgccgttggcacgggtctaggaacgtagttgggtcgacttaaggtttacttacgtgtaccgaagtacctaaattattacgtacttccctcctacgtaagtacgttacggaccgtaacggtaaccgtaagggttaagaaacgtaaccgaaaccggtacgtaggtacggtaccgtggaccctacgtcttaccg

SEQ ID NO: 161246 - DNA, 772 bp, Homo sapiens
  misc_feature: GYAE6OF02IB2NL.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactcctggctgtgtctctgggcgagagggccaccatcaactgcaagtccagccagagttatttttacagtcctccaaccaataagagttacttagcttggttccagcagaaacaggacatcgtcctgctactgctctactttacgtcgggtcgtaccgtaacccgggaactcccgggggtacctcggacccgtacgttacgtaacggttcgggacctagggtccggggtcgttacggggaacgtaacggtacttttaccgactttacccgttaccaaccgtacgtaccacggtacctaacggtcccttacggaccgtaacgggtctaacgggaaaggtacgtttacgggttcggtaacgtttaacgggtttttatttaaccgtttcggtaaccgtaacgggttacttaaaacttaagtttttaacgttaaccgttttccccttacccggttaccttaacgggttacccggtttaccgggaacccggaaacgggggttaaccctaaacgggggtttaacgtaaaaaccgttaccgtaaaaaaccgggttaccgttacgggttaaccggtccgttaaccgggttaccctaacccgttaaccgg

SEQ ID NO: 161247 - DNA, 626 bp, Homo sapiens
  misc_feature: GYAE6OF02GR3V0.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctggcgagagggccacatcaactgcaagtccagccagagttatttttacagactaccaaccaataagagactacgttagcgtttcggttaccagtacaagaaaccaaggacctataccctcctactactgcctactactttactcgggtccgtaccgtaacccgggtaacgtcccggggtccctacggaccgtattccgaggtacggaccgaggtcgggtacgtacgggtactacgtattaccacgtctacacctagtaccagacagtcccgtgacgagcgtagaagtgtacgtgacttagtttattacgtatcgagactaagttactaacgttcttaccctactacgtagttacccgtcggaaccgtaacgggacttaaacgggtacgaaacttaacgaaacgtacgttaggacgtacctacgtaccacgttaaccg

SEQ ID NO: 161248 - DNA, 727 bp, Homo sapiens
  misc_feature: GYAE6OF02H0ZYF.22.27.C05.1.454.CMB.1.raw
  modified_base (323)..(323): a, c, t, g, unknown or other
  misc_feature (323)..(323): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctaccacctaaataagagctacttagtcttggttaccagtcaacgaaaccaggacactcctacctctactgctcatttacgngggtccgtcgtaccggactccgggtcctcgacgtatcgagtggcacggtcggtcgtgggacagtactttcgacttcctaccacctatcgaacgtccacgtcctggacgacggtacgtaggaaagtacgtttggtacgggtaccttaagtttttacgttacgttacggttacgaacggttaaccttaaaatttaacgtttaacgtttaacccttttaccccgttaaccgtaccgttaacggggtttacccggtttacccggggtaacccgggtaaaacgggggtaaaacccggttaaacgggggttaaacggtaaaaccgtttaaaccccggaaaacggtttaacccggttacggggttaacccgggttaacccgttaccgggacccttaacccggttaacccgg

SEQ ID NO: 161249 - DNA, 662 bp, Homo sapiens
  misc_feature: GYAE6OF02JGILT.22.27.C05.1.454.CMB.1.raw
  modified_base (250)..(250): a, c, t, g, unknown or other
  misc_feature (250)..(250): n is a, c, g, or t
  modified_base (260)..(260): a, c, t, g, unknown or other
  misc_feature (260)..(260): n is a, c, g, or t
  modified_base (370)..(370): a, c, t, g, unknown or other
  misc_feature (370)..(370): n is a, c, g, or t
  modified_base (395)..(395): a, c, t, g, unknown or other
  misc_feature (395)..(395): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
tcagacatacgcgtcacgaccggtgctcgatttagacgcgatcgaagggtttgggggctaaaacaggcaggcaggggcagcaagatggtgttgcagacccaggtcttcatttctctgttgctctggatctctggtgcctccggggacatcgtgatgacccagtctccagactccctggctgtgtctcgtggcgagagggccaccatcaactgcaagtccagccagagtatttttacagctccacaataanagctacttancttggttccagcagtaaaccaggacatcctcctctactgctcatttacgtgggcttcctacccgggaatcccggggtcctcgaccgatttcagtcggacaggtccgggtntaggggacaggtatttccacgttcnctaccatccagccagcctgcgagcgtanaacgngtggtcgtacgtagtttatactgcaggacctataagtttactacgttaccctccttcgaacggttacccgttacccgggtaaccgtaacggggtaaccgtaaacgggggtttaaacggtaaaccgttaaaaccccgggtaaaacccggttaaaccgtttacgggtttaacccgggtcccggtttaaacggtaacccccggtaaacccttaccgtttaaccggttttaacccggg

SEQ ID NO: 161250 - DNA, 629 bp, Homo sapiens
  misc_feature: GYAE6OF02HDAV6.22.27.C05.1.454.CMB.1.raw
  modified_base (254)..(254): a, c, t, g, unknown or other
  misc_feature (254)..(254): n is a, c, g, or t
  modified_base (278)..(278): a, c, t, g, unknown or other
  misc_feature (278)..(278): n is a, c, g, or t
  modified_base (416)..(416): a, c, t, g, unknown or other
  misc_feature (416)..(416): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgacaagtccagccaagtagttatttttacagcctccaaccaanaagtagctacttagcttgttccancaagaaaccaggacatccctcctcttactgctctatttactcggggtctacgtaaccgggaactcccgggggtccctgaccgtattcgtaggtggcaggccgggtctggggaccagtatttccactcctcaccatcancgcgcccgtagacgtacggactaggaagtacgtggtaggtcgttaaaggttttacttacgtcgtaccagtaactaattacgtttaacttacttccttaccgtagtaccggtaccgtttacggaccgtaacgggaaccgtaaagggttacgaaacgtaacgtaaaaccgtacggttacggtacgggtactacggtaaccctacctagttacccg

SEQ ID NO: 161251 - DNA, 595 bp, Homo sapiens
  misc_feature: GYAE6OF02HOA7N.22.27.C05.1.454.CMB.1.raw
  modified_base (581)..(581): a, c, t, g, unknown or other
  misc_feature (581)..(581): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctgctgtgtctcgtgggcgagagggccacgactcaactgacaagtccagccagagttattttacagctccaacaataagagactactatcgttcggtccagacaagaaccaggacactcctcctctactcgacctctactttacgtcgggtccgttaccgtaacccgggtaaccggttccccggggtaccgtcggaaccgtacgttacgaggtcggacgacgggtcgggtcgtagggactaagtacgtttacacgtctaccacactcgaacgcacgcctagcgagcgagatatcgggtagacttaggtttactagctcgacgtacttaatacttattaccgttccttctacgtacgtacgttccgacgaacggtacgaacggtaggaactacgaaacgtgtcgtcgntaccgactctatcg

SEQ ID NO: 161252 - DNA, 641 bp, Homo sapiens
  misc_feature: GYAE6OF02GBS39.22.27.C05.1.454.CMB.1.raw
  modified_base (255)..(255): a, c, t, g, unknown or other
  misc_feature (255)..(255): n is a, c, g, or t
  modified_base (389)..(389): a, c, t, g, unknown or other
  misc_feature (389)..(389): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataaganctacttagcttggttccagcaagaaaccaggacactcctcctctacctcgccgtactattttacgtcgggtccgttaccgtaacccgggaacgttcccggggtccctacggacccgtattccgaggtcggacgnggtcgggtcgtaggggactagtactttacaccgtctcctacctatcgagcacgcctcgactaggacctagaacggtattcgggtacggtacgttagttttaactaccgttgtaccagtacgtaaattatttacttacctttcctaccttacgtacggtaaccgttccggaaccgtacgggtaaccgtaaacgggttagaaaacgtaaccgaaaacggtaacgttacggacggtacgtacgtacccacgtacg

SEQ ID NO: 161253 - DNA, 826 bp, Homo sapiens
  misc_feature: GYAE6OF02I0MJ7.22.27.C05.1.454.CMB.1.raw
  modified_base (169)..(169): a, c, t, g, unknown or other
  misc_feature (169)..(169): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccanactccctggctgtgtctcgtgggcgagacgggccaccatcaactgcaagtccagccagagttatttttacagtcctaccaaccaataacgagacttacttaagcgtttaggttccagtcaagaaaaccaggaactactccctccttctacttcgactcattttaccgtgggtacgttaccgtaacccggggaacgttccccgggggtaccctacggaacccggtactttccgtaacggtttcggaccgtacgggtacggggttaccgttagggggtaacctaagggttaaccgttttaccaaaccggttcccgtttaccaaacccgttactttaccgaaccgtacccgaaacggtccccttagggacccggaacgggttccgtaacgggaaacggtacggttacgggttacggtaaccgtttaaggtttttaaccgtttacgtacggttaaccgtaagtaaaccgttaaacgttttaatttaacgtttaccctttaccctttacccgtacgtaaccgggttaacccgggtttcccgggaacccgggttaaaccgggtaaacccggtaaggggttaaccgtaaaacgtaacccggttaaaaaccggacgtttacgggtacgggtaccgttacgggaaccctaccggtactttacccgg

SEQ ID NO: 161254 - DNA, 775 bp, Homo sapiens
  misc_feature: GYAE6OF02IGEUD.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagacctccctggctgtcgtctcgtgggcgaggacgggccaccatccaaactgcaacgtccagaccagtagttaatttttacacgctacccaactaaataagagtcttaacttagcgtttcggtaccagacaacgaaaccaggactaactccctactctaacgtgctactactttacgtcggtccgttacgtaacccgggtaacgtcccggggtcccgtacgaccgtcgttcgacgttcgggcgacgggtccgggtacggtacgggaacgtaacggttactttactaaccttcctaccgtaaccttagtccaacggtaccctaggtccgtacggacggaacggtacgtaacggtaagtaccgttacgggtcggtaacgttttaaacgtttttacttaacgtgttaaaccacgttaaacgttaaacgtttaaaactttacgtttaaccctttacccgttacgttaacggtaccggtttaaaccggggttaccgacccgggttaaaaaccggggtaaccggtaaagggtttaaaccggaaaacggttaaacccaaaccggttaacgtggtaacccgggttacaccgggaccttaaccgtacgtttacccgg

SEQ ID NO: 161255 - DNA, 639 bp, Homo sapiens
  misc_feature: GYAE6OF02F5WQA.22.27.C05.1.454.CMB.1.raw
  modified_base (319)..(319): a, c, t, g, unknown or other
  misc_feature (319)..(319): n is a, c, g, or t
  modified_base (352)..(352): a, c, t, g, unknown or other
  misc_feature (352)..(352): n is a, c, g, or t
  modified_base (403)..(403): a, c, t, g, unknown or other
  misc_feature (403)..(403): n is a, c, g, or t
  modified_base (433)..(433): a, c, t, g, unknown or other
  misc_feature (433)..(433): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggcccaccatcaactgcaagtccagccagtagttatttttacagctccaccaataagagctacttagctttggttccagcaagaaaccaggaccatacctcctctactgctcatttacnggctcgtacccggaatccgggtcctcgaccgtntcagtggcagcgggtctgggactagatttcgctcgtacaccgtactcgacncacgtcctgaccgtaggcctagaaacggtntacggtcgggtacttaggttttaactttaccgtagttaccacggtacttaaagttactttaaacttaccgtttaccttacccgttaaccgtacggttaacccggttaccgggtaacccgtaaacgggaaccggtaaacggttaacggtaaaacgtaacctaaaacggtaacgttggtaacggtactaccgtaccgtaccttaaccg

SEQ ID NO: 161256 - DNA, 679 bp, Homo sapiens
  misc_feature: GYAE6OF02JH8TO.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgaggagggccaccatcaactcgcaacgtccagccagagttatttttacagctccaccaataagagactactagcttggttcagtcaaggaaaccaggaacactcctcctactactgctcactttcgtgggtccgtacgtacccggggtaagttcccggggcctacggaccgtatcgtaggtacggcgtacggtcggtcggtacgggtaacgtacgttactttacgtaccgttaccttaccggaacctaacgtcggtaaccgtacccgtacgtacccggttgaacccgggtaggtaccgttaggaaacggtgtttcggggtaccgtacggttaaacgtttttacgtaccggttcgtaacgttacgaacttaacgttatttaacttctttacctctaacggtacgtaccgtcggaaccgacgggtaacgtaagggtacgtaaactaccggtaaatacggtaggtcctaacgggtctaccaccgtacg

SEQ ID NO: 161257 - DNA, 733 bp, Homo sapiens
  misc_feature: GYAE6OF02FJSUU.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagacgctacttagcttggttccagcacgaaaccaggactactcctcctctactgctctagtttacgtgggcgttaccgtacccggggtaacgttcccggggtacccctcgaaccgtattcgaggttcggcgacggtcggggtcgtaggggacagtactttcaccgtctccaaccgtactccgaacgtaccgacggtccctaggtccgaacgggctaacggaaagtacgttcgggttacgggtaccttaaggttttttaattttaacgtttacggttaccgaacggttaaccgtaaaaagttttaagttttaacctttaaaccgttttcccttaacccgtttacgtaacggttacccggttttacccgggaacccgtaaacggggggaaaccccgttaaaggggtaccgggtaaaaactaccggtaaaaaaccggttaacccgttaggtaccgggtacctaccgggtacctaacccttaacg

SEQ ID NO: 161258 - DNA, 631 bp, Homo sapiens
  misc_feature: GYAE6OF02IZ3P3.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgacaagtccagccagtagttatttttacagctccaaccaataagagactactagtctttcggttacagacaagaaaccaggactactcctcctctactcgctactatttacgtgggtccgtaccgtacccgggtaacgtcccggggtccctcgtaccgtacgttcgacggtacgggcctagggtcgggtcgtagggacagtacttcacctctacacctatcacgcacgtccgtcgcgaggctagaagtgtaggtgtactttagtttacttacgtatacagttactaatttacttaactttacttcccgttcctacgtaacggttaccgttacggaccggtaacggtaaccgtaagggttaacgtaaacgtaaccgtaaagtacggttaggtaccggtcgtacgacctacgtcgttaccg

SEQ ID NO: 161259 - DNA, 630 bp, Homo sapiens
  misc_feature: GYAE6OF02HJNUE.22.27.C05.1.454.CMB.1.raw
  modified_base (448)..(448): a, c, t, g, unknown or other
  misc_feature (448)..(448): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagtaattatttttacagctccaccaataagagactacttagcttggttccagcaagaaaccaggacactcctcctctactgctactatttacgtgggtcgtccgtacccgggacgtcccggggtccctcgaccgtattcgtagtcggcgtacggcgggtcgtcggggactagtactttcacttctaccaccatacgacgcacgcctgcgaggcgtagaagtntggtacgtcttagttttactacgttcgtacgtaacgtacgtaaattaacgtttaattacctttccctaccgttactaacggttaccggtttaccgggaccgtaacggggaaccgtaagggtaacggtaaacgtaaccgaaacgtacggttacggacgggtacctacggtaccctaccttacg

SEQ ID NO: 161260 - DNA, 670 bp, Homo sapiens
  misc_feature: GYAE6OF02I4ATV.22.27.C05.1.454.CMB.1.raw
  modified_base (447)..(447): a, c, t, g, unknown or other
  misc_feature (447)..(447): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgaggacgggccaccatcaactgacaagtccacgccagtagttactttttacagtctccaccaataagacgacttacttacgtcttggttccagtacaagaaaccaggacacgtccctcctctactcgctactactttacgtcgggtccttaccggtaacccgggtacgttcccggggtaccctacggaccgtagttcgacggtcggacgtacggtcgggtacgtgggtacagtactttacactctacacctancctagcacgtcctcgcgaggctaggaagtagtcgcggtacctttaggtttacttagttcgtagaacgtacttaagtttaactttacttaaccgtttccctaccgtacgtaacggtttaccggttacgggaacccggttaaccgggtaacgtaacgggttaacggaaacttaaccggaaaaccggttacgtacgggttaccggactacggtaccctacgttacg

SEQ ID NO: 161261 - DNA, 637 bp, Homo sapiens
  misc_feature: GYAE6OF02HOGL0.22.27.C05.1.454.CMB.1.raw
  modified_base (306)..(306): a, c, t, g, unknown or other
  misc_feature (306)..(306): n is a, c, g, or t
  modified_base (340)..(340): a, c, t, g, unknown or other
  misc_feature (340)..(340): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacacgcctccaaccaataagacgcttacttagtcttggttccagcaagaaccaggacatccctctctactnctctattcgtggcgtctaccggactccgggtccncgacgtactcgagtgcgaggcgggtcgtacgggacaggtacttcgacctacgtaccacctagtccaacgccacgtccgtcggtcgaacgggtctaaggaacggtattcgggtacgtacgtttagtttaacgttacgtcgttacgaggtactaagttaactttagtaaccttttccaccgttacgtaacggttaccggttccggaccgaaacggggttaccgaaagggttacggtaaactacccggtaaaacgtcggttacggtacggtacgtaccggtacctaaccgtagtttcccg

SEQ ID NO: 161262 - DNA, 667 bp, Homo sapiens
  misc_feature: GYAE6OF02I51EN.22.27.C05.1.454.CMB.1.raw
  modified_base (259)..(259): a, c, t, g, unknown or other
  misc_feature (259)..(259): n is a, c, g, or t
  modified_base (356)..(356): a, c, t, g, unknown or other
  misc_feature (356)..(356): n is a, c, g, or t
  modified_base (395)..(395): a, c, t, g, unknown or other
  misc_feature (395)..(395): n is a, c, g, or t
tcagacatacgcgtcacgaccggtgctcgatttagacgcgatcgaagggtttgggggaggctacaacaggcaggcaggggcagcaagatggtgttgcagacccaggtcttcatttctctgttgctctggatctctggtgcctccggggacatcgtgatgaccagtctccagactcctggctgtgtctctggcgaggagggccaccagtcaactgcaagtccacgccacgagttatttttacagtctccaccaataaganctactagcttcggttccagcaagaaaccaggacatcctcctctactgctcatttacgcggtctacgtacccgggtaacgtccgggtcctggaccgtntcgagtcggcacggcgggtctcgggactacgtacttacnctctactaccactacagacgacgcctcgcgacgtcgtacggaacgtagtcgtacggtacgttacgtttcttaaaaaccgttcgtacgtacgtacgtaacttaacgttaactttacgtttaccgttaccctacgttacggttaaccggttaccgggtaaccggtaaccggggtaaaccggttaaacgggtaacggtaaaacgttaaccggtaaaaccggttaaccgttacgggtaaccggtaccggtaccggtaaccgtaccgttaaacccgg

SEQ ID NO: 161263 - DNA, 518 bp, Homo sapiens
  misc_feature: GYAE6OF02IPWB2.22.27.C05.1.454.CMB.1.raw
  modified_base (404)..(404): a, c, t, g, unknown or other
  misc_feature (404)..(404): n is a, c, g, or t
tcagacatacgcgtcacgaccggtgctcgatttagacgcgatcgaagggtttggggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctctctactgctcatttactggcgtctaccgggatccggggtcctgaccgattcagtcggcagcggtctgggacagatttcactctcacatcagcagctgcaggctagaagtntgtgactagtttatactgtacagctaaattattatctttcctctcagtaccgttacgactaacgggccaaggtacgaaactacgaaacgtcgtagtacgactagtaccactacg

SEQ ID NO: 161264 - DNA, 658 bp, Homo sapiens
  misc_feature: GYAE6OF02IV5BM.22.27.C05.1.454.CMB.1.raw
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaaccaataagagtctacttagcttggtccagcaagaaaccnggacatcctcctctacngctactatttacgcgggtcgtaccgtaaccgggtacgtcccgggtcccgtacgtaccgtattccgtaacggtcggacaacgggtcgggttcgtacggggtaacaggttactttaccgacctttcctacacccatacgagcacgtcctgacgacgtccgtagaagtagtggtacggacttagttttaactacttcggacagtactaaattaacgtttagtacctttcgtaccctagtacgtaccggtttaccgaccgaaacggggtaaccgttaaaagggtaagtaaaccgttaaacgaaaacccggttacgttacgggttaaccggacgttaaccgtacccgtaaaccttaaccg

SEQ ID NO: 161265 - DNA, 638 bp, Homo sapiens
  misc_feature: GYAE6OF02ITLH4.22.27.C05.1.454.CMB.1.raw
  modified_base (632)..(632): a, c, t, g, unknown or other
  misc_feature (632)..(632): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgaccagtctccagactccctggctgtgtctctgggcgagacgggccaccatcaactgcaagtccacgccagagttatttttacagtctccaccaataagagctacttagcttcggttccagcaacgaaaccaggacactccctcctctactcgtcctctactttacgtcgggtcgtccgtacccgggtacgtcccgggggtccctcgtaccgtacttcgaggtggcctaggtcgggtacgtgggtacgtacgtacgtttcgaccttccgtacgacctactcaacgcacggtccctgtaccgacgggtcgttacggaaagtaggttgggtacggtacttaaggttttaactttccgtacgggtactacggaacttaacgttattaacttacttccgtactacgtacgtacggttcggaccgtacggaaccgtagggtaacaactacgaaccgtaatcggtacgacgtcgactaccgtnttaccg

SEQ ID NO: 161266 - DNA, 735 bp, Homo sapiens
  misc_feature: GYAE6OF02GXAE6.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctacgtgggcgagacgggccacatcaactgacaacgtaccagccaggagttatttttacagtcctccaaccaataacgagctactagtcttaggttaccagtacaagaaacctaggactactccctcctctacgtcgactactatttacgtcgggtacctacgttaacccgggtaacggtcccggggtaccctaggacccgtacttaccgaggtcggaccgtacgggtaccgggttacgtacggggaactaacggttaactttccgaccttccgtactaccgaactaccgaacggtacaaccggtccgtacgtacgacgggtactaacggtaacgtaggttacggtacggtacgttaaggttttactaacgttgtaccgtaaggtaacttaaacggtttactttaacgttactttacccgtacgttaaccgaacggttaccgggtttaccgaaccggtaaacgggtaacccggtaagggtaaaccgtaaaacgtaccgtaaaaccgtacgttaacggtcggtaaccgttacgaccgtaacctagtttaccg

SEQ ID NO: 161267 - DNA, 663 bp, Homo sapiens
  misc_feature: GYAE6OF02GFBI5.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagaggccaccatcaactgcagtccagccagagttactttttacagcctccaccaataagacgactacttagtcttcggttaccagcaagaaaccgaggacactccctcctctactcgtcctctatttacgcgggtccgtaccgtaaccccgggtaacggtcccggggttccctacggtaccgtacttcgagtcggcgacgggtcgggtcgtacgggacgtagtactttcacttccgtccaacctacgtccgaagtccacgtcccgtgccgtaagggcttaggaagtagttggtacggtcttaagtttttacttagtttacgacgtagtactaaagtttacttacttacgtttccccttacgtaccgttaacgtaccgggttaccggacccggtaagggtacccgtaaagggttaacgaaacgttaaccgaaaggtacttgggtaccgtcgtacgtaccctacgtcgttcg

SEQ ID NO: 161268 - DNA, 777 bp, Homo sapiens
  misc_feature: GYAE6OF02JDTHV.22.27.C05.1.454.CMB.1.raw
  modified_base (198)..(198): a, c, t, g, unknown or other
  misc_feature (198)..(198): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatgacccagtctccagactcctggctgtgtctcgtggcgagnggcccacgatcaactcgcaacgtccacgccaagtagtttactttttacacgctccaaccgaataagacgctacttagtcttggttaccagcaacgaacagacactcctcctactactcgctctatttacgtcgggtccgttaccgtaacccggggtacgttccccggggtaccgtaccggaccgttacgttacgtaacgggtcggacgtaggtcccggggtctacggggactacgttactttccaacgtttcctaccgaacctcttaccgagtaccgtacggtcccgttgaccgtacggtccggttaagaacgttggttacgggttacgaccgtttaaagtttttacgtaaccgtttcgtaaccggacttaacgttaaactttttaacttacgtttaaccccgtttttcctaccccggttaagtaaccgggtttaaccccgggtttagggaaacccccggtaaaggggttaaaccccgaaacggggtttaaacgggtaaaaaccctaaccgggttaaaaacccggttcggttacggggtacctttaacccgggtcgtaaaccccgttacgttaacccgg

SEQ ID NO: 161269 - DNA, 812 bp, Homo sapiens
  misc_feature: GYAE6OF02G9T2E.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatgacccagtctcagactccctggctgtgtctcgtggcgaggaggccaccatcaactgacaacgtccagaccagtagttatttttacagtcctaccaaccaataacgagtacttacttaacgtctttacggttacccagccaacggaaaacccacgggaaccacttacccttcccgttacttaaccgtggccttactaacttttacgtcggggtcccgttccggtaaccccggggtaacgttccccggggggttccctacggtaacccggttaacgttccgtacgggttccgggacgtaacgggtccgggggttaccggtacggggaccgtaggttaacgttttcccgacctttccgtacccaacctcgttaccgacgtaccgtaccggtcccggttacgacccgtagggtcccgtaggtaaacgttaggtacggttcgggaacctttaggttttaacgttttaccgtagttacccgggtaactaccgttaaagttaactttacttttaaccctttccccttaccggtttaccgtaaccggtttacccggttaccgggtaacccgtaaaccgggggtaccgtaaaacggggttacgtaaaccgtaaccggtaaaccggttacgtacgggttaaccgcgtacgtacctaccgttacg

SEQ ID NO: 161270 - DNA, 631 bp, Homo sapiens
  misc_feature: GYAE6OF02GTDSV.22.27.C05.1.454.CMB.1.raw
  modified_base (304)..(304): a, c, t, g, unknown or other
  misc_feature (304)..(304): n is a, c, g, or t
  modified_base (601)..(601): a, c, t, g, unknown or other
  misc_feature (601)..(601): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagcctccaaccaataagagctacttagctttggtccagcaagaaaccagacatcctcctactacngtctctatttacgtgggtctccgtacccgggtacgtcccgggtccctagaccgtattcgagtcggacacggtcgggtctacgggacagtatttaccacgtctacaccgatcagtccacgtcccgtacgcgacggtactggtaacgtagtagtcggttaccgttagttttatttacctgttaccaggtaactaattttaatttacttaaccgtttccgttacttccggtaacgtccggttacggtaaccgtaacgggtaccgtaaacgggtacgtaaaaccgtagaaacccgttacgnggtttaccgactacggtaccaccgttaacg

SEQ ID NO: 161271 - DNA, 603 bp, Homo sapiens
  misc_feature: GYAE6OF02G0F1Q.22.27.C05.1.454.CMB.1.raw
  modified_base (259)..(259): a, c, t, g, unknown or other
  misc_feature (259)..(259): n is a, c, g, or t
  modified_base (456)..(456): a, c, t, g, unknown or other
  misc_feature (456)..(456): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgaggagggccaccatcaactgcaagtccagccagagttatttttacagctccaaccaataaganctacttagcttggttccagcaagaaaccaggacatcctcctctactgctactatttacgtggcctccgtacccgggaacgtcccggggtccctggacccgattcgaggtggcaggtcggtcgtcgggacagtactttcactcaccaccatccgagcgacgccctgacacggctagagtatgtaggctagtttatcgngtacgagtactaattagttacttaccgtttcctacttacgtacgttacccggttccggaaccgtaaccgggtaaccggtaaacgggtacggtaaaacgttaccgaaaacggtacttagggtccgtaccgttaggccctaacgtaccg

SEQ ID NO: 161272 - DNA, 634 bp, Homo sapiens
  misc_feature: GYAE6OF02I3LTW.22.27.C05.1.454.CMB.1.raw
  modified_base (242)..(242): a, c, t, g, unknown or other
  misc_feature (242)..(242): n is a, c, g, or t
  modified_base (619)..(619): a, c, t, g, unknown or other
  misc_feature (619)..(619): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgaggacgggccaccatccaactgcaagtccagccagagttatttttacngcctaccaccaataagagtctacttagtcttggtccagcagaaaccgagactactcctcctctacgtcgtcctactacttttaccgtggggtaccttaccggtaaccccgggtaacgtccccggggttacccttacgacccggtacgttccgaacggttcggaccggtcggcggggttccgtagggaccgtagttaactttccgacctccttaccgacccgtacttcgaggtcccacgtcccgtagcgacgggtcgtagaacgtagtggttacggagtttatttactacgtgactatactaattattcttacttcctcgtcgtacgtaccgttcgacgtaacggtacgaagggtacaacgtacaacgtatgacgtcncgtacgcctgtaccg

SEQ ID NO: 161273 - DNA, 708 bp, Homo sapiens
  misc_feature: GYAE6OF02G37SZ.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagacctccctggctgtcgtctcgtgggcgaggacgggccacatcaactgacacgtccacgccagtagttatttttacacgtcctaccaaccaataagacgtactacttacgtcttggtccagacaagaaacaggacactccctcctactactcgcctactacgtttacgcgggtacgtaccgtaccgggacgttcccggggtcctacggtaccgtacttacgaggtcggacgtacgggcgggttcgtgggaactagtactttaccactcctaccacctatcgtacgacgtacgtcctggacgtacgggtacgtagtaaacgtaggttggtagggttactttaacgtttacgttacgtacgtacgtaagttaaccttaagtttaactttacgttacctttccttacctacgttaaacgggttaccggttacccggaccggtaacgggtaacccggttaacgggtaacgttaaaacgtaccggtaaaacgggtacgttacggtaccggttccgttaaccgtacccgtaccgttagttacccgg

SEQ ID NO: 161274 - DNA, 616 bp, Homo sapiens
  misc_feature: GYAE6OF02GH2P2.22.27.C05.1.454.CMB.1.raw
  modified_base (315)..(315): a, c, t, g, unknown or other
  misc_feature (315)..(315): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcaagaaaccaggacaatcctcctctactgctcatttacgnggcgtcctacccgggaatcccggggtccctgaccgtattcgagtggcaggcgggtctagggacagtactttcactcctcacctatcacgcacgtcccgtgaccgtaggtctaggaaagtgtggttaggcctttaagtttacttaccgtgtacaagtcctaaagttactttatacgtttcccctacttacgtaacgtaccgtttccggaaccggtaaacgggtaccgtaaagggttaacggtaaaactaccgaaaaccggttacgtcggttaacggacctttacggacctaacccgttaacg

SEQ ID NO: 161275 - DNA, 670 bp, Homo sapiens
  misc_feature: GYAE6OF02FLSXZ.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagacgctacttagctttggttccagcagaaaccaggacactccctcctctactgctctacttttacgtcgggtcgttcccgtaaccccggggtaacgttccccgggggtccccttacggtacccgtattccgaggttcggaccgtacgggtccggggtccgtggggaacctaggtactttccgtaccgttcctccgacctactccacgacacggtcccgttagcgacgggctaggaacgtagtggtcggtactaggttttatacgttcgtacgagtacctaaattacttaactttaccttcccttacctgtaccggtaccggtttccggaaccgtaaacgggtaaccgtaagggttaacgtaaacgtaccgtaaaacggtacgttacggtacggtactccggtacctaccgttaaccg

SEQ ID NO: 161276 - DNA, 612 bp, Homo sapiens
  misc_feature: GYAE6OF02G0E4X.22.27.C05.1.454.CMB.1.raw
  modified_base (446)..(446): a, c, t, g, unknown or other
  misc_feature (446)..(446): n is a, c, g, or t
tcagacatacgcgtcacgaccggtgctcgatttagacgcgatcgaagggtttgggggcgtacaacaggcaggcaggggcgagcaagatggtgttgcagacccaggtcttcatttctctgttgctctggatctctggtgccgtccggggacatcgtgatcgacccagtctccagactccctggctgtgtctcgtgggcgaggacgggccaccgatcaactgacaacgtccagccagagttattttacagctaccacaataagacgctacttagctttaggtccagcaagaaaccaggacactacctccactactcgctctactttacgcggtctaccgaacccgggtacgtcccggggttccctacggtaccgtatttccgaacggttcgggcacgggtcgggtcgtacgggaactacggtactttcgacctcgtacacctagtacngactacgccgtacgcgacggctaagggaatacgtggtccgtataggtttaactcgtgtacgtagaccttaatagttactaactttcccaacgtctaacgtacgttcgacgtaacgaccgtaaggaggtaacaacgttaacgagtctaggcgtaccgctacagtccg

SEQ ID NO: 161277 - DNA, 873 bp, Homo sapiens
  misc_feature: GYAE6OF02FPQA1.22.27.C05.1.454.CMB.1.raw
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatcgacccagtctccagacctccctggctgtgtctcgtgggcgaggacgggccaccactcaactgacaagtccanaccagtagttatttttaacngcctaccaacctaataagagaccttaacttacggtcttcggttaccagacaaacgaaaccgaaggaactactcccttccttactaccgttcgccttctacgttttaaccgtcggggtaccgttacccgttaacccggggtaacgttccccggggggttacccctacgggtaacccgttacgtttccggtagggttacgggccggtacggggtcccgggggttaccggttacgggggaaccgtaaggttaaccgtttttaccgaacccgtttcccgttacccgaacccgttcgtaccgtaaccggccgtaaccggtcccgtacgggtaccggtacgggtaccggttaaaggaaacgggttacggttacgggttacgggttaccttttaaacgggttttaactttacgtttacgggtaacctaaacggtaacctttaaagtttacgttttaactttaacccttttacccgttacccttacggttaaccggttacccgggtttaccgtaacccgggtaacggggtaaccggtaaacggggttaacgtaaacccggttaacgtaaacccggtaacgtttacgggttacggtacccggttacggtacccttaacccgtagttttacccg

SEQ ID NO: 161278 - DNA, 727 bp, Homo sapiens
  misc_feature: GYAE6OF02GCFNK.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcattctctgttgctctggatctctggtgcctccggggacatcgtgatgacccagtctccagacctcctggctgtgtctcgtggcgaggagggacccacatacaacgtgcaacgtccacgccgagacgtttatttttacacgtcctaccacctaaataagacgtacttacgttagtcctttagggttccaggctaaacgaaaacccgtaggacctaacgttcccctccgtaccttactcgtacctacttaacgtttaccgtggggtcccgttaccggtaacccgggtaacggttcccggggtccgtacggtaccgtacgttccgtagggtcggcgtaaggtccgggttgtacgggaactagttactttacgccgtactcgaccctataccgagacaacggtcccgtgacggtaaggtcctaaggtaacgtagttcgtaacggtcgttacgttttaactacggttcgtaacgagtaactaaagttttccttaacgttcctttacccacgtactaaccggttcgggtaacccgcggtaaaccgtaacggttaaaggtaacggtaaacttaaccggtaaaagtaccggttggtaccgtccggtaactaccgtaccgttaacg

SEQ ID NO: 161279 - DNA, 624 bp, Homo sapiens
  misc_feature: GYAE6OF02GWUKH.22.27.C05.1.454.CMB.1.raw
  modified_base (280)..(280): a, c, t, g, unknown or other
  misc_feature (280)..(280): n is a, c, g, or t
  modified_base (306)..(306): a, c, t, g, unknown or other
  misc_feature (306)..(306): n is a, c, g, or t
  modified_base (317)..(317): a, c, t, g, unknown or other
  misc_feature (317)..(317): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatgacccagtctccagactccctggctgtgtctctgggcgagagggccaccatcaactgcaagtccagccagagttatttttacagctaccaaccaataagagactacttagcttggttccagcanaaaccaggacactcctcctctactcnctcatttacgngggtcgtacgtaccgggacgttcccggggtaccctcgccgtattacaggtcggcgaggcggttcgtagggacgagtacttcactccactaccgataccgacgtcacgccgtagcgaggactacggaagtattcggtaggtattacgtttagttctggtacaacgttacaagtttactttaattacttaccttaccgttcgtaaacgtccggttaaccggacggttaaacgggtaaccgtaaagggtaagtaaacctaacgtaaaacgtacgttacgggtcggttaccgtaacgtacgtacctagtcg

SEQ ID NO: 161280 - DNA, 782 bp, Homo sapiens
  misc_feature: GYAE6OF02IP8EX.22.27.C05.1.454.CMB.1.raw
tcagacatacgcgtcacgaccggtgctcgatttagacgcgatcgaagggtttgggggcgtacgaacaggcaggcaggggcgagcaagatggtgttgcagacccaggtcttcatttctctgttgctctggatctctggtgcctccgggacatcgtgatgacccagtctccagactccctggctgtgtctctgggcgaggaggccaccgatcaactgcaacgtccagccaagagttatttttacagtactccgaaccaagtaacgaacgacttaacgttagtaccgttggttaccacgacaagtaaaccgaggaacctaacgtccctacctactaacctgtcctacttacttacgtcgggtaccgttccgtaacccgggtacgtaccccgggggtaccctcggtaccggtaacttaccgacggttacggacgtagggaccggttcgtacgggaccgtagtacgttttaccgacttaccgtaccgtaaccgtactaccgtaacggtccgaacgtcccgtaggtaaccggcgggtaaccgtaggtaaacggtaaggttacggtcgggttaacgttaccgttttaaaggtttccgtacgttacggtaacgtacgttaaacgtttaacgtttaacgtttaccctttccgtttacccgtacgttaaccgggtacccggtttaccggaccggtaaaccggggtaccggtaaaccgggttaaggtaaacccgtaacgtaaaaccgtaacggttacgtaccgggtataccggtaccctaactaccgttaccg

SEQ ID NO: 161281 - DNA, 719 bp, Homo sapiens
  misc_feature: GYAE6OF02HCTQP.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctccctggctgtgtctctgggcgagagggccaccatacaactgcaaagtccacgccagtagttaatttttacagtctacctaaccaaataacgagtacctaacttagactttcggttaccaggtacaacgaaaaccaggactaatccctcttacctactgcctctactttacgcggtccgtaccgtacccgggtaacgtcccgggtcctacgaaccgtagtctaggtcggtacgaggtacggggtctacggggaactacggtactttcgaaccgtttcctaccaaccgtacgtaccgacgtaccgtacgtaccgtacgaccggtacggtactaacggaaacggtaacgttgggtacgtacgtttaaacgttttaacgtttacgttacgtaccgtaaggttacctaaagtttaactttaactttaacttccctaaacgttccgtaaagtcccggtttaccgggaccgtaaacgggacggtaaacggttaacggaaacgttaaaccgaacgtaaccgtacggtagggacctggtaccctacgttaacg

SEQ ID NO: 161282 - DNA, 655 bp, Homo sapiens
  misc_feature: GYAE6OF02FU2WB.22.27.C05.1.454.CMB.1.raw
  modified_base (471)..(471): a, c, t, g, unknown or other
  misc_feature (471)..(471): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctcgtggtcgccgtccggggactatcgtgatgacccagtctccagacctcccgtggcgtgtgtctcgtgggcgaggacggccaccatcaactgaccagtccacgccagtagtttatttttacgacgtcctaccaacctaagtaacgacgtcttaacttacgtcgtttcggtaccagtaccaacggaaaccgaaggactactccctcctactactgcctactaacgtttacgtacggccttaccggaccggtacggttcccggtccgtacgacgtacgtcgacgtgcgacggtcggtcgtggactagtacttacgacgtcacgactagtcacgctacgcgtncgtagcagaagtgtacggtacgtcttagtttactatcgtacgacgtacgtaaattacgttaacgtacctttaccgtaccttacgaaccggttacgttaccgggaaccggaacggttaacggaagggttaaactaaaccgtaacgaaacgtcgtacgggttccgacgttacgaccctagttaccg

SEQ ID NO: 161283 - DNA, 636 bp, Homo sapiens
  misc_feature: GYAE6OF02F4YNN.22.27.C05.1.454.CMB.1.raw
  modified_base (254)..(254): a, c, t, g, unknown or other
  misc_feature (254)..(254): n is a, c, g, or t
  modified_base (281)..(281): a, c, t, g, unknown or other
  misc_feature (281)..(281): n is a, c, g, or t
  modified_base (389)..(389): a, c, t, g, unknown or other
  misc_feature (389)..(389): n is a, c, g, or t
tcagacatacgcgtcacgaccggtgctcgatttagacgcgatcgaagggtttgggggctacaacaggcaggcaggggcagcaagatcggtgttgcagacccaggtcttcatttctctgttgctctggatctctggtgcctccgggacatcgtgatgacccagtctccagactccctggctgtgtctctgggcgagagggccaccatcaactgcaagtccagccagagtatttttacagcctccaccaataaganctacttagtctggttcagcagaaaccnggacatccgtctctactgctcatttactgggtcgtctacccgggaatcccgggtcctcgaccgattcgagtgacgagcgggtctggacagtatttcactctcaccgtntacgagctaggacccttggacctaagggcctaggaaacgtgttcggtacgggacttaggttttaactcggttagttacgtaacgggtctaaaagtttaccgtttaaagttcctttaccccgtacctacgtaaacggtcccgttttacgggaccgaaacggggtaccctaaaggggttacggaaaaccttacgaaaaccggttaaccgttgggtaccgtaccgtacggtaccctaccttacgttcccg

SEQ ID NO: 161284 - DNA, 657 bp, Homo sapiens
  misc_feature: GYAE6OF02F4SB2.22.27.C05.1.454.CMB.1.raw
  modified_base (458)..(458): a, c, t, g, unknown or other
  misc_feature (458)..(458): n is a, c, g, or t
tcagacatacgcgtcacgaccggtgctcgatttagacgcgatcgaaggtttgggggtcgtacaacaggcaggcagggcagcaagactggtgttgcagacccaggtcgttcgattctctcgttgctcgtcggatctctggtgacctccgggacatcgtggactgacccaggtctccgagactccctggctcgtgtcctcgtggccgagagggccaccgatcaactgcaagtccagcccagaggtatttttacgagctccaccaactaagagctactagcttggttccagtcagaaaccaggactaatcctccgtcctactgctcactttactggcgtctacccgggaatccgggtcctgtaccacgttcagtcgccacgcggtacgtgggaccagttacgtttcgacgtacttcgaccgtactcaacgcacgccgttagcctaagggtctggtaaacgngttgtcggatagtttacgttaacctgttacgacggttactaagttaacgttttattaaccgtttcccgtacctaaccgtagttaacccggtttaccgggacccggttaaacgggtaccccgtaaagggttacgggaaaccgtaccggtaaaaccgtaacgttcggtaacgtccgtacgtaccgtaccaaccgttcccgg

SEQ ID NO: 161285 - DNA, 857 bp, Homo sapiens
  misc_feature: GYAE6OF02IGY6K.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatcgacccagtcctccacgacctccctggtctgtgtctcgtgggcgaggacggccaccatcaactgcaacgtccacgaccagtacgttactttttacgacgtacctaccaacctaaataagacgtcttacgttagctttcgggttaccacgtaccgaagaaaaccgtagggaacctacttacccctacccgttcccttaacctcggtaccttactaacttttaccggtcgggtacccgttaccgtaaccccggggaaccggttcccccggggggtccctaccggtacccgtattaccgtagggttcgggccgaagggtcccgggttcggtaacggggccttaaacggtacttttccgaccttaccgtacccgaacctaccgtagtaaaccggccgttaaacggcccggttacggaacggacgggtaccgttaagggtaaacggtacgttcggggttacggaacgttttacgggttttaacttactacgggtacctaaacggtaagtaaacttttaacgtttaactttaccgtttcccttaccgttaccggtaaccgggttacccgggttacccgggtaaccgggtaaaccggggttaaccggtaaacggggttaaggaaaacccgttaaacccgtaaaacggttaaccccggtagggttaaccgggttccctaaccgggtaccgttaacccgtagtttacccgg

SEQ ID NO: 161286 - DNA, 984 bp, Homo sapiens
  misc_feature: GYAE6OF02GOW0B.22.27.C05.1.454.CMB.1.raw
tcagacatacgcgtcacgaccggtgctcgatttagacgcgatcgaagggttgggggcgtacaacaggcaggcaggggcgagcaagatggtgttgcagacccaggtcttcatttctctgttgctctggatctctggtgccgtccgggacactcgtgatgaccagtctccagactccctggcctgtgtctcgtgggcgagacgggccaccactacaactcgcaacgtaccacgccgagacgttacttttttacagtaccttccaaccgaaagtaacggactacctaacgtttacgtacgtttcggtttacccaacggtctaaacggtaaaaccaacgggaaacctaaccgttccccttcccgtaccttaaccgtccggtccttacgtacttttaaccgtcggggtaccgttacccggttaacccggggtaaccggtttccccgggggttacccgtacggtaaaccccggttcgttaaccggtcgggtttacgggaccgttaacggggtcgggttacgggtaccgggtacgtaaacgggttccttttacctacccgtttaccgttacacgtttacccggtaacttaccggaacgttacccgtaaccgtcccgttgggtacccgtaacggccggttaaagggttaacccgttaaggtcccggggtttagggtaacccgttttaaagggtttttaaacgttttaaccccgggtttggtttaaccccaaagggttaccgtttaaaaaccctttaaggttttaaaccctttaaaccggtttttcccccctttaaacccgttacgggtttaaacccggttaacccgggtttaccgggtttaaccccgggtaaaaaacccgggggtaaccgggtttaaaccgggtaaacggggttaaaaacccttaaacccgggtaaaaaccccggtttaacgggttacccgttttaacgggggtaaccttccccgggtaaccggtttaaccttaaccccggg

SEQ ID NO: 161287 - DNA, 868 bp, Homo sapiens
  misc_feature: GYAE6OF02G4OA8.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgacaagtccagccagtagttactttttacacgcttaccaacctaataagtacgttacttagtcttaggttccagacacgaaaccaggactagtcgtcctacggctactcgtctactactttacgcgggtaccgttccgtaacccgggacgttcccggggtaccctacggacccgtattccgaggtcggacgaggtcggtcgtcggacgtacgtactttaccgacgtccgtaccaacctactcgtaacgccgtaacggtcccgtaacggccgtaacgggtctaaacgggtaaacggtacgtttcgggggtacggttaacccgtttaaggttttttaacgttttaaccggtttttaccgggtacgaaaccgggtttaacggtaaaactttttagtttttaaaaccggtttacccttttaccctttaccccgggttttaaacttccgggggtttaaaccccgttttaaccgggggaaacccccgggtttaaagggggaaaaccccggtttaaacgggggttaaaacgggtttaaaaccccggtaaaacccggggtttaaaaaaccccgggtttaacgggtttaccgggtttaacccgggttcccggtaacccgggtttaaacccccttaaccccggtttaacgttttaacccccggg

SEQ ID NO: 161288 - DNA, 569 bp, Homo sapiens
  misc_feature: GYAE6OF02GSNM2.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctctatttactggctctacccggaatccgggtcctgaccgattcagtggcagcggtctgggacagtattacactctcacatcagtcagcctgcaggctagaagtagtgtgactagtttatacgtgtacagactaaacttattaacttacttccctacctacgagtaccgtttcggaacccgtaaagggaacccgtaaagggttacgtaaaacgttaaccgaaaaccggtaacgttacgggtacggacgttacggacctaaccgtaacg

SEQ ID NO: 161289 - DNA, 685 bp, Homo sapiens
  misc_feature: GYAE6OF02G8PI5.22.27.C05.1.454.CMB.1.raw
  modified_base (533)..(533): a, c, t, g, unknown or other
  misc_feature (533)..(533): n is a, c, g, or t
  modified_base (544)..(544): a, c, t, g, unknown or other
  misc_feature (544)..(544): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgcctgagtctctgtgtccgtccgggtacgactcgtgagtcgaccacgtctccacgacctcctcgcgtgtgtctcgtcggcgagacggacgaccacgtacactacgtacaacgtaccacgacgacgtaagttacttttaacgtacgacctaccaacctaaacgtaagagtcttaacgtacgttcgttacgttacgacgactaacgaaaccgaagactactcctccctactactgactactacttacgtcggtaccgtacccgtaccggaacggttcccgggtcctacgaccgtaacttacgacgggtcggtacggaggtccgggtccggtaggactacgtacgttactaccgtcaccgaccgatacgacgacgctaccgcgagacgtagtaacgaaggtacgttgtaccggtnttaaaccgttntttacgagtcaagtaactattacgtttaacttccgttacctcgtatacggtaccgttacggaccgaaacggttaacgaaggttaacgaaaccttaacgaaccgtagttcggtacggtaccgacctaacggaccttagtccg

SEQ ID NO: 161290 - DNA, 820 bp, Homo sapiens
  misc_feature: GYAE6OF02I3IVP.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatgacccagtctccagactcctggctgtgtctctggcgagaggccacatcaactgcaacgtccagccagagttattttacagtctaccacctaaataagacgtctacttagctttggttacccagtcaagtaaaaccaggtacaacgtccctaccttcgtaactcggccttctaagttttacgcggggtaccgttaccgtaaccccgggtaagttccccgggggttaccctacggtaacccggtatttacccgaaggttcgggtaccaacgggtccgggggttacgtacgggggtaacctacggttaacttttacccgacgttaccgttacccgtaaaccctaacgtttcccaacgggtaccgtaaccgggtacccgtttaccgggaccggtaaccggggtaaccgtttacgggaaaacgggttacgttaacggggtttacgggaaccgttttaacggggtttttaaaactttacccggttacggttaaccggtaacgtaaccggtaaacttttaacgtttaaagttaccgtttacccgttacccgttactaaaccgggttccgttacgggaaacccggtaacgggtaaaccgtaacgggtaacggttaaactacgaaaacggttacccgtaggtaccggtacgtacggtacctacgtaaccgg

SEQ ID NO: 161291 - DNA, 815 bp, Homo sapiens
  misc_feature: GYAE6OF02GUT85.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgaggacgggccaccatcaactgacaacgtccagccagtagttatttttacagcctacccaacctaaataaagacgtaccttaacttacggtaccgtttacggttccaagaccgaaacggtaaaacccgaggaacctaccttaccccttacctccttaacgtcgtaccttacctaacgttttaccggtcggggtaccgttacccggtaacccggggtaaccgttccccgggggtaccctacgggtacccggtacttacgacgggtcgggacgtaacggggtccgggttacgtacggggacctacggttacttttacccgaccttccgtaccgaccctaacgtaccgaacggtaccgaccgtcccgtacggaccgtacgggtaccgtacggaaacggttacggttcggtacggttacgttaaggttttaacgttacgtacgtactaacggttactaacgtttaattaaacgtaccggttcggtaccccgttacggttaacgtttacgggtttaacgggacccgtaacggggtaaccgtaacggttacgggtaacgggtaacgttaaccgtaaccgaaacggttaccgttacgggttaccggtacgtaccgggtaacctaacccg

SEQ ID NO: 161292 - DNA, 794 bp, Homo sapiens
  misc_feature: GYAE6OF02HRMGH.22.27.C05.1.454.CMB.1.raw
  modified_base (239)..(239): a, c, t, g, unknown or other
  misc_feature (239)..(239): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgaccagtctcagactccctggctgtgtctcgtgggcgagacgggccaccatcaactgcaagtccagccagtagttatttttacngactaccaacaataagacgactaacttagcttaggtccagacaagaaaccaggacatcctctctaactgcgtactactttaacgtcgggtcgtaccgtacccgggtaattccggggtccctacggtaaccgtacttaccgaaggtcggtacgacgggtcgggttcgtacggggaactagtaacttttccgaaccgttaccgtacctaaccctagttacctacggaaccgtaacggtcccgtttagaccggttaacgggaccgttaacggaaacgttacgtttacggggttacgggtacccttttaaacggttttaacgttttaaacccgtgggtttaaccgtaaacgtaaacggttaaactttaaattttaacgtaacgttttaccccgttaccgtaaccttaaacgggtaaccggttttaaccccgaaccgggttaaaaggggtaaccccgtaaagggggttaaccgtaaaaacgttaaccgtaaaaaccggggttaaccttacgggttacgggtacccgttacggtaacccctacgtttaacgtttaccccgg

SEQ ID NO: 161293 - DNA, 704 bp, Homo sapiens
  misc_feature: GYAE6OF02GRUGA.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatgacccagtctccagacctccctggctgtgtctcgtggcgagacgggccaccatcaactgacaacgtccagccaagtagttatttttacacgtcctacccaaccgtaataaagagtcttaacgttaacgtcgtttacggttccagaccgaagaaaaccgtaaggaactaacctccctaccctctactcgtactacttaactttcggtcggtcgtaccgtaacccgggtacgtccgggtcccgtacgtacccgtattccgtagtcggacgtcggtcggtcgtacgggtactaggtactttaccgacgttcctaccaacctactaccgtacgaccgtacgtcccgtgaccgtacggtacgtaggaacggtagttcggtaggttacttaagtttaactttacgttacgtacgtaactaactacgttttaactttacttactttacctaacgtccgtaacgttccggtaccggtaccgtaacgggtaaccgtaaagggtaacgtaaacgtaaccgttaaacgtacgtaggtcgaccgtcgacctacgacttcg

SEQ ID NO: 161294 - DNA, 669 bp, Homo sapiens
  misc_feature: GYAE6OF02GKL9D.22.27.C05.1.454.CMB.1.raw
  modified_base (476)..(476): a, c, t, g, unknown or other
  misc_feature (476)..(476): n is a, c, g, or t
  modified_base (523)..(523): a, c, t, g, unknown or other
  misc_feature (523)..(523): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgaccagtctccagactccctggctgtgtctcgtgggcccgaggacgggccaccagtcaactgacaagtccacgccgagtacgttatttttacacgtctaccacaaattaacgagtaccttaacgttagtcgtttcggttaccaggacaacgaaaccgacggaccaacttcccgtaccttacgtaacgtcgaccttactacgtttaacgtcgggtaccgtaccgtaacccgggtaacggtcccgggtaccgtacggtaccgtacgttcgaaggtcggtaccgacggtcgggtcgtgggaactacgtacttcgacctaccncgactactcgaacgcgaacgtccgagcgacggtcgtaacgaaggttntacggtcgtacgttagtttactacgtacgttacgaacgttactaaagttacgttattaccttacctactacgtacggtaccgtaccgacgaaacggtcgaaggttacgaacgtacgaacgtcgtaggtacgactcgacgtactacg

SEQ ID NO: 161295 - DNA, 636 bp, Homo sapiens
  misc_feature: GYAE6OF02GT2QF.22.27.C05.1.454.CMB.1.raw
  modified_base (467)..(467): a, c, t, g, unknown or other
  misc_feature (467)..(467): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctccctggctgtgtctcgtgggcgaggagggccaccatcaactgcaagtccagccagagttatttttacagcctccaaccaataagagcttacttagtcttggttccagacagaaccaggacactcctcctctactgctctactttacgtggtcgtcgtaacccggacgtcccggggtcctgaccgtattcgagtcggctacggtcgggtcgtgggactagtacttccactctccaccatcagcgacgtccgtgccgtaggtccgtagaacgtagtggtcggtactaagttttntaacgtgtacgtacgtactaattaagtttacttaccttcccttacccgttactaaccgggttacggtttacccggaaccgaaaccggggtaccgtaaaggggttaacggtaaacgtaaccgtaaacggtaaccggttggtcccggtactaccggtaccgtaccttacgg

SEQ ID NO: 161296 - DNA, 821 bp, Homo sapiens
  misc_feature: GYAE6OF02H93LL.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctcgggtgttgctctggatctctggtgccgtccggggacatcgtgatgacccagtctccagacctccctggctgtgtctcgtggcgaggaggacccacatcaactgacaagtccagacagtacgttaatttttacagtacctacaaccaaagtaagagacttaacttaagtcctttacggttaccagacaacgaaacccgaaggaacacttaccctaccttacctaacgtgtaccttctaacttttaccggtacgggtaccgttaccgtaacccggggaactttaccccgggggacccttacggaacccgtacttacgaacggtcggacgacgggtccgggtcgttcggggaactaggttaactttccgacgttacctacaaccgttaactaccgaacgggtccaaccgtcccgtttagggaacccgtagggtcccgttaaaggtaaacgggtacgtttacgggggttacggtaaccgttttaaacggtttttaaccgttaaaccttcgggtaaaccgtaacggtaccttttaaaagttacggttttaaactttccgttacccccttacgtaaccgttaacgttaaccgggttacccggaaaaccccggtaaacgggtacccgtaaaagggttaacgggaaaaccttaacccgttaaaaaccggaaggttcggaccggttactaacggttaccccagtttaacccgg

SEQ ID NO: 161297 - DNA, 627 bp, Homo sapiens
  misc_feature: GYAE6OF02FY7JO.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactcctggctgtgtctcgtggcgagagggccaccatcaactgacaagtccagccagtagttatttttacagtctccaaccaataagagtactacttagtctttggttccagcaagaaaccaggaacactcctcctctactcgctcgtaatttcgtgggtccgtaccgtaccgggaacgttcccggggccctcggtaccgtacttcgagtcggccgtaggcgggtcgtacgggacagtactttaccaccgtcacctaccatcagcacgccgtgcgacgctaggaaagttcgtggttacgacttaagttttattagttcgtataagactaagttacttatttacttcccttctacgtacggtaccgtttaccggaccgtaacgggtaacctaaacgggttacggaaaactaacggtaaacgtacgttcgggtaacggccgtacgtaccaccgttaacg

SEQ ID NO: 161298 - DNA, 641 bp, Homo sapiens
  misc_feature: GYAE6OF02FZCW9.22.27.C05.1.454.CMB.1.raw
  modified_base (486)..(486): a, c, t, g, unknown or other
  misc_feature (486)..(486): n is a, c, g, or t
tcagacatacgcgtcacgaccggtgctcgatttagacgcgatcgaagggtttggggggagctacaacaggcaggcaggggcagcaagatggtgttgcagacccaggtcttcatttctctgttgctctggatctctggtgcccgtccggggacatcgtgatcgacccagtcctccagacctccctggctgtgtctcgtgggcgaggacgggcccaccatacaactgacaagtccacgaccagtagttatttttacagtcctaccaaccaaataagacgtcttaacttagcgtttcggttaccagacaacgaaaccgacggacactccctcctctactcgcctactactttacgtgggtcgtccgtacccgggtaacgtcccggggtccctcggaccgtattcgaggtcggacgagggcgggtcgtgggacagtacttcactcctaccacctactcagcacgtccgtagcgacggtacgtagaaggtntggtcggtcttaagttttactacgtgtacgagtactaaagttattaacttactttccctccgtacgtacgttccgttacggacggtaacgggtaaccgaaggtacggtaaactacccgaaaggtacgtcggacgggtctacggacctacgtaccg

SEQ ID NO: 161299 - DNA, 764 bp, Homo sapiens
  misc_feature: GYAE6OF02HP23Z.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccgggacatcgtgatgacccagtctccagactccctggctgtgtctcgtggcgaggagggccaccatcaacgtgacaagtccagaccagtagttatttttacagtcctaccaaccaattaacgacgtcttaacgttagtcgttggttaccagactaacgaaaccgaggaacctactaccctcctactaacgtcgtacctcgtactttacgtcgggtaccgtaccggtacccgggtaacgttccccggggtacctacggaccgtacgttaccgtagggtcggacgacgggtacgggtacggtcggtacagttaactttacctaccttcctaccacctacttaccgaacgtaccgaccgtacctcggaaccgtacgggtcctaagggaacgtaacgttggttacggactttttaaggttaacctttaccggtagttacacgttaacgtaaatttactttaactttaccgtttccctaccgttacgtaacgggttacccggtttaccgggaacccgtaacggggtaaacccgtaaggggtaaaccgtaaaaccgttaaaccgaaacccggttaacggtcggtttaaccggacttaaccggtaccccgtaacgttaccggttaacccg

SEQ ID NO: 161300 - DNA, 532 bp, Homo sapiens
  misc_feature: GYAE6OF02G2IO7.22.27.C05.1.454.CMB.1.raw
  modified_base (407)..(407): a, c, t, g, unknown or other
  misc_feature (407)..(407): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctggcgagagggccaccatcaactgcagtccagccagagtatttttacagcctccaccaataagagctacttagcttggttccagtcagaaaccaggaccatcctcctctactgctcatttactggcgtcgtacccggaactccggggtccctgaccgattcgagtggcagcggtctgggacagatttcgactctcaccatcagcagcctgcaggctgagngtgtggctagttatactgtcagacgaatattatacttcctacgtctacgtacgttcgacgaacgggaccgtaagggtacgaaacgtacgtaacgacgttcgtggtacctcgacctacctataccg

SEQ ID NO: 161301 - DNA, 719 bp, Homo sapiens
  misc_feature: GYAE6OF02IY6MR.22.27.C05.1.454.CMB.1.raw
  modified_base (150)..(150): a, c, t, g, unknown or other
  misc_feature (150)..(150): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacntcgtgatgacccagtctccagctcccgtgctgtgtctcgtgggcgaggacgggccaccagtcaacgtcgacgtacgtccagcctagtagtttactttttacacgccttaccgaacctaaagttaacgacgtaccttaacgttacggtcctttacggttccaagaccgtaacgaaaccagggtaacctactccctccgtactactagcctactattaccgtgggtcctaccgaacccggtacgtcccgggtcctaggacccgtactcgaggtacggacctagggtacggtcggtaggactacggtaacttccgtactccgtacacgtaactacgacgtacacccggtcgttacgacccgagggttaccaggtaaagtccgggttaggtacggtacgttacgtttaacgtttaccgaggttactaacgtataaacgtttattaacctttccgttaccttcggacgttaactccgggttacgacccgttaaggggaacttaacgggtaacgtaaaccgtttaacgaaaccggttacgtaccggtggttacgtaccgtacccgtaagttcccg

SEQ ID NO: 161302 - DNA, 529 bp, Homo sapiens
  misc_feature: GYAE6OF02GXN1W.22.27.C05.1.454.CMB.1.raw
  modified_base (455)..(455): a, c, t, g, unknown or other
  misc_feature (455)..(455): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactggcgtctacccgggaatcccggggtcctgaccgattcagtggcagcgggtctgggacagatttcactctcaccatcagcagccctgcaggctgaagtatgtgctagtttatactgtcagtactaatattatactttcctcctanagtaccgttcgaccgtaagggtacccaagggtagaaactaccgaaacgtaacttggtagacctagaccactacg

SEQ ID NO: 161303 - DNA, 759 bp, Homo sapiens
  misc_feature: GYAE6OF02GRY03.22.27.C05.1.454.CMB.1.raw
  modified_base (537)..(537): a, c, t, g, unknown or other
  misc_feature (537)..(537): n is a, c, g, or t
  modified_base (612)..(612): a, c, t, g, unknown or other
  misc_feature (612)..(612): n is a, c, g, or t
tcagacatacgcgtcacgaccggtgctcgatttagacgcgatcgaagggtttggggggagctacaacaggcaggcaggggcagcaagatggtgttgcagacccaggtcttcatttctctgttgctctggatctcgtggtcgccgtccgggacagtcgtgatcgaccctagtcctccacgtacctccgtggtactgtcgttcctcgtcgggcgaacggaccgggacctaaccacgtaccgtaacgtacggacgaacgtaccgtacgaccaagttacggttttaactttttacgacgtcctacccaaccgtaaagttaacggtacgtttaactgtccgtttacggttaccagaccaacgaaaccgacggacctacgtccgtcgtacgactacgtcgtctacgttacgtttacggcggtaccgttaccggtaaccgggttaccggttcccgggtaccgtacgtaaccgtacgtcgtacgggtcggtacgtacgggtccggtcgtacggtattacggtacttaccgtaccgtaccgtaccncgtacgtacgacgtcgacggtctcgacgtaggtacgtacgaagttcggttggtaccgtaatttagtagtttacgngttaacgacggttacaaattttacgtaacctttccttacccgtcgttagtaacccgggttcgttacccgaaccgggttaacggtaacgtacgggtaaccaaccgttaaccgtaagtaccgttggtaccgactcgtacccgaacttcg

SEQ ID NO: 161304 - DNA, 827 bp, Homo sapiens
  misc_feature: GYAE6OF02FI8BY.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacttatcgtgatgacccagtctccagactccctggctgtgtctcgtgggcgaggacgggcccaccatcaactcgacaacgtccgacgaccgagtagttatttttacgacgtccttaccaacctaaagtaaacgagtaccttaacgtttagtccgtttagggtttacccaacggtaccaaacggaaaaacccgaagggtaacctaccttaccccttcccttaccttaaccgttcggaccttaccgtaactttttaccggtcgggggtaccgttacccggtaacccccgggggtaacccggttccccgggggtttaccccgtacggtaaccccggtactttccgtacgggttcgggaccggtaacggggtcccgggggttacggtacggggacgtaacgggttacttttccgaacccgtttccctaccgtaacctacgttaccgaacggtcccgtaaccggtcccttgggacccgagggtaccgtaacgggtaacgttaaggttcgggtaccgggttacttaaacggtttttcttaacggtcgttaaccagtaacttagtttaaacttacgttactttccctacgttacgtaccggtacgttaccgtaccgaaagggtaccctaaagggtacgaacctaccgtaaacgtacgtcggttaccggcagtccctaagtccgttacg

SEQ ID NO: 161305 - DNA, 937 bp, Homo sapiens
  misc_feature: GYAE6OF02HW3H4.22.27.C05.1.454.CMB.1.raw
tcagacatacgcgtcacgaccggtgctcgatttagacgcgatcgaagggtttgggggctacgaacaggcaggcaggggcagcaagatggtgttgcagacccaggtcttcatttctctgttgctctggatctctggtgcctccggggacatcggtgatgacccagtcctccagactccctggctgtcgtctcgtggcgaggacgggccaccagtcaactgacaacgtaccacgaccaagtacgtttaactttttacgacgtaccttacccaacaaataaacgacgtaaccttaaacgttaacgtaccgttttacggttacccaagtaccgaaacggaaaaacccgtacggaacctaacgttcccctaccgttacccttaaccgttccgtaccttaccgttaaccgttttacggtacggggtaccccgttaaccggtaaaccccgggggttaaccgttaccccccggggggttaccctacgggtacccggtacgtttccgtaacgggtcgggaccgtacggggtccgggttccggtaggggtaaccctagggttaaccgttttcctaaacccgttccgtttaacccgtacccttaacgtacgtaccgacccggttaacccgtacccggtcgaacccgggtacgggtaacccgtaaggggtaaccgttaacgttacggggttaacgggttaacttttaaccgggttttaactttaaccggacggtttaaccgaaacttaaaccgtttaagtttaacggtttaaaccttttacccgtttcccctttaaccgtaacggtaacccgggtttacccggtaaccgggtacccggtaaaacgggtaccccggtaaaaggggttaacccgtaaaaaagttaccccggtaaaaacgggtaccgttacgggtaaccggtacgtaaccggtaaccgtacctacgttaccg

SEQ ID NO: 161306 - DNA, 556 bp, Homo sapiens
  misc_feature: GYAE6OF02GXU4W.22.27.C05.1.454.CMB.1.raw
  modified_base (409)..(409): a, c, t, g, unknown or other
  misc_feature (409)..(409): n is a, c, g, or t
  modified_base (423)..(423): a, c, t, g, unknown or other
  misc_feature (423)..(423): n is a, c, g, or t
  modified_base (436)..(436): a, c, t, g, unknown or other
  misc_feature (436)..(436): n is a, c, g, or t
  modified_base (543)..(543): a, c, t, g, unknown or other
  misc_feature (543)..(543): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctccctggctgtgtctctgggcgagagggccaccatcaactgcaagtccagccagagttatttttacagctaccaccaataagagctacttagcttggttccagcagaaaccaggacatcctcctctactgctcattttacgtgggtctaccgtaccgggtaatcccggggtcctgacccgtattccagttcggctacggcgggtctaggggacagtatttcgactctacacctancagcacgcctgacncgctgaagtatgnggctatttactacgtgtcagactattaagtcttacgtcctacctcgagtccgttcgaccggaacggtaccgtaaggtagtaaaactacgaacgtaacgtgtaccggntacgacctacacg

SEQ ID NO: 161307 - DNA, 627 bp, Homo sapiens
  misc_feature: GYAE6OF02GTAY1.22.27.C05.1.454.CMB.1.raw
  modified_base (324)..(324): a, c, t, g, unknown or other
  misc_feature (324)..(324): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccgggacatcgtgatgacccagtctccagactccctggctgtgtctcgtgggcgagagggccaccactcaactgcaagtccagccaagagttatttttacagtcctccaaccaaataagagctacttagctttggttccagcaagaaaccaggaccatccctctctactgctactatttacgngggctacgtaaccgggtaacgtccgggtcctagaccgtacttcgagtcggacaggtcggtcgtcgggaactacggtattccgactactaccaacctacttaccaaggtccgaacgtcccgtagacggtacgtaccgtaggtaaagtcgtaggtacggtacttacgttttaatacgttcgtacgacgactaagtttactaagttcttacctctagtacgtccggttacggaccgaaggtaacccgaaggttcgaaaacttacgaaaccgtacgttcggagttaccgtacggtactaccgttacg

SEQ ID NO: 161308 - DNA, 769 bp, Homo sapiens
  misc_feature: GYAE6OF02JLDB4.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggtacatcgtgatgacccagtctccagactccctggctgtgtctctgggcgagagggccaccatcaactgcagtccagccagagtattttacagtctccaccaataagagtctacttagcttggttccagcaagaaccaggacactcctacctctactacgctactactttacgtgggcgtaccgtaacccgggtaacgttccccggggggttacccctacgggtaacccgtacgttaccgacggtttacgggcgtaacgggttccggggtacgttacggggaccgtaagggtaaccttttacgtacccgttaccgtaccgtaaccctaacgttcccgaaggtaccgtaaacggtcccgttagggaaccgttacgggacggttaacgggtaaacggtaacgttggtaccgggtaccttttaaacggtttatttaacccggttggtacccgtaaggtaaccgttaaagtttacttttaagttaacccttttcccgttacccttaaaccggtaccggttaaccgtttacccgggacccgggtaaacgggacccgtaagggttaaccggtaaaacttacgtaaaacgtacgttacgggtacggtacctacggaccctaccgtaacttcg

SEQ ID NO: 161309 - DNA, 789 bp, Homo sapiens
  misc_feature: GYAE6OF02IHAPM.22.27.C05.1.454.CMB.1.raw
  modified_base (699)..(699): a, c, t, g, unknown or other
  misc_feature (699)..(699): n is a, c, g, or t
  modified_base (777)..(777): a, c, t, g, unknown or other
  misc_feature (777)..(777): n is a, c, g, or t
tcagacatacgcgtcacgaccggtgctcgatttagacgcgatcgaagagtttgggggagctacaacaggcaggcaggggcagcaagatggtgttgcagacccaggtcttcatttctctgttgctctggatctctggtgccgtccggggacatcgtgatacgaccagtcctccacgacctcccgtcggtcttgtcgttcctccggtaggggacgaagggacgggccctaacctacttaccaaacgttcgaaccgtaacgtacccgaggaccctaaggttaacgttttaacttttttaacgaccggtacctaacctaaacctaaaagtaaagacgttaacttaacttacgtaccgtttcgtacctaagaccgaaagaaaacccggacgaaacgtacctaccctacctttactaaccggtctaaccttacgttaacgtttaccggttacgggtaccggttaaccggtaaccccggggttacggttccccgggttacccgtaacggtaccgtacgttacgaacgggttcgacggacgggttaccgggttagtaaccggggtaactaacggtttacctttaccgtaaccgttccgtaactaccctaaggactaaccgacgttaccgacgttcggaagtcggaacttaggaagtactacggtgttacgttagttaacgttctcgtacaagtactaagttaacttnttacctacgtacacgtacggtacgtaccggaacgtaacgggaacctacggtaataaaccgtagaacttagtgtaccgnttccgaactacg

SEQ ID NO: 161310 - DNA, 753 bp, Homo sapiens
  misc_feature: GYAE6OF02HFZPD.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgaggacgggccaccgatccgaactgacaacgtccagccaggtagttaactttttacagtcctaccaaccaaataacgaacgtctaacttacgtcgtttcggttaccacgtacaagtaaaccgaggactacgtcccttccgtactactcgaccttactaacttttacgcggggtaccgtacccgtaacccggggtaacgttcccggggtacccgtacggtacccggtacttaccggaggttcggcgtacgggtccgggttcgtacggggaactaacggttacttttaccgaccgttccgttacccaccgtaagttaccgaagtcacgtcccgttaggcgtaacgggtacgtaacggtaaacgtaggttcgggtacggtactttaaacggttttacttaacggttcgttaacgacggtaccgtacggacggttacgacctaacccgttccggtacggtacggttccgggtacgggacgggtaaccgtaacggggtcgaacgtacgtaaacggaaaccgtacggttacggacggtaccgtacgaccttaacccgtagtttccg

SEQ ID NO: 161311 - DNA, 891 bp, Homo sapiens
  misc_feature: GYAE6OF02G1XF5.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatcgacccagtctccagactcctggctgtcgtctcgtgggcgaggacgggccaccgactacaactcgactaacgtaccgacgaccgaagtacgtttaactttttaacgacgtacctaccgaacctaaataacggacgtacctaacgtttacggtccgtttacggttaccgaacgtaccgaaacgtaaaccgtacggtacctacttccccgttaccctacttaccgtcggtacctacttaacgtttacgtcgggtaccttaccggtaaccccgggtaccggtacccggggtcccgtacggtacccgttaacgttccgtacggttccggaccgtacgggttcgggtaccggtacggggtaaccgttagtacgtttaccgacctttaccgtaccgtaacccgttacgtaccgtaacggtccgacggtaccgtcgaaccggaacggtccgtaaggtaacggtacgttcgggttacggtaacctttaacggttttacttaccggtgtaacccgtaacgttaaccgtttaaagtttaccgttaacgttttacccggttacccctttacgtaaaccggggtttacccgttaacccgggggttacccggtaacggtaaaacccggggggttaacccgttaaacggggttaaaccggttaaacccaaacccggggtttaaacgttacggttaacccgggttaaccggtaccgggtaaccgttaccccggtaaaccgtttacccg

SEQ ID NO: 161312 - DNA, 851 bp, Homo sapiens
  misc_feature: GYAE6OF02IPQYZ.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatgacccagtcctccagactccctggctgtgtctctgggcgagagggccacatcaactgacagtccagaccagtacgttatttttaacacgtactaccaacctaaataacgtagaccttaccttaaaggtcctttaggtttaccgaacgtcaaggaaaaccctaggaacctacgttcccctaccgttactaacctacggcttacgtaacttttaccgtggggtaccgttacccgttacccgggtaaacgtccccgggggttaccccgtacggaacccgttagttaacctaacgggttcgggacgtacgggtaccggggttaccgtacgggggtaacacggggttaaacttttacccgaccgtttacccgtacctaacccgtaacgtcgtaaacggcccgaacgtacccttaggacgtacgggtaccgtaaggtaaacggacgtttagggtacggtaccgttaagttttagtttaccgtagttaaccgtagaccttaaagtaacttttaacgtaacctttaacccgtttaccgtacgttaacggttcccgggttaacggtaacccgtaaccggggttaacccgaaacggggttaaacggtaaaaccggttaaacccaaaaacccgggtttaaaccgaccggggtttaaccggttacccggtaaccgggacccgttaaacccgttacgtttaacccggg

SEQ ID NO: 161313 - DNA, 704 bp, Homo sapiens
  misc_feature: GYAE6OF02IVY0S.22.27.C05.1.454.CMB.1.raw
  modified_base (302)..(302): a, c, t, g, unknown or other
  misc_feature (302)..(302): n is a, c, g, or t
  modified_base (484)..(484): a, c, t, g, unknown or other
  misc_feature (484)..(484): n is a, c, g, or t
tcagacatacgcgtcacgaccggtgctcgatttagacgcgatcgaaggggtttgggggagctacaacaggcaggcaggggcagcaagatggtgttgcagacccaggtcttcatttctctgttgctctggatctctggtgcctccggggacatcgtgatcgacccagtctccagacctcccgtggctgtcgtctcgtgggcgagacgggccaccactcaactgacaacgtccacgccagtagttactttttacagtcctaccaaccaataaagacgtacttacttaggtctttggttccacgngaacaaccaggaccactaccctcctactgtccgctcttaactttcgtcgggtaccgttgtaaccccgggaacgttcccggggttccctacggtaccgtaataccgtggtcggcgtacggtaccggggtcgtaacgggctaagttacgttaccgactttcgacctaccgtaactcccggtaanacccgtcgtacccgttggaccgacgggttcgtaggaaacgggttcagggttcgttaaccgttaaggtttactacgtcttaacgtacgacgtaattaagtttctaccgtttcctcgtaacgtataccggggtttacacccgggtaagtaacccggagggttaaccgaactttaacggaacgtaccggtcggtaccggacttcggtaccctaacgtttcccg

SEQ ID NO: 161314 - DNA, 751 bp, Homo sapiens
  misc_feature: GYAE6OF02J0Q5N.22.27.C05.1.454.CMB.1.raw
  modified_base (478)..(478): a, c, t, g, unknown or other
  misc_feature (478)..(478): n is a, c, g, or t
tcagacatacgcgtcacgaccggtgctcgatttagacgcgatcgaagggtttgggggagctacaacaggcaggcaggggcagcaagatggtgttgcagacccaggtcttcatttcgtctgttgctctgggatctctggtgcctccggggacatcgtgatgacccagtctcagactccctgctgtgtctcgtggcgaggacggccaccgatccaacgtcgcaacgtccgagccagtagttatttttacgacgtcctaccaacctaataagacgtactacttaagtcgttcggttaccagtaccaacgaaaccgacggaactactccctacctactactcgacctcctaactttacgtcggtcggtaccgtaacccgggtacgtcccgggtccctacggtaccgtacgttacgacggtcggaccgtaggtcgggttacgtacgggacgtacgttacgttacctactactaccgaacctanacgtacgtaccgacgtccctaggacgtaacggtactaacggaacggtcttcgggtacggtcgttaacgttttactaccgttcgacgtaacggtaactttaaggttactttaaacttcccgttaaccttacccgtaccgttaacgggttcccgttaacccggaaccggtaaaccggggtaacgtaaacgggttacggtaaaaaccttacccgtaaaacggtaaccggtttgggtaacccggttcgtaaccggtttaccgaacccgtttaaccgg

SEQ ID NO: 161315 - DNA, 618 bp, Homo sapiens
  misc_feature: GYAE6OF02F745X.22.27.C05.1.454.CMB.1.raw
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctggcgagagggccaccatcaactgcaagtccagccagagttattttttacagcctccaaccaataagagctacttagctttggttccagcaagaaacccaggacatcctcctctactgctctatttacgtgggcgttccgtacccggggtaactcccggggtccctgacccgtattcgaggtggcaggcgggtcgtggggacaggtatttcactcctcaccatcagcagtccngaccnggctaggaagatgtggtctagttttacttacgtgtaccgagtactaaattatttaagttactttcccttacctacgtaacgtaccgtttacccgggacccgtaacggggtaacccgtaagggtaacgggtaaaaccttaccggaaaaaccggtaacgttggtaccgggtacttaccgggactacccgtacg

SEQ ID NO: 161316 - DNA, 662 bp, Homo sapiens
  misc_feature: GYAE6OF02HIVPV.22.27.C05.1.454.CMB.1.raw
  modified_base (440)..(440): a, c, t, g, unknown or other
  misc_feature (440)..(440): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatgacccagtctccagacctccctggctgtgtctctgggcgaggacgggccacactacaactgacaacgtccagccagtagttatttttacagtcctaccaaccaataagagtcttacttagctttaggtccagacgaacgaaaccgaggacactccctcctacttacgtcgtctactactttacggtcggccgttaccggtaacccgggacgttcccggggtccctcgtaccgtcttcgaggtggcgtaggcgggtcgtggacagtacttcactctcactacgtnacgcgacgtccgtgacgtacggtctacgaagtctgggtcgtacgttagtttactacgtagtacagttaacctaatttacttacttccgtttacctactaccggttagtaccgggttaccggaaccgtaagggttaacccgtaagggttaaccgtaaacgttaaccgtaaaccgggtaacgttacgggtacggtacttaaccggccgtacctaagtttcccgg

SEQ ID NO: 161317 - DNA, 631 bp, Homo sapiens
  misc_feature: GYAE6OF02FMJ5D.22.27.C05.1.454.CMB.1.raw
  modified_base (515)..(515): a, c, t, g, unknown or other
  misc_feature (515)..(515): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccagccagagttatttttacacgcctcccaaccaataagtagttacttagtcttcggttccagctaacgaaaccaggacatccgtcctgccactgctactactttacgtgggtccgttccgtacccgggtaacgtcccgggtccctacgtaccgtattcgagtcggcgacggtcgggtcgtacgggacagtacttcgtacctctaccgtaccctagtaccgacgccgacgtcccgtggacgacgggtactaagaaggtacgtgggttacggtacttaagttttattagttcgtanagtactaagtttatacttacttcctctacgtagtaccgttacgaccgtaagggacctaagggtacgaaaccttacgaaaccggttacgttacggacgtcgtacgtacctacttacg

SEQ ID NO: 161318 - DNA, 556 bp, Homo sapiens
  misc_feature: GYAE6OF02IJEQO.22.27.C05.1.454.CMB.1.raw
  modified_base (410)..(410): a, c, t, g, unknown or other
  misc_feature (410)..(410): n is a, c, g, or t
  modified_base (424)..(424): a, c, t, g, unknown or other
  misc_feature (424)..(424): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctggcgagagggccaccatcaactgcaagtccagccagagtattttttacagctccaccaataagagctacttagcttggttccagcggaaaccaggacatcctcctctactgctcatttactggtcgtctacccgggaatccggggtccctcgaccgattcagtggcgagcgggtctgggacagatttcactctcacgatcagcagcctgcaggctgaagntgtggctaggtttntactgtcagcaattattctaattcccttcctcgtacgacgttccggaccgaaggggaacccaagggttacgggaaaacttcaaaacccgggtacttacggtcgggttacgcggaccctaacccgacgttacg

SEQ ID NO: 161319 - DNA, 711 bp, Homo sapiens
  misc_feature: GYAE6OF02HRFOR.22.27.C05.1.454.CMB.1.raw
  modified_base (558)..(558): a, c, t, g, unknown or other
  misc_feature (558)..(558): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatcgacccagtcctccagacctccctggctgtgtctcgtgggcgaggacgggccaccatcaactgacaacgtccacgaccagtatttactttttacagcctaccactaaatagacgtcctaacttacgcgttacggttaccagacaacgaaccgtaggacctaacgtccctaccgttactactgtccttacttacgtttaccgtcggggaccgttccgtaacccgggtacgtccccggggtccctacggaccgtattccgaggttcggacggtacgggtccgggtcgtagggaactaggttaactttcgaccgtccttaccacctacgtaccgaggccgtaccgacgcgtaccggaaggtcgtagaacgtagtggtcggacttagtttactacgtgtacgtaanagttaacttacttattaccttacctaccggttacgtacggttaaccgttccgggacgtaaccgggtaaccggtaagtaaccgggtaaactaaaccggtaaacgtaccgtacgggttacggtaccttaccggaacggttacccacgtttcccgg

SEQ ID NO: 161320 - DNA, 634 bp, Homo sapiens
  misc_feature: GYAE6OF02FMW7P.22.27.C05.1.454.CMB.1.raw
  modified_base (493)..(493): a, c, t, g, unknown or other
  misc_feature (493)..(493): n is a, c, g, or t
  modified_base (607)..(607): a, c, t, g, unknown or other
  misc_feature (607)..(607): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgcctacttacttacggcggtccgttaccggtaaccggtaccggttcccgggtaccgtcggtaaccgttactacgtacggtcgacgacgggtcggtcggtacggacgtagttactacgtactcctacactagtccgagtcgacgtcgtacgcggtaacgtcgtaaagacgttgttcggtacgtagttttaagttntttaagttcggacagtaacttaatttatttaaccgttcctttccgaccttagccgttaccggtagaccgggtaccggaacggtaagggtaacgtaacctaacgaacggttacgnggtacggacgtacacctacttgtaccg

SEQ ID NO: 161321 - DNA, 733 bp, Homo sapiens
  misc_feature: GYAE6OF02JLMJV.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatcgacccagtctccagacctcctggctgtgtctcgtgggcgaggacggccaccactcacgtgcaacgtccacgccgagtagtttactttttacgacgtcctaccaaccaaataagtacgtaccttacgttacgtcgtttacggttccacgactaacgaaaccgagactactccctcctacttacgtcgtacctcgttaactttacggtcggggtaccgtacccggtaacccgggtaacggttccccgggggttacccctacggtaaccggttacttaccggtagggtacgggaccgtacgggtccgggttacggtacgggaaccgtgtttaacctttccgacctttccgtaccctaccgtaacgtccgaacgtccgacgtcccgtaggtgaccggtacctaggaagttagttcggtaccggtacttaacggttttactcgtactacgagtaactaactttgtttactccttcccgttaactccgtaaggttccgttaccgaacgtaaccggggtaacacggggtaacttaaacgaaccgtaacgtacttcgggcgtacgtccgactaccttagtccgg

SEQ ID NO: 161322 - DNA, 823 bp, Homo sapiens
  misc_feature: GYAE6OF02G22YA.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctccctggctgtgtctcgtgggcgaggacgggccaccatcaactgaccaacgtccagaccagtagtttatttttacacgtccttaccaacctaaataaacggacgtacttaaccgttaagtcgtttcggttaccacgtaccaaacggaaaacccgacgggtaacctaaccttcccgttaccttaccttaaccgtcgtccctacgttaactttaccggtcgggtccggttaccgtaaccccggggtacggttccccggggtcccgtacggtaccgtacgttcgaggtcggacgacgggtcgggtcgtacggggacgtacgttactttaccgaccttcctaccaccctaagtccgaagtccacggtccctaggaccgtacgggaccgtaggaacggttaacgtttcgggtacgttaccgtttaacgggttttactaaccgttcggtaacgtaacgtacgtttaaacgtttaactttaacttacctttttccccgtaccggtaacgtttacccgggttaccgggttacccgggtaaacggtaaaccgggtaacccggttaaaaggggtaaaccggtttaaaaaccgttaaaaccgggttgtaaccgggttaggtaacccgtaccggttaacccgttacgtaccgtttacccgg

SEQ ID NO: 161323 - DNA, 736 bp, Homo sapiens
  misc_feature: GYAE6OF02JDRIZ.22.27.C05.1.454.CMB.1.raw
  modified_base (201)..(201): a, c, t, g, unknown or other
  misc_feature (201)..(201): n is a, c, g, or t
tcagacatacgcgtcacgaccggtgctcgatttagacgcgatcgaagggtttgggggagctacaacaggcaggcaggggcagcaagatggtgttgcagaccaggtcttcatttctctgttgctctgatctctggtgccgtcggggacactcgtgatcgaccacgtctcagacctcccgtggctgtgtctcgtgggacgagngggccacatccaaacgtcgaccaacgtccgacgccgtaagtagttttaacttttttacgacgcctacctaacctaaagtaaacggtaacgtacctttaacgttaacggtacgttttacggttcccgtacgtaacgaaaacgaaaccgaacggaaacctaaccttcccctaccttaccgtaacgtcgtaccttaacgttacgtttaccggtccgggtacccgttaccggtaacccgggtaacggttcccggggttacccgtaccgtaaccgtcgttaaccggacggtacggtacgtacggtccgggtacgtacgggtactacgtcttacctacgtctaccgtactatacgacgtacgtacgaccgtacgcgacgtcgtaacggtagtcggtaggtacgttacgtaacgtttacgtacgtactacgacgtaacgtatttaacttaattccgttactcctaagtacgttccgtacgtacggaacggtaccgtaagtacggaactaacgtaactacgtacgacgacgtacgctacgtac

SEQ ID NO: 161324 - DNA, 744 bp, Homo sapiens
  misc_feature: GYAE6OF02IKSGU.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggactatcgtgatcgacccagtcctccagacctcccgtcgctgtcgtcgtcgtggcgaggacggccaccgatacactgacaacgtccacgacgacgtagttattttacagtcctaccaaccgtaagtaagacgtactacgttacgtcgttacgtccagtacaacgaaccgacggtactacgtccctccgtacttaccgtcgtcctacttacgtttaccgtcgggttaccgtaccggtaacccgggtaacgttcccgggtaccctacggacccgtagttacgtacggcggtccgaaggtccgggttacgtacggtacgtaacgttacgttcgtacctccgtaccacgtacgtacgacgtctaccggtcgtaccgcgtacgtagtacgaacggtacgtacggtacgtacgttacgtttaatccggttaacgtccgtaacgttacgtaaacttacgtttaaccgttaccttaccgtaccgtacgttacccgggtaacgttacccgggtaacggtaacccggtaggtaaacgggttacgtaaaccgttaaccgtaaccggttacgtccggttacgtaaccgttcggtacccctagtaacccg

SEQ ID NO: 161325 - DNA, 1005 bp, Homo sapiens
  misc_feature: GYAE6OF02J3BZ0.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctcgtggactctctggtcgccgtcgggactatcgagatcgaccacgtcctccacgtacctccgtggtctgtgtcctacggtgggcggaacggacggacccaacctactaccgtaacgtccgtacaaccgttccgaacgtaccgtaacggttaacgttttaacgtttttaaaccgaccgtacccctaaaccccgtaaaccttaaaacggtaaacgtaccgttaccggtttaacctttaaccgggtttccggtttacggttaccccgaaacggaccggtaaaaaccgtaaacccgaggttaaccccttaccccgtttccccttaaccccttacgttaccgtaccgtttaccgtaccggttttaaaccggttaaccccgggtccggggtaaccccgttttaaccccgggtaacccccgggggttaaccccggtttccccccggggttaccgtacgttaaccccggtacttaccgggttaccggggccggtaaaccggtaaccgggggtcccggggttacggtaaccggtaacccggttaattacccgggttaccctaccgtttacccgaaccctaacccttacggtaccgtaccggtacctaacccggtaccggtccggtaccgggtaccgtttacgaaaccggtacggttaacggtaccggtttaacggttaccgttttacgtttaacgtacggtaccgttaacgtaaccgttaaccttaagttttaccgttaaccgtttcccgttaacccgttacgttaacccggtacgttacccgggtaacccgtaaccggtaacggtaaccggtaaacggtaacaaacccggtaagtaaaaccgttcggtacccggtacggtacctaccggtacccgttaacgtcctttaaccg

SEQ ID NO: 161326 - DNA, 696 bp, Homo sapiens
  misc_feature: GYAE6OF02FH8YF.22.27.C05.1.454.CMB.1.raw
  modified_base (137)..(137): a, c, t, g, unknown or other
  misc_feature (137)..(137): n is a, c, g, or t
  modified_base (225)..(225): a, c, t, g, unknown or other
  misc_feature (225)..(225): n is a, c, g, or t
  modified_base (317)..(317): a, c, t, g, unknown or other
  misc_feature (317)..(317): n is a, c, g, or t
tcagacatacgcgtcacgaccggtgctcgatttagacgcgatcgaagggtttgggggaggctacaacaggcaggcaggggcagcaagatggtgttgcagacccaggtcttcattctctgttgctctggatctctgtncctccgggacatcgtgatgacccagtctccagactccctggctgtgtctctgggcgagagggccaccatcactgcaagtccagccagngtattttttacagctccaccgaactaagagctacttagctttaggttccagcagaaacccgagacatcctcctacttactgctcattttacngggcgtctacccgggaaatccggggtccccgttgacccgtagttccgagtcgggtctaggccgggtctacggggacgaggacttttccaacctcttaccaaccctatcaacgtccaacgtcccctagggccctaacggggcccttagggaaacgtactcgggttaggtccctaagggttttttaccttttaaccgtaacgtttccgaacggtcctaaaagttaaacttttaactttaacgttcccttaccccgttgtacccggtaaccgttttccgggaccctaacggggggtaaacccctaaaggggttacgggaaaacgtttccaaaaaccgggtaaccccttgggtaccgggtcctaccgggtaccaaccgttacc

SEQ ID NO: 161327 - DNA, 776 bp, Homo sapiens
  misc_feature: GYAE6OF02F3IMC.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtcgccgtccggggacagtcgtgatcgacccagtcctccagacctccctggctgtcgtctcgtgggcgaggacggaccaccgatccacgtgacaacgtccacgaccagtagtttactttttacgacgtcctaccaactaaataacggacgtacttaacgttacgtcgttttacggttacccagacgtaaacgaaacccgaggaacctactccccgttcctacgttaccgtcgtacctacttacgtttaccggtacgggtaccgttacccggtaacccgggtaaccggttcccggggtacctaccggaaccgtacgttacgacggtcgaccgtacggtcggtacgtacgggactacggtacttacgtacctcaccgtaaccacgtccggaacgaccgtaccgtcgtacgacgtacggtacctaggtaacgtagtcggttacgtactttagtttaccttacggttcgtaccggaacttaacgttaacgtttaacgtttacttacccgttacccgttaacgttacgtaaccgggttacccgttacgggaacccggtaaacgggtaacgtaaacgggttaacggtaaactaacggtaaaaccggtgttaaccggtcggtaacccgtctaaccgtcctttaaccgg

SEQ ID NO: 161328 - DNA, 803 bp, Homo sapiens
  misc_feature: GYAE6OF02GQQGA.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctcgtggtcgccgtaccggggacacgttccggtagatcggaacccgtagttcctaccacgacctcccgtggtctgtcgtctcgtggcgagacggccacgacacactgactaacgtccgacgccgaagtagtttaactttttacacgtacctaccgaacctaaataaggacgtacttaacgttacgtacggtttcgttaccgacgtacgaaaccgaaaccgtaacggaacctacttacccgttacccgttcttaccgttgcccgttaacgtacgtttaccgtcggttaccggtacccgtacccggggtaaccgtcccggttcccgtacgtaccgtacgttacgaggttcggacgacggtcggtcggtacggacgtacgttaccttacgtaccgttcctaacctaccgtacgtacgtaccgcgtaccgtccgtaccgacggtaccggtaaggttacggaaacggttacggtttacgggtacgtaacggttttaacgttttaacgtacggtttaccgtaacggtagtaactttaaacggttacttaacttttacccttaccgttccttaacggtaacgttacgttaaccggacgtaaacgggtaccgggtaagtaacggtaaaccgtaacgaaacgttacgggtacgtacgttccgtaacggtacctactagttaccg

SEQ ID NO: 161329 - DNA, 626 bp, Homo sapiens
  misc_feature: GYAE6OF02G23N8.22.27.C05.1.454.CMB.1.raw
  modified_base (325)..(325): a, c, t, g, unknown or other
  misc_feature (325)..(325): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagacctccctggctgtgtctcgtgggcgagagggccaccatcaactgacaacgtccagccagtagttaattttttacacgtcctccaaccaataagagctacttagctttggttccagcaagaaaccaggacacgtcctcctctactgctcatttacnggcgtctaccggagtcccggggtccctgaccgattcgagtcggacaggtcgggtcgtgggacgagtactttcacttctcaccatacgagcacgcctacgcgacggtcaggaagagttgtcgggcttaaggtttacttacgttacgttcgaacggtacttaaagttacttttagttacctttccgttacctacgtacgttaccggttaccggaccgtaacgggaaccgtaagggtaaccggaaactaccgtaaaacgtaccgttacgggtaccgtacgtacggacctaccgtagttacccgg

SEQ ID NO: 161330 - DNA, 707 bp, Homo sapiens
  misc_feature: GYAE6OF02HCWOU.22.27.C05.1.454.CMB.1.raw
  modified_base (381)..(381): a, c, t, g, unknown or other
  misc_feature (381)..(381): n is a, c, g, or t
tcagacatacgcgtcacgaccggtgctcgatttagacgcgatcgaagggtttgggggctacaacaggcaggcaggggcagcaagatggtgttgcagaccccaggtcttcatttcctctgttgctctggatctcgtggtcgcccgtccggggacagtcgtgatcgaccctagtcctccgacgaccttccgtggctgtcgtctcgtgggcgaggaccggaccacactacaacgtgactacgtccacgcaagttagttttaacttttacacgtcctacccaacaaagtaagtacgtacttacgttcgtcgtttcggtaccactacgtaaacgaaaccgtagactaccttccctcctactacgtcgtccttactacgtttacggnggtccgtacccgtaaccggtaccggttcccgggtcctacggaccttatcggacgtcggcgtacgggtcggtacgtacgggaatacgttacgtctacgtcctaaccgactatcgacggccacggtccgagacggtacggctaaggtaagtgtcgggtactactttagttactcgtagaccgtagtacgtaatttacgtttaacctaccgtttccctaacccgttgaaccgtttaccggtaccgaaccggtaaacggtacggtaaaggtaacctaacgtaaacgaaccgttaggttccggacgttaccacggttccacgtacgttccc

SEQ ID NO: 161331 - DNA, 744 bp, Homo sapiens
  misc_feature: GYAE6OF02G33G0.22.27.C05.1.454.CMB.1.raw
  modified_base (313)..(313): a, c, t, g, unknown or other
  misc_feature (313)..(313): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagtctccaccaataagagttacttagcttggttccagcaagaaaccaggacatcgtcctgcactgctctatttacgnggctaccgtaccgggacgtccggggtcctgaccgtattcgaggtggcgtacggcgggtcgtggacgtagtactttaccaccttctccaacctagtacgagcctacgccctgactacgggaccttaggaaacggtgttacgggtacgggttactttaaggtttttaacgttagttttaccgggtaccgttaaaggtaccttaaaagttttacgtttttaacgtttaaccctttttaccccgttccctttaaaccggtaaacgggtttaaccccgggttttacccggggtaaccccggtaaaaccggggttaaccggtaaaaacggggttacgggttaaaaaaccttaacccggtaaaaaacccgggttaacgtttaacggggttcccgggtaaccgtttaaccggaccccgtaacccgttaacgtttcccgg

SEQ ID NO: 161332 - DNA, 732 bp, Homo sapiens
  misc_feature: GYAE6OF02IN1DB.22.27.C05.1.454.CMB.1.raw
  modified_base (547)..(547): a, c, t, g, unknown or other
  misc_feature (547)..(547): n is a, c, g, or t
  modified_base (716)..(716): a, c, t, g, unknown or other
  misc_feature (716)..(716): n is a, c, g, or t
tcagacatacgcgtcacgaccggtgctcgatttagacgcgatcgaagggtttggggggaggctacaacaggcaggcaggggcagcaagatggtgttgcagaccacggtcttcatttctctgttgctctggatctctggtgccgtccggggacatcgtgacgtcgacccgagtcctaccacgtacctcccgtcggtctggttcgtcctcggtcggggcggagggacgggcccaacctacgtaccaacgtgactaacggtaccacggaccgagtacgtttaacttttttacgacgtcctaccctaacaaactaacgacgtaccttaacttacgtccgttcggtacctacggacaaacggtaaaccgacggtactaacttccctcctactacgtctcctacttacttacgtcggtccgtaccggtacccggtaacgtcccgggtccgtacggtacctacgtacgacggtcggaccggtacgggtcggtacgtacgggactagttacttacgtcctaccactacccatcgacgctagccgtgactacgggngtacgtaaggcttggacgtaactttagtttaactcgtacgtaccgagtacctaactttaagttccttacgttccctagtaccgtacgtttaccgggaccgtaacgggaaacccgggtacgtaaggtacggttaaacctaacggaaaccgtacggttcgccggttaaccncgtaaccctgttaccg

SEQ ID NO: 161333 - DNA, 665 bp, Homo sapiens
  misc_feature: GYAE6OF02I5ESB.22.27.C05.1.454.CMB.1.raw
  modified_base (477)..(477): a, c, t, g, unknown or other
  misc_feature (477)..(477): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagacgggccaccatcaactgacaacgtccagccagtagttatttttacagctaccacaataagagtactactagtcgttggttccagacaacgaaaccaggacactcctcctctactcgctctattacgtggtccgtcgtaacccgggtacgtccgggtcccacgtaccgacgttacgacggtcgacgtacggtcgggtcgtagggaccgtaagtacgtttaccacgttcacctactactaccgaacgccaacgtcctaggaccacgggtcctaggtaaacgngtccggttaggtacgttaagtttacgttacgtcgtacgaacgttataaacgttaactttagttaactttcccctcgttaaccgtacggtaccggttacggaccgtaacgggtaaccgtaaggggtaaccgtaaacgtacgtaaaaccgtacggtacggttacggtcctaaggtacccacgtacttcgg

SEQ ID NO: 161334 - DNA, 681 bp, Homo sapiens
  misc_feature: GYAE6OF02HOB30.22.27.C05.1.454.CMB.1.raw
  modified_base (355)..(355): a, c, t, g, unknown or other
  misc_feature (355)..(355): n is a, c, g, or t
  modified_base (400)..(400): a, c, t, g, unknown or other
  misc_feature (400)..(400): n is a, c, g, or t
tcagacatacgcgtcacgaccggtgctcgatttagacgcgatcgaagggtttggggggctacaacaggcaggcaggggcagcaagatggtgttgcagacccaggtcttcatttctctgttgctctggatctcggtggtgccctccggggacagtcgtgatcgaacccagtcctccagacctcccgtggctgtcgtctcgtgggacgaggacggccaccactacaactgactaacgtccacgaccaaggtagttttatttttaccgacgtacctacccaaccaaataagacgtacttactagtcgttgtaccagacaagaaccagactactcctcctctactcgctactattacgngggtctccggaaccgggtacgtccgggtcctacgctagtcgacgnggagtcgcggtgtacggacaagtctttaccacttctaccaactactacgacgtacaccgtctacgacgtaacggtcgtaggaagttgtacggtagtaacgttttaaagtttccgtactcggactaacggttactaacgtttagttaaaccttaccgttcccttaacgtccgtaaacggttacccgggtaccggtaaccggaacgggtaaccgtaaggggaaccgttaaaactaaccgtaaacggtactacggaccgttacgaccgacttagtaccgttacg

SEQ ID NO: 161335 - DNA, 754 bp, Homo sapiens
  misc_feature: GYAE6OF02I7HW7.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctcggggacatcgtgatgacccagtctccagactccctggctgtgtctcgtgggacgaggacggaccacatcaactgcacgtccagccagtagttatttttacacgtcctaccgaacctaataacgagtactaacttacgtcgttacggttaccacgacgaacgaaaccgaggacctactccctaccttctacgtcgactactacgtttacgtacgggtaccgtaccgttaccgggtaacgttcccggggtacctaccggtaccgtacgtacgtacggtcggtacgacgggtacgggttacgtacgggacgtacgtactttaccgacgtactaccgacctaacttccggaaggtacccacggttaccctcggaaccggtacggtacccgttaaggaacggttacgttaccgggtaggttaacctttaaaggttttacctacggttcgaacgtaccgttaattaaaacgtttatttaccgttaacctttcccgtaacccgtataaccgtttaccggtaccggaaccgtaaacccgggacgttaaacgggtaactaaaccgtaacccgtaaaggtacggttacggtaccggtaaccctagggtaccctaacccttcg

SEQ ID NO: 161336 - DNA, 631 bp, Homo sapiens
  misc_feature: GYAE6OF02F0XTC.22.27.C05.1.454.CMB.1.raw
tcagacatacgcgtcacgaccggtgctcgatttagacgcgatcgaagggtttgggggctacaacaggcaggcaggggcagcaagatggtgttgcagaccccaggtcttcatttctctgttgctctggatctctggtgcctccggggacatcgtgatgacccagtctccagactccctggctgtgtctcgtgggcgagagggccaccatccaactgacagtccagccagagttatttttacagcctccaccaataagagctacttagcttggttccagcagaaaccaggacagtcctcctctactgctctatttacgtcgggcgtcgtacccgggaacgttcccggggtccctcggacccgtattccacggtggcgacggtcgggtacgtggacagtacttcacctctaccactactcagcaacgccgtgaccgtaggctaggaacgtagtggtacggtctaagtttattagtttgtacaagtctaattaagtttactaacgtttccctactaccgtagttacccgtacgggaccgaacgggtaacccgtaaggggtaaccgtaaaaccgttaaccgaaaacgttaacgttacgggtcggtaacgttccggaacctaccgtacgttacccgg

SEQ ID NO: 161337 - DNA, 1043 bp, Homo sapiens
  misc_feature: GYAE6OF02JQY1E.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacacgtcgtgagtcgacccaggtcctccacgacctcccgtcggcctgtcgtcgttcgtcgggcgacggagggcccaaccgactacgtaacctaggacctaacggtaccacggcccgtaaagtacgttttaacttttttaaccgaacggtcctacccgaacctaaagtaaacgacggaccttaacgttaacgtcgtttcggttacctaaggaccgaaaccgaaaccgtaacggacctaacgttccctaccgtacctaactcgtcctacttacgtttaccggttaccgggtccgttaacccggttacccgggtaaccggttacccggggttcccgtaccggtaacccgttacggttacccgtagggttaccggtaccggttacggggtaccggggttaccgggttacggggtaacccgtaaacggttaccgttttaacccgacccgtttacccgttacccgtaaacccgtacgttaccgtaccggtaaccccgtaccgttacccggttcgaaaccgggtccggtaacccgttaagggtaaacggttaaccggttccggggttaacgggtttccttaaacgggttttttaaccttttaaccgggtacgtttaacggtacccgttaaaacgtttaacggttttaaacgttaaccttttaccgggtttaacccccttacgttaaccccggttaagggggtttaacccccgtttaaccgggaacccggggttaaaacccggggggttaaaccccggttaaaacgggggtttaaaaccgttaaaacccgggttttaaaaaccccggtaaacccggggttttaaacccgggtttacggggttaaaccccggttaaccttttaaacccccgggggtacccttaacccgggggtttttaaccccg

SEQ ID NO: 161338 - DNA, 794 bp, Homo sapiens
  misc_feature: GYAE6OF02HJ4EJ.22.27.C05.1.454.CMB.1.raw
  modified_base (167)..(167): a, c, t, g, unknown or other
  misc_feature (167)..(167): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggactctcgtgcgtccggcgatcgtgatgaccacgtctccncgacgtccctcgcgtgtgtctcgtcggcggacgaggccgaccactactaactacgcaacgtaccgacgaccgacgtaagtttagtttttaccttagccttacccaaccaaataaaggaacgcgttaacctttaagtaccgttcggtttaccgtaacgacgaacgtaaaaccgaacggtaacgtactacccttcccgttccttaccgtacggtcctacttacttttaacgttccgggtcggttacccgtacccgggtaaccggtacccggggttcccgtacgtacggtacttgcgtaggccgacggtcgggtcgtcgggacgtaacgtactttcgtaccctctaccaacctactaccgtagaacgtccgtacccgtgtaccggaacggtcgtaaggaaactaggttgtacgggtactttaaacgttttacgttagtaccggttacaacggtaacgtaacttttaaagttttacgtttaacctttccccgtttaaccgtacgtaacgggtttaacccgttaccgggaccgtaacggggtaacctaaggggtaaacgttaaaaacgttaaaacccggacggttcgttacgggtactaacccgtacccgtaaaccgttcttagtttcccgg

SEQ ID NO: 161339 - DNA, 754 bp, Homo sapiens
  misc_feature: GYAE6OF02JKSRC.22.27.C05.1.454.CMB.1.raw
  modified_base (450)..(450): a, c, t, g, unknown or other
  misc_feature (450)..(450): n is a, c, g, or t
tcagacatacgcgtcacgaccggtgctcgatttagacgcgatcgaagggtttggggggctacgaacaggcaggcaggggcagcaagatggtgttgcagacccaggtctcatttctctgttgctctggatctctggtgcctccggggacagtcgtgatcgaccagtctccagacctccgtgctgtgtctcgtgggcgaggacggcctaccagtacactcggacaacgtccagtccagtagttaactttttacgatacctaccgtaaacctaaataaacggtagaccttaacgtttaacggcttttacgggttaccacgtacgtaaaccgtaaaccgagggtaacctacgttacccgttccgttaccgtaaccgtcggtacttacgtaaccgttttaacggcgggtaccgttaccggtaacccgggtacgttcccggggtcctagtaccgtnttcgaaggtcgacgacggtcgggtactcgggaacagttaacgttccgacgtactaccgtacgacttaccgaggctaaccggtccttaaggaccggaacggtcgttaagaacgggtttagtacggttacggttattaaaccggtttataacccggtgtaactaaccggttacttaaacgtttactttagtaacccgtttccctagttaacgtaagttaccggtccgtaagaaaccgggtacgtaagggtacttaaacgtacccaacggttaaggtcggtaacgctaccggacgtactcttaccgg

SEQ ID NO: 161340 - DNA, 622 bp, Homo sapiens
  misc_feature: GYAE6OF02HMEWB.22.27.C05.1.454.CMB.1.raw
  modified_base (609)..(609): a, c, t, g, unknown or other
  misc_feature (609)..(609): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctccctggctgtgtctcgtgggcgaggagggccaccatcaactgcaagtccagccagtagttatttttacagcctaccaccaataagagcttaacttacgtcttggttaccagaccaacgaaaaccgaggaactactccctcctctactgtcctctatttacgtgggtccgtccgtaacccgggaacgttcccggggtcctacggaccgtattcgtaggtcggcgagggtcggtcgtacgggactagtactttaccgactccgtacaaccctataccgacgccacggtcctcggcgacggtacgtagaaagtagtggtaggtacttaggtttaattaccgtgtaccgagtactaattatttaacttctttcctctactacgtacgttccgaacgtaacggaacgaaggtagaaactacgaaaccgacgtgccggtntacgactactacg

SEQ ID NO: 161341 - DNA, 739 bp, Homo sapiens
  misc_feature: GYAE6OF02JBT2M.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacagtcgtgatcgacccagtctccgagacctcccgtggcctgtcggtctcgtgggcgaggacgggccaccatcactgcaacgtccacgccgagtagtttatttttacgaggcctaccaaccaattaacggacgtccgttaacttacgttctttaccgggttccaaggtccgaaacggaaaacccagggaacctaacttccccttaccttaccttacgtcggtactaccttacttttaaccggtcgggtcccggtttcccgtaaccccgggttaaccggtccccgggggtaccctacggtaccgtaacctttcggtacggtcggcggtacggtccggggttcggtaaggggccttagggttaacctttctaaccgtccttaccgtacccaggttaccacggtcaaccggtccgttcgacgtcggtactagggtagtacgttagggccgtacgtttgttttattggttacttacgattataacttaattcgttaacttccctacgtaccgtacgtaccggtttccgaacgtaagggtaccctaagggtacgtaaaccacgtaacgacggttcgaggtactaccggtacactacg

SEQ ID NO: 161342 - DNA, 730 bp, Homo sapiens
  misc_feature: GYAE6OF02GBES2.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagacctccctggctgtgtctcgtgggcgagagggcccacatcaactgacaagtccagccgaagtaagttatttttacgagtccgtaccaacctaaataagactaccgttaacgttacgtcgtttacggttaccgaacgacgaaccgtaaaaccgtacggacctaacttccctcccttaccttaacgtcgtcctacgtaattttaacgtcgggtaccgttacccgtaacccgggtaccggttccccggggtcctacggtaccgtacgttacgacgtcggccgaagggtcggtacggtacgggaactagtacgtttactacgtccgtaacgactacacgtacgacgaccgtccacggtaacgtggtacctaagggaataggtacggttagaccgtttaagtttacgtacttagggaccaagtacaagtttaacttaacgttacccttcctactaccgggtataccgggttaccacggtaacggtaccgtaaacgggttaacaaccgtaaacgtaacggttaacgtgggtaccggtaccgtacgaaccgtaccctagtttaacccg

SEQ ID NO: 161343 - DNA, 598 bp, Homo sapiens
  misc_feature: GYAE6OF02IBYX3.22.27.C05.1.454.CMB.1.raw
  modified_base (511)..(511): a, c, t, g, unknown or other
  misc_feature (511)..(511): n is a, c, g, or t
  modified_base (570)..(570): a, c, t, g, unknown or other
  misc_feature (570)..(570): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactcctggctgtgtctcgtgggcgagagggccacatcaactgcaacgtccagccagagttatttttacagtcctaccaaccaataagagtactacttagtcttggttaccagtacagaaaccaggacactccctacctctactcgctactatttacgtggtccgtccgtaccgggacgttccgggtcctagaccgtagttcgagtcggacgtggtacggtcgtgggtacagttacgtttacaccgttcctaccaccgaactcgaacgccgagtccctgacggaaggtccgtagaacgtggtgtggtaccgttatttacgtcgtgtacagtatattacttnttacttccactcgacgtcgttcggacgtaacggacgtaaggtagtaaccaggtaaaccncgttgggaccgtagtctacccgtatacg

SEQ ID NO: 161344 - DNA, 679 bp, Homo sapiens
  misc_feature: GYAE6OF02HUI5S.22.27.C05.1.454.CMB.1.raw
  modified_base (553)..(553): a, c, t, g, unknown or other
  misc_feature (553)..(553): n is a, c, g, or t
  modified_base (562)..(562): a, c, t, g, unknown or other
  misc_feature (562)..(562): n is a, c, g, or t
  modified_base (572)..(572): a, c, t, g, unknown or other
  misc_feature (572)..(572): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtcgtctcgtcgggcgaggagggccacctatcaaactcgacaacgtccacgccaagtacgttatttttacagcctaccaacaagaacgtagacttacctagtctttcgttaccagacaacgtaaacgacgacactcccgtactacctactacgcctacgttaatttacggtcgggtaccgttaccgtaacccgggtaaccgttccggggtccctacggaacctacgttaccgaggttcggacgtcgggtacgggtaccgtacgggtaacgtacggtacttaccgacgtacccttaccgacctacgtcgacggtactacgcgttacggcgacggtcgtacgaagttaggcgtagacttaagtttactcgtanacgtaactntaaacgtttnttaacgttactcccgtctaaccgtgttaccgtaccggagtaaccggtaacgagggtaagtaaccgtaacgaacgttaacgtggtaccgttaggacacccgtactacg

SEQ ID NO: 161345 - DNA, 860 bp, Homo sapiens
  misc_feature: GYAE6OF02HZ263.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtcgccgtccggggacatcgtgatcgacccagtcctccagactccctggctgtcgtctcgtgggcgaggcgggcccaccatcaactgacaagtccagaccgaagtacgtttatttttacgacgtcctaccaacctaaaagttaaagacgtaaccttaacgtttaacggtccgtttacgggtttaccaacggtaaccgaaacggtaaaaccgaacggggtaaaccctaacttcccccgttaccgttaacctacgttacgtccgtttaacctaacgttttaccggttacggggtaccgttacccggttaaaccccggggtaaccggtttcccccgggggtaccgttaccggtaacccgttacgttacggtacgggttacggcggtaacgggtccggggttaccggtacggggaaccttaaacggttaccgttttaccctaccgggtttacctacccgaaccgttacgtacgaccgttaccgacgccgttacgacggtaacggtccgtaagaacggttagtccgggtacgtacgtttaacgtttacgttacgttaccgtagtacgtaacgtaatttaactaacgttccgttaccctacgtcgttaacccggttacgttaccggtaaaccgtaacgggtaacggtaaccgggttaaagtaaaccgttaacccgaaaaggttccggtaacgggttaccgtaccggtaacggtaccccgtacttaaccggg

SEQ ID NO: 161346 - DNA, 587 bp, Homo sapiens
  misc_feature: GYAE6OF02HIGN1.22.27.C05.1.454.CMB.1.raw
  modified_base (581)..(581): a, c, t, g, unknown or other
  misc_feature (581)..(581): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagtagttatttttacagtcctccaccaataagagtctacttagcttggttaccagcaagaaaccaggacatccctcctctactgctctatttacgtggccgtccgtacccgggaatcccggggtccctagaccgtatcgagtggacaggcggtcgtgggacagtacttcactctcactagtcacgcacgccgttgcgacggataggaaacgtgtaggtcggtacttagttttactacgtcggtacaggtacttaaagtactttagttacctttacctccgtaacgtacgtaccgtccgacggaacggtaacggaacgttagaaactaacgaaaccgtgtaggtcgcctagactacgtnttaccg

SEQ ID NO: 161347 - DNA, 751 bp, Homo sapiens
  misc_feature: GYAE6OF02HU0I2.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagacctccctggctgtgtctcgtgggcgaggacgggccaaccactacaactcgacaacgtaccgagaccaagtagttaattttttacacgtcctaccaaccaaagtaaacgtacgtacttaacttacgtcgtttacggttaccacgacgaacgaaaaccgaggaacctacttcccttacctactacgtcgtcttactacgtttaccgtcgggtccgttaccggtaacccgggtaacggtccccggggtaccgtacggtaaccgtacgtccgtacggtcggacgtacgggtccgggtacgtacgggacgtacgttacgtttaccgaccttaccgtacctaacctacgtccgacggccaacgtccgtacggactacgggtctaaggaacgtaggttcggtgggtacctttaagtttacgttacctaggtctaaccgtaattaacgtttacttacgttaccttcccgttaacgtacgtacgggttaccgtaccggtaaccggaaggtaaaccggttggtaaaccggtaaacgtaaccgaaacgttacggtcggtaacggtaccctacggtaccctacgttcttaacg

SEQ ID NO: 161348 - DNA, 786 bp, Homo sapiens
  misc_feature: GYAE6OF02HD17G.22.27.C05.1.454.CMB.1.raw
  modified_base (353)..(353): a, c, t, g, unknown or other
  misc_feature (353)..(353): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctgatctctggtgcctccgggacatcgtgatcgaccagtctccagactcctggctgtgtctcgtgggcgagacgggccaccatcgaactcgacaacgtccagccagtagttactttttacacgtctaccacaataagacgactacttagtctttcggttccagacgaacgaaacctaggactaaccgttcctaccttaccgtacgtcgtacctcttaacgttttaccgnggtcgttacccgtaacccgggtacggttcccggggtcccttacgaccggtatacccgtaggtccggacgtacgggtccggggttacggtacgggtaaccgtagtaacgtttttccgaccgttttacccaccgtaacctacgttacgaacgttacgaaccgtaccgttcggaccgtacggtacgtaacggtaacgttacggttacggtcggttaacgttaacgggttttacttaccggttagttaccgaaacggttactttaacgtttaaactttaacgtttaacctttcccttaccgttaaccgtaccgggtttacccggttaccgggtaaccggtaacgggtaaaccgggtaacggttaaaccgggtaaaaccgttaacgaaaaccgttaccggttaaggtccgtaacggttacgtaaccgacctttaaccg

SEQ ID NO: 161349 - DNA, 696 bp, Homo sapiens
  misc_feature: GYAE6OF02G5NLJ.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccgggacatcgtgatgacccagtctccagactccctggctgtgtctctgggcgagagggccaccactcaactgcaacgtccagccagtagtttatttttacacgctaccaaccaataagagacttaacttagtctttggttccagacaagaaaccaggacactcctcctactacctgctactatttacgtgggtccgtccgtacccgggtacgtcccggggtccctagaccgtattcgaggtcggaccaggtcgggtcgtagggactagtactttacgaccttctaccacgtaactccgagacctaccggtcccgttcggacgacggggtactaggtaacgtagttccggttacggactttaagttttaaccttacgtcggttaacaaccgttaattaaacttttaacgtttaactttacccttacccgtttacctaaccgttaacgggtacccggttaccgacccggtaaaggggtaaccccggtaaagggttacggaaaacttaacccggaaaccgttaggttcggtacgtaaccggtcaaccgtaccttacg

SEQ ID NO: 161350 - DNA, 832 bp, Homo sapiens
  misc_feature: GYAE6OF02I81OF.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcactttccctgttgctcgtggatctcgtggtgccgtccggggacagtcgtgatcgaccagtctccagtacctccctggctgtcgtctcgtgggcgagcgggaccaccgtactacaacgtgacaacgtccagaccaggtacgttacttttacgagtcctacaacctaaatacgaacgtcttaacgttacgtcgttacggttaccaggactaacggaaaccgtaacggtaccacgttaccctctacccgttagtaccgtcgttactaacgtttacgtacgggtccgttaacggtaaccccgggtacgttccccggggttacctacggtaccgtacgtacgacggtacggaacgtcgggtccggggttacgtaaggggtaccgttaacgttcgttttaaccaccttcgtaaccctacggtaaccttaccgacggtacccgtaaccggtcgtaccggttaacgtacgggttacggtaaacgttacgtttaacggttttacgtaaacccgtttaacgtttttaaccttaacgtcgttaacgtaaccttaacttaacggttaaacttgtacggttacgttaccggtttacgtccgtaacttaccgtaaccggtttccggaaccggttaacggtaacccggtaaccggtaccgggttaaaggtaaccgttaaacgttaaaccggtaccgggttacggtacggttacccgtacgttacgtaacccgtttccgg

SEQ ID NO: 161351 - DNA, 801 bp, Homo sapiens
  misc_feature: GYAE6OF02JHC2V.22.27.C05.1.454.CMB.1.raw
  modified_base (777)..(777): a, c, t, g, unknown or other
  misc_feature (777)..(777): n is a, c, g, or t
tcagacatacgcgtcacgaccggtgctcgatttagacgcgatcgaagggtttgggggagctacaacaggcaggcaggggcagtaagatggtgttgcagacccaggtcttcatttctcgtgttgctctgatctctggtgccgtcgggactatcgtgagtcgacccgagtctcagacctcctggctgtgtctacgtggcgaggacggccacactacaacgtcgacgtaacgtccgaacgaccaaggtacgttttactttttacgcgtacccttacccaactaaataacgtacgtaccttaccggtacgttccggtttacgggttaccacggtaccgtaaaaccggaaaccgtcggtaaccgtacccttacccgtacccttataccgttacgtcctacgtttacgtttaccggccgggtacccgttaccgggaacccgggtaacggttccccggggttacctacggtacccgttacgtacgtaaccgggtcgacggtacggggtaccgggttacggaagggtaccgttaagtttaacctttccggaaacttacgtcccgtaaaccgtacgtaccggacgtacgtccgaccttccggaacgacgtacgtaaagggcgtaaggtcgtaacgttacgtatttaacgtccgtagtcacggttaactacgtttaacttacgttaccttccgtacttacggtaacgggtaccgttaccggacggaaccgtaaccgggtaaggaacggttaccctaaacggtaacgttccggtaagtcccggttacncggtaaccgtacttaccgttacgg

SEQ ID NO: 161352 - DNA, 631 bp, Homo sapiens
  misc_feature: GYAE6OF02GEQKM.22.27.C05.1.454.CMB.1.raw
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctgtgcctccggggacatcgtgatgacccagtctccagacctccctggctgtgtctcgtgggcgaggagggccaccatcaactgacaagtccagccagtagttatttttacagtctaccaccaaataagagcttaacttagtcttcggttaccagacaagaaaccaggacactcccgtcctctactgactctattctggcgtcgtacccggtaagtcccgggtcctagaccctatcgtagtcggacgtacggcgggttacgtcggggaactagttacgtttacgacctcgtaccacctanccgtancgtacgcctgcacggctagaacgtgtcggagtacgttagtttacttagttcgtacgagtactaatttaagttacttacttcccgtcttaactacgggtacccttacgggaaccgaacgggaaccggtaaggtaaacggtaaacgttaaccgaaacggtaacctagggtaccggactcggtaaccgccttaacg

SEQ ID NO: 161353 - DNA, 712 bp, Homo sapiens
  misc_feature: GYAE6OF02GMNCT.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctaccaccaataagagctacttagcttggttccagcaagaaaccaggacactaccctcctctactgctactatttacgtgggtccgtactaacccgggtaacgtccggggtccctaggacccgtatttcgaacgttcggacgaacggtcgggtcgtagggaacctaaggtaactttcgacttacccgtacaaccgtacttaccgaacgccgtaacgtccccgttaggacccgaagggtccgtaaggaaacgtaacgttggttacggtaacgttaagtttttaccgtaacgtttacggtacgtaagtaacgttaaatttaacgtttaactttaccttcccttaccgtacgtaacggttacccgttaccggtaaccgtaaacggggttaacccgaaaggggttaaccgaaaaacgttacccgaaaaacggtacttacgggtacggtacctagggtacccctaactagttacccgg

SEQ ID NO: 161354 - DNA, 797 bp, Homo sapiens
  misc_feature: GYAE6OF02JWQQ3.22.27.C05.1.454.CMB.1.raw
tcagacatacgcgtcacgaccggtgctcgatttagacgcgatcgaagggtttgggggagctacaacaggcaggcaggggcagcaagatggtgttgcagaccaggtcttcatttctctgttgctctggatctctggtgcctccggggacagtcgtgatgacccagtctccagactccctggctgtgtctctgggtcgaggcgggccaccactcaactcgtcaacgtccagccagagttactttttacagtcctaccaacctaataagacgcttaacgttaacgtctttcggttaccagactaacggaaaacccgtaggaacctacgtccccttaccgtaccttaccgcgtaccttaccgtaagttttaaccgtcggggaccgtttacccggtaaaccccggggtaaccggtttcccgggggtacccctaccggtaacccggttagttaacccgtaggtaccgggtacgtacgggtccggggttacgttacggggggtactacggtaaacgttttccgaccgtttacccgttaccgtaacccgtacgtaacccgtaacggtacccgtaacggtccggttacggaccgttagggaccctagggaaacgttacggttgtaacgggtcttaacgtttacgttaacgttcgtacgaataccgtaattaacgtttactaacttcccgtactacgtaccgtacggttcccggtaacgtaaccgggaaccgttaacgggaacggtaaactaaccgttaaacgaccggttacgggaacggttccgtaacgccgttaacccgttacgg

SEQ ID NO: 161355 - DNA, 725 bp, Homo sapiens
  misc_feature: GYAE6OF02HW6O3.22.27.C05.1.454.CMB.1.raw
  modified_base (306)..(306): a, c, t, g, unknown or other
  misc_feature (306)..(306): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagacctccctggctgtgtctcgtgggcgaggacgggccaccactcaactgacaacgtccacgaccaagtaagtttactttttaacagtctaccacaaataagagtctactagcgttgtccagcaacgaaacaggactancccttcctctactgctctattacgtggtccgtacgacccgggtagtcccggggtcctaggtaccgtattccggacgtggcgacgggtcgggtcgtacggggaactaacgtctttaccgaccgttctacccgaccgtaattccgaagccgtaacgtcccgtggaaccgacgggttaacacgggtaaagtacttacgggtccggttaacgttaacggtttttaaataccggttacggtaccgtaaggtaacctaaagtttaagtttaaccttaacctttccctaccgttacgaaccgggttaccgtaacgggacccgtaaaggggtaaacccgtaaggggtaaccgttaaaactaaacccggtaaaaggtacccggttggtaacgggtcctacccggtaacgttaaccctacggttacccg

SEQ ID NO: 161356 - DNA, 712 bp, Homo sapiens
  misc_feature: GYAE6OF02H88MG.22.27.C05.1.454.CMB.1.raw
  modified_base (554)..(554): a, c, t, g, unknown or other
  misc_feature (554)..(554): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtcgccgtccggggacatcgtgatcgacccagtctccagacctccctggctgtgtctcgtgggcgagacgggccaacactacaactgacaacgtccagccaagagttactttttacagtcctaccaacaataaacgacgactaacgttagcgtttcggttaccgagtaccgaacgaaaaccgaggaactaaccttccctaccttaccgtacgtcgtccttactaacgtttacggtcgggtaccgtaccggtaacccgggtaacgtcccggggtacctacggaccgtactacgagtcggacgacggtcgggtcgtgggaactagtaccttcgactacctacctaacgactcgaacgtcaacggtcctacggcgtaacggctaggaacgtgtacgtacgggtcttaacgtttacttacggngtaaccggtaataaccctaaagttacgttttactacgtttcccctacgaaccgttacgtaacggttcccgtaaaccggaacgggtaaccgaaaaggttcggaaaactaaccgtaaaccgacggtaggtaccgaaccgtacctacggtacctaacccgg

SEQ ID NO: 161357 - DNA, 792 bp, Homo sapiens
  misc_feature: GYAE6OF02HPOJG.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctcgttgctctggatctctggtgcctccggggacatcgtgatgacccagtctccagactccctggctgtgtctcgtgggcgtagacgggtccaccatcaactgactaagtccacgccacgtaagttatttttacagtacctaccgaacctaataagacgtactaacttagaccttacggttccaacgtacaacggaaaccaggaactactcctacctacctacgtcgactcgtaacgttttacgtcgggtaccgtccgtaaccccgggtaaacgttcccggggtaccctacggtaccgtaacgttctaggtacgggcctacgggcggttacgtacggggtactaagtactttaccgacttaccgtacacctaacgtcctaacggtacgacggtccttcggacgtaacgggtaccgttaggaacggttacgttacggttacggttaacgttaacggtttaaccttaacggttacgtaacccgtaagtaccgtaaacgttaatttaaccgtttaaccgtttacccgttaccgtaaccggtaacggttaacccggttccggaaacccggttaacgggggtaaccctaaaagggggttaacccgaaaacgtttaccggaaaacccgttaacgggttacggtaaccggttcgttaacccgggtaccttacccggttaaccg

SEQ ID NO: 161358 - DNA, 737 bp, Homo sapiens
  misc_feature: GYAE6OF02H0B7R.22.27.C05.1.454.CMB.1.raw
  modified_base (481)..(481): a, c, t, g, unknown or other
  misc_feature (481)..(481): n is a, c, g, or t
  modified_base (656)..(656): a, c, t, g, unknown or other
  misc_feature (656)..(656): n is a, c, g, or t
  modified_base (660)..(660): a, c, t, g, unknown or other
  misc_feature (660)..(660): n is a, c, g, or t
tcagacatacgcgtcacgaccggtgctcgatttagacgcgatcgaagggttgggggctacaacaggcaggcaggggcagcaagatggtgttgcagacccaggtcttcatttctctgttcgctctggatctctggtgccgtccggggacatccgtgatcgacccagtctcccgagtacctcccgtggccttgtcgtcgtcgtcggcgacggacgggccacctactaccaactcggactaaccgtccgacgtaccaagggttacttaacgtttttaacaccggtacttacccaaccgtaaagtaacgacggttacttaacgttacgtccgttttcgttaaccgacgtaccgaaaccgaaaacccgtaggtaacctacctcccgtacccttaacgtacctacgtaccttactacgtttacggtcgggttcccgtaaccggtaaccgggtccgtccccggggtccgtacgtaccgtacgttacgnggtacggaccgtgggtaccgggtacgtacgggacttaccgttattcccgtactacccgtcctaaaccgtcgttaccgccgtaacgtaccgtccgtaggtacacggtccgtaagacgtagtgtaaccggtcttagttttacgatcgaagtcgtaacttagtacttctacgtttccncgtnaaccggttcgacgaccgtaacggtactaacgttacacgtacgtaacctcggtatccggtactacgactcgtacgttc

SEQ ID NO: 161359 - DNA, 702 bp, Homo sapiens
  misc_feature: GYAE6OF02H0UJ7.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagacctccctggctgtcgtctcgtgggcgaggacgggccaccactcaactgacaagtccagccagagttatttttacacgctaccaacaataacgagactacgttagtcttcggtaccacgacaacgaaaaccgaggaactactccctacctactacgtcgctactaactttacgtcgggtccgtaccggtaacccgggtaacggtccccgggggtaccgtacgtacccgtaacgttcgacgggttacggcgtaacgggtcgggttccgtaacggggtactaggttactttaccgtaaccttccgtaccgtaacctaactccgtaacgaccgtacgcccgtggaccgacggtaccgtaggaacgtaagttcggtacgtacggttaagttttactacgtcgtacgaagttaacaagttaactttaataccttaccctacgtcaacgttaccgttaccgaccgggtaacggtaaccgaaaggttaacggaaactaacgtaaacgaacgttcggacgtactcggaccgtacacttacg

SEQ ID NO: 161360 - DNA, 859 bp, Homo sapiens
  misc_feature: GYAE6OF02IUY9F.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtcgcccgtccggggacatcgtgatcgacccagtctccagcctccctggctgtgtctcgtggcgaggacggccaccgatcaactcgacaacgtccacgactagtagttttacttttacacgtacctaccaaccaataacgacgtactacttcgtactttcggtaccagacaacgaaccgacggtactacctccctacctactacctacgtccttaccgtactttacggtacgggtcccgttacccggtaacccgggtaccggttaccccgggttaccgtacggtacctaacgttcgacggtcggcgtacgggtacgggttcgacggacgtacgttacttccgtacctactaccgtacgtaaccctgaaccgtcgaccgttccggtaccgacgtaacgggtgtaaacggaacggtcgttacggttaggttaaccggtttagtttacgttacggttaccggtaacgaaccgtttaacgttaaacgttttaaccgtttaaccgtttacccgttttaaccccgttaacccgtaaaccgggtttaacccgggtttaaccggggtttaaccccgggaaacccggtaacgggggtttaaaaacccgttaacgggggttaaacccgttaaaaacgtaaaccccgggtttaaaacccgggtaacggtttacgggtaacccggtaaacccgtttaccgggtaaaaccccgttcccgtttaacccgttttacccggg

SEQ ID NO: 161361 - DNA, 883 bp, Homo sapiens
  misc_feature: GYAE6OF02IS5QO.22.27.C05.1.454.CMB.1.raw
tcagacatacgcgtcacgaccggtgctcgatttagacgcgatcgaagggtttggggggagctacaacaggcaggcaggggcagcaagatggtgttgcagacccaggtcttcatttctctgttgctctggatctctggtgccgtccggggacatcgtgatcgacccagtcctccagacctccctggctgtgtctcgtgggacgagcgggccaccactcaactcgactaacgtccagaccagtagtttactttttacacgcctacccaacaataacgacgtctaacttagtcgttcggttaccagaccaagaaacccgaggtaacctactaccccttcccgtactaccgtacgtccttacctagtttaccggtcgggtaccgttacccggttaaccccgggggtaaccggttccccggggtacccgtaccggtacccggtacgttaccgacgggttccgggacggtaacgggtccgggggttaccgggtacggggtaaaccgtaacggttaaccttttacccgtaaccgtttccgtaacccctaacccgttaacgtaacccggtaacggtcccggtaaacccgggtcccgttaccgggaaccgggtaacgggttaacccggtaaagggtaaaccgttagggtttaccggttacggggttacctttaaggtttttaaccgtacgtttacggtacgtaaacgttacttaaacgtttaacttaacgtttaccctttacccgtacgttaccgtaacggttacccgggtaccggtaaaccggtaaaccgggggaacgttaaaccggggttaacggaaacccgttaaaccggtaaacggtaaccggttacggggtaccttaaccgggtccggaacccttaccggttaacgg

SEQ ID NO: 161362 - DNA, 788 bp, Homo sapiens
  misc_feature: GYAE6OF02H3VMS.22.27.C05.1.454.CMB.1.raw
  modified_base (775)..(775): a, c, t, g, unknown or other
  misc_feature (775)..(775): n is a, c, g, or t
tcagacatacgcgtcacgaccggtgctcgatttagacgcgatcgaagggtttggggggagctacaacaggcaggcaggggcagcaagatggtgttgcagacccaggtcttcatttctctgttgctctggatctctggtgccgtccggggacatcgtgatcgacccacgtctccacgacctccctggctcgtgtctcgtgggcgaggacgggccaccatacaacgtgcagtccacgccagtaagttaatttttacagtcctaccaacctaaataacgacgtaccttaacttgtactttggttaccaggtacacgaaacgacggaccacttccctcctacgtactcgcttactactttacggtcgggtaccgttaccggtaacccgggtaaccggttccccggggttcccgtaacggtacccgtaacgttacgtacgggtcggcggtacggtccgggtacgtacggggaacctacggtactttacgaccctttacgttaccgaccttacgaccgtacggtaccgccgtacccggttaagacccggtacggtaaccgttaagggtaaaccgttcggggtttaccgtacggggtaaaccttttaacgggttttaaacgtaacccggtttacggtaccggtaaacgttaacgtttaaactttaactttaacgttttaacccttccgttaacgtaacgtccgttaacccgggtacgtaaccggaaccgggtaagtaaacgggtcggtaaactaacggaacgtaacggttgtacgacggtanaccgtaataccgg

SEQ ID NO: 161363 - DNA, 960 bp, Homo sapiens
  misc_feature: GYAE6OF02HUJRY.22.27.C05.1.454.CMB.1.raw
  modified_base (149)..(149): a, c, t, g, unknown or other
  misc_feature (149)..(149): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctgatctcgtggtgccgtccggganatcgtgatcgaccctagtcctccgacgtacctccctggcgttgtcgtctcgtgggaccgaggacgggcccaaccactacctaacgtgaccgtaaccgtccgacgaccgtaacggtaacgtttttaacgttttttaaccgaccgttaccctaacccgtaaaccctaaaagtaaacggtacgttaacccgtttaaccgtttacgttacccggttttaccggttaacccgaacggtaaccgaaaaccggtaaaaccctaacgggtaacccttaaccccgtttaccccgtttacccctttaacccgtttaaacccgttccgtaccgtttacccgttaacggtttttaacccgggtaccggggttaccggtttaacccccgggttaaccccggggttaaccccggggtttaccccgggggttacccccttaacgggtaacccggttaccgttaaccgggtaacgggttaccgggtccggtaacggggttccggggtccgggtttaacgggaaccgttaacgttaacccgtttacggtacccttaccccgtacctaaccggtacctaccggtaccgtaccgtacgtccgttaccgggtacgacggttacggtaacgtaacggtacgggttacgtaccgggttacttaaacggttttctaaccgttacgtcgtaacgttaacgtactttaacgttacttacccgtttaccgtacgttaacgttaccggtaaccggttaccgggaaccgtacgggaaccgtaacggtaacgtaacgtacgtaaaccgtggtacggtacgtacgtacgtacctacgtacg

SEQ ID NO: 161364 - DNA, 749 bp, Homo sapiens
  misc_feature: GYAE6OF02FG6AZ.22.27.C05.1.454.CMB.1.raw
  modified_base (532)..(532): a, c, t, g, unknown or other
  misc_feature (532)..(532): n is a, c, g, or t
  modified_base (535)..(535): a, c, t, g, unknown or other
  misc_feature (535)..(535): n is a, c, g, or t
  modified_base (551)..(551): a, c, t, g, unknown or other
  misc_feature (551)..(551): n is a, c, g, or t
  modified_base (574)..(574): a, c, t, g, unknown or other
  misc_feature (574)..(574): n is a, c, g, or t
tcagacatacgcgtcacgaccggtgctcgatttagacgcgatcgaagggtttgggggagctacaacaggcaggcagggcagcaagagtggtgttgcagacccaggtcttcattctctgttgctctggatctcgtggtacgccgtccgggacattccgtgactcgacccagtcctaccacgacctcccgtggtcctgttcgtcttcgtaggaccgaggaccggccctaaccgactaccgaaccgtgaccgacgtacccgaccgacctaggtacgttttaccgtttttaccgaccgttccctacccaaaccgtaactaaacgtcgtaccttaaccgttcgccgttttaccggtaccgagtaaccaaccgtaaccggactacctacctccgtacctactacgtcgtactacgttacgtttacgcggtccgttaaccggtacccggtaccgtccggtacccgtacgtaccgtactcgtacggtcgacgtacggtcgggtctacggaactcgtacttccgactccgtaccaccgtanccncgacacgtcgtgacgngtaacgtagtaacgtgtacggtnttaaccgtgttttaccgacttagtacctacgttaataaccgttaacttaacgttacccgaccgtaccgtacgtaacccgttaccgtaccggaaccggtaacggtaacccggaaaggtaaccgttaactaaaccgaacgtcggttaaccggcgtacccgtctaccctacgttaccg

SEQ ID NO: 161365 - DNA, 682 bp, Homo sapiens
  misc_feature: GYAE6OF02IK9L6.22.27.C05.1.454.CMB.1.raw
tcagacatacgcgtcacgaccggtgctcgatttagacgcgatcgaagggtttggggggctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatacaactgcaagtccagccagtagttattttacagtctaccaaccaaagtaagacgacttaacgttacgtcgtttacggttaccacgacaacgaaaaccgtagacgtactccctccttacctaacgtcgcttactaactttacgtcgggtacgtaccgtaaccgggtaacgttccggggtccctaggaccgtattcgagtcggacgtggtcggtcggtacgggactacgtaactttacctactccgtaccaaccgtacgtacgaacgctacggcccgttaggccgaggcgttaagaagtgttaggtgtaaccgttagtttacgttatacggtacaagtacttaaattacgttacttaccgttcctacgtaccgttaaacggtccgttacgggaccgaacgggaacggtaaaggtaacgtaaacttaaacggaagttaacgttagggtcgtacgtaaccgaccgtactagttaccg

SEQ ID NO: 161366 - DNA, 735 bp, Homo sapiens
  misc_feature: GYAE6OF02GJE1W.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatgacccagtctccagacctcccgtggctgtgtctcgtggcgaggaggcccaccataccaacgtgacaacgtccacgccagtagtttactttttacacgtcctaccaaaccaagtaagacgtacttaacttagtcgtttcggttaccagtacaacggaaaccgaaggaacctacctcccgttccttacctaccgtcgtacctacttaacgttttacgtcgggtcccgttaccggtaccccgggtaacgttcccggggtcccttacggaccgtagttccgtaaggtcggacgtacggtccggggttacgtacggggactacggttactttaccgtaccttccgtaccgacctacgtacaacggtcctaacgtcccgtcaccggtacggtaccggtagtacggtagttcggttacggtaccgtttaagtttacgttcgttacgtacgtaacgtactttaattaacgtttaacttaccctttacccttacgtctaacggttccggtaccggacgtacggtaacgtaaggtaacgtaaacgtaccgtaacgtacgtcggtagtaccgttacgaccacgttacg

SEQ ID NO: 161367 - DNA, 667 bp, Homo sapiens
  misc_feature: GYAE6OF02G3QVU.22.27.C05.1.454.CMB.1.raw
  modified_base (469)..(469): a, c, t, g, unknown or other
  misc_feature (469)..(469): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagacgggccaccatcaactgcaagtccagccagagttatttttacagtcctccaccaataagagctaacttagctttggttccagtcaacgaaaccaggacctatccctcctactactgtctactatttacgtgggtccgttaccgtacccgggtacgtcccggggtccctcggaccgtacttcgagtcggctacggcgggtcgtagggactagtactttcacctcgtcctaccactcgacgtacacgtccctggacgtacggcgtacgaagtnttcgggtcggtacttaagttttacttaccgtgttacgacgtactaagttatttaacgttacctttccctaccgttcgaaccggtttaccggttccgggaacccgtaaacggggtaaccgtaagggttaacggtaaaccttaaccggtaaacggtaaccgttgggtaccggttaccgtaggtacccgtacgttaaccgg

SEQ ID NO: 161368 - DNA, 606 bp, Homo sapiens
  misc_feature: GYAE6OF02H29W7.22.27.C05.1.454.CMB.1.raw
  modified_base (251)..(251): a, c, t, g, unknown or other
  misc_feature (251)..(251): n is a, c, g, or t
  modified_base (284)..(284): a, c, t, g, unknown or other
  misc_feature (284)..(284): n is a, c, g, or t
  modified_base (318)..(318): a, c, t, g, unknown or other
  misc_feature (318)..(318): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctgtgcctacggggacattgtgatgacccagtctccagactcctggctgtgtctctgggcgagaggccacatcaactgcaagtccagccagagtatttttacagctccaccaataacgngttaacttagctttcggttccagcaagaaaccnggtaacatcgtctagctactgctcacttttacgnggcgtaccgtaccgggatcccgggtcctgaccatcagtgcagcggtacgtggactaggtactttcgactacgtaccgacaattcgagtccaggtacctcggactagggctacggaacgtagttcggtacgggtacttacggttttaatacgttagtacctaagtacgtaaattagtaactttacctttccgaccttacgaacgttacgttacggaccgtaacgggaaccgtaaaggtcggaaacttacgaaacggtacgtacggtacgtcctacgtacctacgttacg

SEQ ID NO: 161369 - DNA, 744 bp, Homo sapiens
  misc_feature: GYAE6OF02IGGXF.22.27.C05.1.454.CMB.1.raw
  modified_base (153)..(153): a, c, t, g, unknown or other
  misc_feature (153)..(153): n is a, c, g, or t
  modified_base (547)..(547): a, c, t, g, unknown or other
  misc_feature (547)..(547): n is a, c, g, or t
tcagacatacgcgtcacgaccggtgctcgatttagacgcgatcgaagggtttggggggagctacaacaggcaggcaggggcagcaagatggtgttgcagacccaggtcttcatttctctgttgctctggatctctggtgccgtccggggactntcggtgatcgcccagtctccagacctcctggctgtcgtctcgtcgggcgacggacgggccaccatcgaactgacgaacgtccacgccgagtacgtttaactttttaccgacgtcctaccaacgtaacttaacgagtcctacgttacgtacgttcgtccgagaccgtaaacgaccgacgacgtacctcccttaccgttcctacgtcgaccttacgttaacgtttaccggtcgggtacgttaccgggttaaccccggtaaccggttcccgggttaccctcggacccgttacgttcgtacggtaccggtacgagggttccggtacgtacgggtacgtacggttactttaccgtaccgtaccctcctacgaccttacgacgtaaccctccgggttccncggtaccgtacggtacggtcgtaaacggtcggtacgttcggtaacgttatttaccggttaaattccgtacgaacttagtaatttagtttacttacttcccgtagtaccgtcgttaccgttaccggaagtaccggaagttaacggaaccgtaagtaccgtaaacgtcggtcgtaaccggtctacgaccgttaatccgg

SEQ ID NO: 161370 - DNA, 536 bp, Homo sapiens
  misc_feature: GYAE6OF02GRN4R.22.27.C05.1.454.CMB.1.raw
  modified_base (258)..(258): a, c, t, g, unknown or other
  misc_feature (258)..(258): n is a, c, g, or t
  modified_base (319)..(319): a, c, t, g, unknown or other
  misc_feature (319)..(319): n is a, c, g, or t
  modified_base (379)..(379): a, c, t, g, unknown or other
  misc_feature (379)..(379): n is a, c, g, or t
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
  modified_base (419)..(419): a, c, t, g, unknown or other
  misc_feature (419)..(419): n is a, c, g, or t
  modified_base (435)..(435): a, c, t, g, unknown or other
  misc_feature (435)..(435): n is a, c, g, or t
  modified_base (448)..(448): a, c, t, g, unknown or other
  misc_feature (448)..(448): n is a, c, g, or t
  modified_base (460)..(460): a, c, t, g, unknown or other
  misc_feature (460)..(460): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagacctccctggctgtgtctctgggcgagagggccaccatcaactgcaagtccagccagagttatttttacagctaccaccaataaganctacttagcttggttccagctaagaaacaggacatcctcctacgtactgctctatttacgnggtcgtctacccgggtaatcccgggtcctcgactattcagtcgcagcggtctggacagtnttccactctaccacatcagctgacctnacgngctaggaantgtgcttatttatacngtacagctaattnttatacttcctntcgagtccgttcggactaagggaaccaggtaacgtaactaacgaaacgtcttacggcgtacgacgactacccgtag

SEQ ID NO: 161371 - DNA, 833 bp, Homo sapiens
  misc_feature: GYAE6OF02J1B0Y.22.27.C05.1.454.CMB.1.raw
tcagacatacgcgtcacgaccggtgctcgatttagacgcgatcgaagggtttgggggaggctacaacaggcaggcaggggcagcaagatggtgttgcagacccaggtcttcatttctctgttgctctggatctctggtgcctccggggacatcgtgatgacccagtctccagactccctgctgtgtctcgtggcgagagggccaccatcaactgcaagtccagccagagttatttttacacgctaccaacaataacgacgtacttacgttacgtcgtttcggttccgaagcctaaacggaaaacccgtaaggaacctaacgtccccttaccctactaaccttcgtccttaccttacgttttaaccggtcggggtaccggttacccgttaacccccggggtaaacggttccccgggggttaccccgttacggaaccccggttacgttacccgaacggttcgggaccctaacggggtccggggttaccggtacgggggtaaacctaacggttaccgttttacccgaacccgtttaccgtacccgtaacccgtacgtacccggaaacgtcccgtaacggtcccgttggacccggtaagggttaccgtacggaaaacggttcgttacgggttagggaccctttaaggttttaaccttacgttcggtaacgtacgtaacctaaagtttaacttactttaaacgtttcccgtaaccctcgttaaacggtccggttacccggtaaccggtaacgggtaacccgtaagggttaccgtaaaaccgttaccgttaaaccgggacttacgggtaccgttacggaacgtaccctaaacccttcgg

SEQ ID NO: 161372 - DNA, 795 bp, Homo sapiens
  misc_feature: GYAE6OF02HHQAI.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctcagtactccctggctgtgtctcgtggcgagagggccaccatcaacgtgactaacgtccagaccgagtaaggttaattttttaaccgacggtacctaccctaaacccgtaaattaaacggaacgtacttaacctttaacggtccgttttagggttacccaagactaaacggaaaaaccgacgggtaaccaaacgttccccttaccgttacccttaaaccgtcggtacccttactaacgttttaaccggtcggggttaccgtacccgttacccggggtaaacgttcccccgggggttcccgtacggtaccgtacgtttaccgagttacgggaccgaggtccgggtacgtcggggtactacgtagttacctactaccgtacgtacctaagtccgagacccgtacgtcgtacgtaacgacggtacgtaggtaacgtaggttaccggtaggaccgttagttttaagttaacccgtggtaaccgtacggtaacccttaaaggtttactttaattacccgtttacccgttaccgtaccaaggtttaaccgttcgggaacccgtaacggtaaccgggtaaggtaacgtaaacgtaaccgaacggtaacgtggttacaggtcaacgtccgtattaccgg

SEQ ID NO: 161373 - DNA, 735 bp, Homo sapiens
  misc_feature: GYAE6OF02JKLPY.22.27.C05.1.454.CMB.1.raw
  modified_base (504)..(504): a, c, t, g, unknown or other
  misc_feature (504)..(504): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccgggacagtcgtgatgaccagtctcagacctcctgctgtgtctcgtgggcgagacgggccaccactacaactggactaacgtccacgccaagtagtttactttttaccacgtcctaccaacctaaagtaacgagtaccttacttacgtccgtttcggttaccagaactaaccgaaaccgaaggtacctactccctacctctacgtctacgtcctaatttcgtacggtccgtaccgtacccggtaacggtcccggtacctcgacgtactcgtacgtggccgtacggtcggtcgtcggaactacgttaaccgttccaccttccgtacctaccgtacgttacgacgtaccgtaccgtccggtaacncgggtaccggtagtaccgtaagtcggttacggtacgtacgtttaaacgtttcgttattccgtaagtacgttaactaagttttacttaacttccgtttaaccctcgtacgttaacggaccgttaccggaccgtaacggtaaccggtagggttaaaccgttaaagtaaccccgttaaaggacggtttacggtaccggtacctttacccgggaacctaccgttaactttaccgg

SEQ ID NO: 161374 - DNA, 680 bp, Homo sapiens
  misc_feature: GYAE6OF02G5XY2.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccgatcaactgcaagtccagccagagttatttttacagtactccaaccaataagagctacttagacttggttccagctaagaaaccgaggaacactccctcctcctactgcctactactttaccgtgggtccgtaccgtaccccgggtaacgttccccgggggtccctacggacccgtagttcgaaggttcggaccacgggtcggggtcgttacgggggactaggtacttttccgaacctttcctacaccctatccgacgcgtaaccggtcctaggcgtagggacctagaacggattgggtacgtcgttaagttactttaccgagtacaggtaaccttaagttattacttcgtttccccgttaacgtcgtagtaccgggttccggaccgtaacggggtaacccgtaagggtacggtaaactaaccggtaaaccggtcgttacggtaccggtactacggccctaaccgttcgttacccg

SEQ ID NO: 161375 - DNA, 788 bp, Homo sapiens
  misc_feature: GYAE6OF02FYCTH.22.27.C05.1.454.CMB.1.raw
  modified_base (219)..(219): a, c, t, g, unknown or other
  misc_feature (219)..(219): n is a, c, g, or t
  modified_base (608)..(608): a, c, t, g, unknown or other
  misc_feature (608)..(608): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatcgacccagtctccagacctccctggctgtgtctcgtgggcgagacgggccaccatacgaacngcaacgtccacgccagagttactttttacagtctaccacaataagagtactacttagtcttacggttccagacagaaccgaggaccacgtccctccttacctacgtacgtcttactaactttacgtcgggtaccgtaccggtacccgggaacgttcccggggtacccgtacggtaccgtacgttacggaggttcggacgtacgggtacggggtcgttacggggaaccgtacggttacgtttacctaaccgttacctaccgtaacctaacgttaccgtaacggtaccggtaccggtcccgtagggacccgacgggtaaccgttaaggaaccggttaggttacgggttccggttacgtttaacggttttttaactttaccggttcggttanaaccggttaacttaagtttaaacctttaacgtttaccttacccgtttacccgtaaccgttacgggttaaccgttccccggggaacggttaaccggggaaccgttaaagggttaaccggaactttaaacccggaaacgttcgggtacggtacggttaccgaccgtacgtaccgtttaaccg

SEQ ID NO: 161376 - DNA, 812 bp, Homo sapiens
  misc_feature: GYAE6OF02GCNM9.22.27.C05.1.454.CMB.1.raw
tcagacatacgcgtcacgaccggtgctcgatttagacgcgatcgaagggtttggggggagctacaacaggcaggcaggggcagcaagatggtgttgcagacccaggtcttcatttctcttgttgctctggatctctggtgccgtccggggacatcgtgatcgacccgagtcctccagacctcccgtggctgtgtctcgtgggcgaggacggccaccactacaacgtcgactacgtacccgagaccgtaggtaagtttacttttttacgacgtacctacccaaccaaataacgacgtacttacgttacgtcgtttccggttaccgaagtaccaacgaaaccgtacgggacctacgttaccccttacccttaccttaccgtcgtcctaccgttaacgtttacgtcgggttacccgttacccggtaacccggggtaaccggttcccggggttcccgtaacggtacccgtacggttcgtacggtcggccgacgggtcggggtacggtacggggtatacggttctttaccgaccttccgtacctaccgtaaccgtccgacgaaccgtaccgtccgtacgtcgggaaccgttcgtaagtacgggttctggttacggttaccggtttaacgttacgtttacgtcgtacgacggttaactttaacgttatttacttacctttcctaccggttcgtaccgtccgggtacccgggaaccgggttaacgggaacccggttaaacgggtaccggttaaacccggtaaccgtaaacgggttcgtacggggttacggtacccgtacggtccctaaccgttacccgg

SEQ ID NO: 161377 - DNA, 825 bp, Homo sapiens
  misc_feature: GYAE6OF02IWT71.22.27.C05.1.454.CMB.1.raw
tcagacatacgcgtcacgaccggtgctcgatttagacgcgatcgaagggtttgggggagctacaacaggcaggcaggggcagcaagatggtgttagcagacccaggtcttcatttctctgttgcgtctggatctctggtgccgtccggggacatcgtgatgacccagtctccagactcccgtggctgtcgtctcgtgggcgaggacgggccaccgactacaacgtcgacgtaacgtccgacgaccgaagtacgttaactttttaccgacgtcctaccaaccaataacggacgtacttacgttacgtctttcggttaccacgacgaacgaaaccgacggtacctactcccgtccttacctaccgtcgtccttacttaacgtttaccgtcgggtaccgttaccggtaaccccgggtaaccggttacccggggtcccgtaacggtacccgtacgttacgacggttacggaccgacgggtacgggtacggtacgggtacgtaacgtacgtttacctaccgttactaccgtaaccgtattacccgaaggtaaccgtaccgtaccgtacgaccgggtaacggtacgtaaacggtaaacggttaagtcggttacggaaccgttttaagtttactacgtttagacgtaacggtatttaaacgttaacgtttaccttaaccgtttccccttaaacgtccgggtaaccgtttaccggggtacccgtaaaccgggttaaccggggaaacccgtttaagggaaaaccggtaaccttaaaccggtaaaccgggttactacggggttaacgaccggtaacgtacccgttacgtaaccgg

SEQ ID NO: 161378 - DNA, 907 bp, Homo sapiens
  misc_feature: GYAE6OF02FIW9A.22.27.C05.1.454.CMB.1.raw
  modified_base (198)..(198): a, c, t, g, unknown or other
  misc_feature (198)..(198): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatcgacccagtctccagactccctggctgtgtctcgtgggcgagnggccaccatcaacgtgcaagtccacgccagtacgttatttttacagtcctacccaccaaataaggtacgtactacgttacgtccgttagggtttacccacggacctaaacgaaaacccgtaacgggtaacctaacttcccttccccttaccttaaccgttcgtaccgttaccgtaactttttaaccgtcgggtaccggttacccggttaaaccccggggtaacggttacccccggggggttaccccttaccggtaacccggttaactttacccgtacgggtacggggtaccgtaacgggtccggggttaccggtcggggtaaccgaacgggttaccctttttaccgtacccgttacccgttaccctaacccgtaacgttaccggaaccggttccgtaaccggtacccgttacgggtaacccgtacggggttacctaagggtaaacggtagttacgggttacggttacgtttaaaccggttttacgtttaccggtacggttaccgaacggttaacggttaaactttaaacgtttaaccttaaccgttttacccgttaacccgttaacgttaccgggttaacccggtttacccgggacccggtaaacgggtacccggtaaacgggttaacgggtaaacctaaaccggtaaaccggtaaccgttaacgggtaccgggtaccgtaccggtacctacccgtaacgtttacccgg

SEQ ID NO: 161379 - DNA, 691 bp, Homo sapiens
  misc_feature: GYAE6OF02IS7Z7.22.27.C05.1.454.CMB.1.raw
  modified_base (441)..(441): a, c, t, g, unknown or other
  misc_feature (441)..(441): n is a, c, g, or t
  modified_base (482)..(482): a, c, t, g, unknown or other
  misc_feature (482)..(482): n is a, c, g, or t
  modified_base (679)..(679): a, c, t, g, unknown or other
  misc_feature (679)..(679): n is a, c, g, or t
tcagacatacgcgtcacgaccggtgctcgatttagacgcgatcgaagggtttgggggagctacaacaggcaggcaggggcagcaagatggtgttgcagacccaggtctcattctctgttgctctggatctcgtggtgccgtacgggactagttgtgagtcggacccaggttcctccacgtaccgtccccgtggtctcgtcgttcgtcgtcgggcggacgacgggcccactacgtacaactcgaccacggtcctagaccgaagtacgtttacgtttttaacgacgtcctaccctaacgtaaacgtaagttacgttaaccgttacgtacgtttacggttccgaccgtacgaaacgaaccgacggaactctaccgtccgtgacctactcgtactcttacttcgtacgggtctaccggtaccggtacgtccggtcctagaccgtntacggacgtcggactacggcggtacgtggactgtacgttcnctcgacacgactacgcgacgacgtcgtaccgcgtaccgtgtaggaactacggttggttacggtacgtttaacgttttacgtacgtttgtaaccgtagtcttaaacttacgttacgttaccttcccgtactacgtaccgttaccggacgtacggtaacgtaacggtacggagttaaccacgaacgtcgtaacgcgtcncgtacacttacg

SEQ ID NO: 161380 - DNA, 853 bp, Homo sapiens
  misc_feature: GYAE6OF02HHDAS.22.27.C05.1.454.CMB.1.raw
  modified_base (589)..(589): a, c, t, g, unknown or other
  misc_feature (589)..(589): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtcgccgtccggggacatcgtgatcgacccagtcctaccacgtacctcccgtggtcttggtcgtctcggtgggacgaggacggccacactactaacgtcgcgtacggtccacgaccgtaagttacgtttacttttacgacgtcctaacccgtaacctaaagtaacgacgtaccttaacgttacgtacgttcggtaccgacgtaaccgaacgaaaccgtacgaacctaccgttaccccttacctacttaccgtacgttcctacgtttaacgtttccggtaccgggtccgtaacccggtaacccgggttaaccgggtccccgggtaccgtaccggtaccgttacgttacggacggtaccggtcggacgggttccggtcggtaacgggtactaacgttacgttacctaccgtactacccgtaactacgtacgaccgtacgtacccggtctaccgggtanacggttacggtaacggtacgtaggttaccggtgggttaacttaggttttaacgtaccgtacggttaacgtaccgtaaacttacgttaactttacgttaccccgttaccgttaccgtaaccgttaaccgggttcccggggttaaccgaacccgggtaaaccgggttaacggaaaccggggttaaaccttaaacggtaaacccggttaacgtaccgggttaacggttcccgtaaccgtcccggtaacacccgtttacgttacccgg

SEQ ID NO: 161381 - DNA, 815 bp, Homo sapiens
  misc_feature: GYAE6OF02JE5XO.22.27.C05.1.454.CMB.1.raw
  modified_base (365)..(365): a, c, t, g, unknown or other
  misc_feature (365)..(365): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccgggacatcggtgatcgaccagtcctcacgtacctcctggctgtgtctcgtgggcgaggacggccaccatacgaacgtgacgtacgaccacgaccgagtaacgttttactttttacaccgtacctacccaaaccgtaaagtaacgagtacctaacttaacgtctttaccggttacacgtacgaacgaaaccgtaacggtactaccttcctaccttacgtacnccgtcttacgtacgttttaccgcggggtaccgtcccggtaacccgggtaaccgggtccccggggttaccgtaccggtaccggttaccgtcgttaaccgggtcggtacccgggtaagtccgggggtacgtacggggacttacggttacgttacccgtacgttcccgtactaaccgtacctaccggtaacgtccgcgtacccgtcgtcggaacgttacgtaaacggtacggttaaccggtagggttacggttaccgtttagtttaacttaccggttaacgtaggtaaccgtaacttaaggtttaacctttaccgtttacctttacccgtacttaccggttaccggttaccgggtacccggttaacggtaacccggggtaacggttaaacgggttcggtaaaacgttaaccgaaacgtaggttacggacgttaccggtcgacgtacgttaccg

SEQ ID NO: 161382 - DNA, 725 bp, Homo sapiens
  misc_feature: GYAE6OF02HNUAZ.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgaccagtctccagacctccctggctgtgtctcgtgggcgaggacggccaccatcaactgacaagtccagccagtagttatttttacacgtctaccaccaataagagtacttacttagtcttcggttaccagtacgaacgaaaccgacggactacgtcccttccgtacctaactcgtccttactacgttttacggtcgggtaccggttaccgtacccgggtaacggttcccggggtacctcggtaaccgtagttcgtaggtccggtacgacgggtccggggtctacgggggactaacgtactttccgtaacgtcctaccaccgtactcaagccagtcccgtgacgacggacgttagaagtcgttggtacgtacgtttaagttacttacggactacggtacgtactaacgtttattaactttccttttaccgtaccgtacgttaagggttcccggtaccgggtaccgtaaacggggtaaccccggttaaagggtaacgtaaacccgtttaaccgtaaaccgggttaacgttcgggtacccggttacgtaccgtaccgtaaccttaaccgg

SEQ ID NO: 161383 - DNA, 809 bp, Homo sapiens
  misc_feature: GYAE6OF02HQXW0.22.27.C05.1.454.CMB.1.raw
  modified_base (547)..(547): a, c, t, g, unknown or other
  misc_feature (547)..(547): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttcgctcgtggatctcgtggtcgccgtaccggggacatcgtgacgtcgacccgtagtcctccgacgtacctcccgtcggtctgtcgtcgtcggtgggacgacggacggccctaaccataccgtaacgtcgaccgtaagtacccgagtccgaacgttaagtttacgttttacacgtacctaccaaccgaaagtaacggactaccttaacgttacgttcggttaccggttaccgagaacgtaaaccgaaacgacgaacctacctcccttacctaccgtacgtacgtccttacgtaacgttttaccggtccgggtaccggttaccccggttaaccccgggtaaccggtcccgggttacccgtacgtaaccgttacgttcggacgtcggacgtacgggtcggtggtacgaagtacgtctttacggcctaccnctaactcgtacgactaccggtcaccgagtaccgaggtacgtaaggtagtacggtaggtacgttacgttaacgtttacacggttacgtaacgtacggtacttaacttaacgttactttacccgttacctcggtaacccgtacgggtttacccgggaacccgtaacgggtaaccggaaaccggttaacggttaaccgtaaacgtaacccggtaacggttacggtacggtccggtaaccggtaccgtaccccgtacgttacccgg

SEQ ID NO: 161384 - DNA, 824 bp, Homo sapiens
  misc_feature: GYAE6OF02G81TK.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccacgccagacgttatttttacagtcctaccactaaataacgacgtactacttaaggtcctttacgggttccacgtaccaagtaaaacccgaggtaacccaacgttccccttccctaccgttaccgtacgtcttaccgtacttttaaccgtcgggttaccggtacccgtaaccccggggtaacgttacccgggggttacccctcggtaacccggtacgttaccgaagggtcggtaccgtaagggtcgggttaccggtacggggaccgtaacggtacgtttaccgaccgttacctccgaaccgtaacgttcgaacggttaccgaacggtcccgttacggaccgtacgggtaccgtttacggaaacggttcgttacgggttacggttaccgttaaaacggtttttacgttaacccgtttacggtaccgttaaacgtaccgttaaaagttttacctttaaacgtttaacccgtttttacccctacgttaccgtaacggttacccgggtttaccgggaccgtaaaccggggttaaccgtaaacggttaacggtaaaacgtaccgtaaaagggtacttacggtcggtacctacggttacaccgttaacg

SEQ ID NO: 161385 - DNA, 782 bp, Homo sapiens
  misc_feature: GYAE6OF02HV3HZ.22.27.C05.1.454.CMB.1.raw
tcagacatacgcgtcacgaccggtgctcgatttagacgcgatcgaagggtttgggggctacaacaggcaggcagggcagcaagatggtgttgcagacccaggtcttcatttctctgttgctctggatctctggtcgccgtccggggacatcgtgatgacccagtctccagacctccctggctgtgtctcgtgggcgaggacgggaccaccactacaactgacaacgtccacgccagtagttactttttacacgcctaccaacctaaataaggacgtaccttaaccgttacgtccgttttcgggtaccaggtaccaaacgaaaccgacggaacctacttccccttacctacctactcgtaccttaccttaacgtttaccggtcgggtaccggtacccgtaaccccggggtaccggttccccgggggtcccgtacggtaccgttacgttacggtacggtcggacgtacgggtccgggttcggtacgggacgtaacgttacgtttaccaccttccgtacctaacctacgtaccggacgtaccccgacggtcccgtacgacgtaacgggtacctaaggagtacggtcgggtgtaacgtttaacgtttacgtacgttacgtacgaacgtacttaaattacgtttaactccttacccgttacgtacgacggttacccgggtaccggaacccggtaacgggtaaccggtaaagggttaaccgtaaaaccgtaaccgtaaaccgggttacgttacgggtcgaaccgttccgaaccgttccgtacttacgg

SEQ ID NO: 161386 - DNA, 733 bp, Homo sapiens
  misc_feature: GYAE6OF02JCJNQ.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtcgccgtccggggacatcgtgatcgacccagtctccagacctccctggctgtgtctcgtgggcgaggcgggcccaccagtacaactgacacgtccacgccagtacgtttacttttacacgcctaccaaccaagtaacgacgtactaacttagtcgttcggttaccaagacaacgaaaccgacggactacgttaccctctactacgtcgacctactacttacggtcggtccgtaccggtaacccgggtacggtcccggggtacctacggtaccgtacgtcgtaggtcggaccgtacggtcgggtacggtcgggtactacgttacttccgacttccgtaccaccacgtcgacgtccgaccgtcgtacgcgtacggacgtagacgtggttacggtacgttacgttaacgttttcgtactcgtaacgtaacgtacttaaacgttacttttacgttaccctttaccgtacccggtaccttaacgggaccgggttacccgaaccgggtaacgggtaaacccgttaaggggtaaccgtaaaccgtaaacggtaaccgttaacgttcgggtacgttacccggacgttaacccggactacgttaccgg

SEQ ID NO: 161387 - DNA, 715 bp, Homo sapiens
  misc_feature: GYAE6OF02JMG3K.22.27.C05.1.454.CMB.1.raw
  modified_base (259)..(259): a, c, t, g, unknown or other
  misc_feature (259)..(259): n is a, c, g, or t
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatgacccagtctccagacctccctggctgtgtctcgtgggcgaggacgggccaccatcaactgacaacgtccagccagtagttatttttacagctccaacctaanaagtagctacgttagcttggttcagcaacgaacaggactactcctccgtctactcactactacgttacgtggtccgtaccgtaccgggtacgtccgggtaccctgaccgtagttaccgtaggtcgaccggtaggtacggtcggtacggtacagttacgttaccacttccgactacccgtagtaccgtacgcgtaacgtcccgtagaccggtacggtacctaggtaaacgtcgttacgggtacgggttacttaagggttttatttaccggcgtaacgacgtacttaaacgttattaacgtttaccttcccgttactaacggtaccgtaccggggtttacccgaaccggttaacggtaaccgggtaaaaggttaccggtaaaacttacccggtaaacgttaaccggtttcgggtacggtacccgttaacggtacccgtaacccgtttatttaccccgg

SEQ ID NO: 161388 - DNA, 708 bp, Homo sapiens
  misc_feature: GYAE6OF02IVZ5Y.22.27.C05.1.454.CMB.1.raw
  modified_base (149)..(149): a, c, t, g, unknown or other
  misc_feature (149)..(149): n is a, c, g, or t
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccgggganatcgtgatgacccagtctccagacctccctggctgtgtctcgtgggcgagacgggccaccatacaactgactaagccagccagagttatttttacacgacctaccacctaaataagacgtactaacttacgacttcggttccagacaacgaaaccgaggtactactcccctccgtaccttactctacgtacctacgtttacgtagggtccgtaccgttacccgggaacgttcccggggtaccctcggacccgtatcgaacggtcggacgtcggtacgggtacgtcgggactagtactttcgaccgtttcctactaccgtactacgacgtacccgtcgtaccgtcgaccgtacggtaccgtaggtaaacgtcgtacggtcggtacgttaagttttacttaccggtcgttacgaagttactaacgtttacttacttaccttacccgttacctaccgtaccgtaccgtccgggaaccgtaaccggtaaccggttaaagggtacgtaaaccgtacgtaaaccgtacgttaagggtcccgtaccgtacgtaccgaccttaacgg

SEQ ID NO: 161389 - DNA, 922 bp, Homo sapiens
  misc_feature: GYAE6OF02I7JVS.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctactggtgccgttccggggacatcgtgatgtaacccaggtctccagtactcccgtggctgtgtctcgtgggcggagagggccacgatcaactgaccaagtccacgaccgagtacgtttacttttttaacacgtccttacccgaacctaaacgtaaggtaacgtaccgtttaacgttaagtcctttcggttacccgagtaccgaacgaaaccgaggtacacttccctaccgtactacgtacgaccttactaacgttttaacgcgggttaccgtaccggttaaccccgggtacggttaccccgggggttacctaccgggtaaccctttacgttaccgtaacggtccggtacgtaacggtccggggttacgtacgggtaccgtagttaaccgtttaccgtaccgtttccgtacctaacccgtacgttacgacgaccgtaacggtcccgttaagacggtaacgtccgttaaggaacgtaaggtttcccggtagggtttaccgtttaaacgttttttaaaccggtacgttttacggtaaaccggttacggtaaaccgtttaaaccgtttaaagttttttaacctttacccggttttacccctacgggttaaccggtttaaccgggtttaacccgggttaccccggggtaaacccggaaaccgggggttaaacccggaacggggtttaaaacccggttaaaacccggtttaaccggtaaaaacccgggttttaccgacgggggtttaacccttacccggggtaaaccgttaccggtaccccggttttaaccccgggg

SEQ ID NO: 161390 - DNA, 835 bp, Homo sapiens
  misc_feature: GYAE6OF02GHNQG.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcgtgatgacccagtctccagtacctccctggctgtgtctcgtgggcgaggacgggcccaccgatacaactgactaacgtccagacccagtaacgtttacttttttaacacgtcctacccaacctaaataaggacgtaccttaacgttaacgtcgtttacggttaccacgaccaaggtaaaccgacggtaacctaaccttcccttacccgttacctaccgtcgtcctactagtttaccggtcgggtccgttacccggtacccgggtacggttcccggggtcctacggacccgtagttcgtacggtaggtcgtagggccgggttacgtacgggaactacggtatttaccgaccgttccctaccacctacgtaccgacgtaccgtacgtccgtacggaccggtaggtccgtaaggaacggtacggtttggttacggtaccgtttaagttttaaccgttagttaccgtagtaaccgtaacgttaaacgtttacgttttaacgttacccgttttaccctacccgttaaccgttaaccgggtttacccgggtttaaccgggtaaacccggtaaaccgggggtaaaccggttaaacgggtaaccggtaaaaccggttaacccggtaaaaacccggttacgttaacgggttacccgggtacccttaaccggtaaccttaccccgttaccgg

SEQ ID NO: 161391 - DNA, 714 bp, Homo sapiens
  misc_feature: GYAE6OF02IY3CV.22.27.C05.1.454.CMB.1.raw
  modified_base (165)..(165): a, c, t, g, unknown or other
  misc_feature (165)..(165): n is a, c, g, or t
  modified_base (253)..(253): a, c, t, g, unknown or other
  misc_feature (253)..(253): n is a, c, g, or t
  modified_base (451)..(451): a, c, t, g, unknown or other
  misc_feature (451)..(451): n is a, c, g, or t
tcagacatacgcgtcacgaccggtgctcgatttagacgcgatcgaagggtttgggggagctacaacaggcaggcaggggcagcaagatggtgttgcagaccaggtcttcattctctgttgctcgtggatctctcggtgcctcggggactagtcgtgatcggaccngtctcagactcctggctgtcgtctcgtggcgaggaggcctacagtcaacgtcgcaacgtccgagccgaagacgtttacgtttttaacncggtctaccaacgtaaacgtaacgacgtactacgttaggtctttacggtaccagtacgaacgaaccgtaggacctacgtcctacctctacgtcgactctacttacgcggtctcgtaccggacgtccggtactcgtacgtagttcgaagtcggagcggtacggttgacgggtactagtacgtctacgttcgtaccactntacgacgacgtacgccgttagccggttacggacgtactaaacggtccggttgtacggtaccttaggtttacaacgggttcaaccgtacgttaccgtaaagtttccttaaacgtttaccgttccctagttaaccggttacggttaccgttacccggaacgggttaaaccggtacgggaaacggttacccggtaaaaataccccggttaaaagacccggttttaagggcccgttaaaccgtcgggttaccccgaaaggtttccgg

SEQ ID NO: 161392 - DNA, 824 bp, Homo sapiens
  misc_feature: GYAE6OF02I0V4L.22.27.C05.1.454.CMB.1.raw
tcagacatacgcgtcacgaccggtgctcgatttagacgcgatcgaagggtttgggggagctacaacaggcaggcagggacagcaagatggtgttgcacgacccaggtcttcatttctctgttgctctggatctcgtggtcgccgtaccgggacagtcgtgatcgaccgtacgtctccacgaccgtcccgtaggtcgtgtcggttcgtcgtcgggcggaggacgggcccaccgtactaccaacgtgacctacggtaccacgaccgtaacgtagttaactttttacgacgaccgtaccaaccgaagtaagtagtaccttacgtttacgtacgttcgttaccgaccgtaacaacggaaccgacgtacctaacgttccccttacctacctagttacctccttacgttaaccgtttacgggtcgggtacccgttaaccggttaacccgggaacggttccccggggtacccgtaccgtaacgtactacggttacggtacggcgtacgggtacggttcgacgggtacgtagtaccttacgtactacctaccgtacacgtaccgacgtcgaccttccgacggtacggacgacggtacgtaacggttagtaccgggttacggtacgtttaacttaggtttaaccgtagttaccgagttaaaccgttatttaacgtttacttaaccgtttacccgttaccgtacggttaacccgggttacgtaccggtaaccgggtaaccggtaacggaaaccgggttaaacggtaaacgttaaacccggtaaggtttaacggtacggtaccgggtacctacggtacccgttaaccgtttccgg

SEQ ID NO: 161393 - DNA, 813 bp, Homo sapiens
  misc_feature: GYAE6OF02HKX6G.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacatcgtgatcgacccagtcctccagacctccctggctgtgtctcgtgggcgaggacggccaccatacgaactgacaacgtccacgccagtacgttattttacgacgtcctaccaaccgaataacggtactacgttaaccttagtccgtttcggttaccgaaggacaacggaaaccgacggactacgtacccctcctaccgttaactcgtaccttacttacgtttaccggtacgggtacccgttacccgggtaaaccgggtacggttccccggggtaccctaacggtaccgtacgttacgtacggtacggaccggtacgggtcgggttacggtacgggaacgttacggttaccttaccgtaccgtacctaccaacgtacgtaccgaacgaacctacggtaccggtgtaaccggaacggtccgtaagtaacggttagtacgggttcgtaaccggtttagtttaaccgttacgttacggtaacaccgggtttaaattaaacgtttaacgtttacttaacccgtttcccgttaacgtaccgttaaccggtttacccgggtaaccgggaaccggtaaacgggtaaaccggtaaagggtaaacctaaaccggtaaacccgtaacggtaacgttgggtaccgtaccgtcgaaacccttggtaaccgtttaccg

SEQ ID NO: 161394 - DNA, 835 bp, Homo sapiens
  misc_feature: GYAE6OF02IY2SK.22.27.C05.1.454.CMB.1.raw
tcagacatacgcgtcacgaccggtgctcgatttagacgcgatcgaagggtttgggggctacaacaggcaggcaggggcagcaagatggtgttgcagacccaggtcttcatttctctgttgctctggatctctggtgccgtccggggacattccgtgaatgacccagtcctccagacctccctggctgtgtctcgtcgggcgaggacgggcccaccaactacacgtcgaccgtaccgtcggacaccgtaagttacgtttttaacttacgcaccgtaccaaacgtaaagtagacgtactttacgtacggttcgttaccgtacgaacgacgaaaaccggtaaaccgacggtaacctccttacccttccgtaccgttaccgtacggttaccttaactttcggtttaaccgggccgggttaccggttaaccccggtaacccgggttaccgggtccccggtaaccgtacggtaaacccgttcgttaccggacgggtaccggtaccgggtacgggtttacccggttacgggtaacggtaacgtacgtttaacccgttacgcccgttacctaacccgaaactttcggaaaccctacggaaccgtcccggttgaacccgtgggtacgttaacgaacggtagttaccgggtgtaccggttaacttttaccgttacgtcggttcaacgttacgtaattaacgttttacttccttacgttcccttacggtaaccttaaccggttcgtaacccgaacggttaacggtaacggttaacggtaaagtaacccgtaaacggttaacgttacgtcccggaattcccgaacggttacaccggttttataccgg

SEQ ID NO: 161395 - DNA, 868 bp, Homo sapiens
  misc_feature: GYAE6OF02HPRJG.22.27.C05.1.454.CMB.1.raw
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgccgtccggggacatcggtgatcgacccagtctccgagacctccgtggcgtgtgtcgttcgtgggcgacggacggccgaccatacaaactgaccgaacgtccacgcagtacgttatttttacacgtcctaccaactaagtaagacgtacttaacgttacgtcgtttacggttccgtaagtaccgaaacgaaaaccgaacggtacctaccgttaccccttcccgttaccttaaccgtaccgtacctttaaccgtttaacgttttacccgggtaggggtacccggttacccggtaaccccggggttaaccggttcccccggggttacccctaccgggtaacccgtacgttaccggtacggtacgggtaccgtacgggtacggggttaccggtagggtaaccggtacgttaaccgtttccgttaaccgtacccgttaccaaccctacgtaccgaaccgtaccaccggttccgtacggtaccggacggtaacgtacgggtaaggtaacggtttcgggtaacggttaaccgttaggttttaacgttaacccggtgtttaacccggtaacttaaaccgttaatttacgtttaaccttaaccgttttccctacggtaccggtaccgtttaccggtaccggtaccgggaaaccggtaacggttaaccgggtaactttaaaccggaaccgtaacggtaccgtcgggttaacggtccgttaacgacccgtttaatacccgg

SEQ ID NO: 161396 - DNA, 547 bp, Homo sapiens
  misc_feature: GYAE6OF01CQAX9.25.37.D04.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgcctccaggggaaanagccaccctctcctgcagggccagtcagagtgttatcaggtacttagcctggtaccaanagaaacctggccaggctcccaggcctcctcatctatgatgcatccaaagacgggcccactggcactccccagccaggttcagtggcaggtggggctgggacagagttcactctcaccatcagcagtctggagcctagaagtattttgctagtttattactgtacagtcagcgtagcgtaggttcggccgttccggggttactagggttttcggccgacggggaccaaggcgtagggagacgtacgaaacggtacgtaggtcggcgtcgaccaccagttctgttcc

SEQ ID NO: 161397 - DNA, 546 bp, Homo sapiens
  misc_feature: GYAE6OF01A2PJ2.25.37.D04.1.454.CMB.1.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
tcagactgtacagtcacgaccggtgctcgatttagtagcatactgttgggtttggggaggaactgctcagttaggacccagagggaaccatggaagccccagctcagcttctcttcctcctgctactctggcctcccagatagcaccggagaagttgtgttgacacagtctccagacaccctgtctttgtctccaggggaaangccaccctctcctgcagggccagtcagagtgttancaggtacttagcctggtaccaacagaaacctggccaggctcccaggctcctcatctatgatgcatccaagaggccactggcatcccagccaggttcagtggcaggtggggctgggacagagttcactctcaccatccagcagtctggagcctagaagtatttgctagtttattactgtcagcagcgtagcgtagttcggccgtccggggttacgtacggttttcggccgtaggggtaccgaaggtccgtagggtacgacgtacgaaacggtacgtaggtaggcgtacgacaccgtactcgtcggttcc

SEQ ID NO: 161398 - DNA, 590 bp, Homo sapiens
  misc_feature: GYAE6OF01ECNPP.25.37.D04.1.454.CMB.1.raw
  modified_base (516)..(516): a, c, t, g, unknown or other
  misc_feature (516)..(516): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggttcagcgttagtcacagctacttgatctgggtccgccaggctccgaggggaagggctgggagtgcgtctctagtttatttatagcgaataaactacccacctactacgcagactccgtgaaggcctattccttatcctcagacactaattcccaagaaccaccctctaactcttacaaatcgaaccgccctagacgagcccgaaggaccacgggtccgttagtaacttacgtggtcggcggacgggggtanaattaccgtaggttggtttatttcgaatttacctacctttccctaagtcgggggccttagggttcccctacggg

SEQ ID NO: 161399 - DNA, 538 bp, Homo sapiens
  misc_feature: GYAE6OF01CEVHD.25.37.D04.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (264)..(264): a, c, t, g, unknown or other
  misc_feature (264)..(264): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (393)..(393): a, c, t, g, unknown or other
  misc_feature (393)..(393): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccgaggggaaanacgccaccctctcctgcagggccagtcagagtgttancaggtacttagcctggtaccaanagaaacctggccaggctcccaggctcctcatctatgatgcatccaagacggccacgtggcactcccagcctaggtcagtggcaggtggggctgggacagagttcactcncacntcagcagtcgtggacnccgtagaagtatttgcttagtttattactgtcagcagcgtagcgaggttcggccgttcgggtacttaggtttcggccgaggggtacccaaggtcgtaggagacgtacgaaacggtactggtcggctcgacaccatcgttgttccg

SEQ ID NO: 161400 - DNA, 711 bp, Homo sapiens
  misc_feature: GYAE6OF01DB4E8.25.37.D04.1.454.CMB.1.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctccagatagcaccggagaagttgtgttgacacagtctccagacaccctgtctttgctccgaggggaaancgccacctctcctgcagggccagtcagagtgttatcgaggttacttgcctaggtaccaanacgaaacctggccaggcctcccgaggcctcctcactctagtgatcgacataccgaaaggcgggcccacgtcggaccaactcccccgaagtcccgaaggtttccgaaggttcggaccgaggggtcgggggccttagggggaactaaggtcggtttccactcctaccaacccttagtcgaacgctacgtcgtacgggacgtccgtaggtaaacgttagttttcgtacgttaagttttattaacgtcgttacgagtaccgtaaggtcgtaacgtcgttacggttccgggtacccggttaccggggttaaccgttacgggtttttaccggggacccggtaacgggggtaaccccgtaagggtccggtagggaaacggttaacgtaacggaaaaccggtacgttcgggtaacggtccgttacggaccctaaccgtacgttccgttaggtttccc

SEQ ID NO: 161401 - DNA, 781 bp, Homo sapiens
  misc_feature: GYAE6OF01DOBLW.25.37.D04.1.454.CMB.1.raw
  modified_base (203)..(203): a, c, t, g, unknown or other
  misc_feature (203)..(203): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctccagatagcaccggagaagttgtgttgacacagtctccagacaccctgtctttgtctccgaggggaaancgccaccctctcctgcagggccagtcagagtattagcggacaacttagcctggtaccagcagaaacctggccagggtcccaggctcctcatccgacggtcgcactcccaccgacgggccacgtggaacttccgagccgaggttcaggtcggctaggtcgggtctaggggactaggacctttcgtacctctaccaaccctattaccgaaggtccacggtcccgtcggaccgtaacggttccgttacggttaaccggttaacgtttttacggtaccgtttaacggtttttaacgttttaacgttacggttaccgtaacggttaacgtaaacggtttaaaacgtttaaaaaacggttaccggggttaacccggtttaaccggtttaacgggtttttaccgggtaacccgggtaaaccgggggtaaacccgtaaacggtaccggttacgggtaaccgtaacgttaccgtaaacggtaaaccggtaaacggttacgggtacgggtaccggtcggaacccgttttttaacccgacgttaccgttacgtttaccctttaccgttaccgttcccgtttacccccgg

SEQ ID NO: 161402 - DNA, 695 bp, Homo sapiens
  misc_feature: GYAE6OF01A5OAE.25.37.D04.1.454.CMB.1.raw
  modified_base (203)..(203): a, c, t, g, unknown or other
  misc_feature (203)..(203): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaaangccaccctctcctgcagggccagtcagagtgttatcaggtacttagcctggtaccaacagaaacctggccaggcctcccaggcctcctcactctatgatcgcactccgaaggcgggcctacgtggcactcccagcctaggttcaggtcggcgtagggtcggggcgtgggactaggtacttccacttcctaccaacctataccaggacctacggttccgtagggaccgtcccgttaggtaaacgttagttttcgaccgtttaaggtttttaacttacgttgtaccgtagtccgtacggtaccgttaggtccgttagggttcccgggtcccgggtttacccggggggttaactttacgggggttttccgggacccgggtaacgggggtaacccgtaacgggtcggtaacggggtaacggtaccgttaaacgggaaaaccggttacgttacgggtcgggtactacggaccccaacgttccgtgtttccgttaccg

SEQ ID NO: 161403 - DNA, 648 bp, Homo sapiens
  misc_feature: GYAE6OF01BV4UG.25.37.D04.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
  modified_base (294)..(294): a, c, t, g, unknown or other
  misc_feature (294)..(294): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacacccttgtctttgtctccaggggaaancgccaccctctcctgcagggccagtcagagtgttatcaggtacttagcctggtaccaanagaaacctggccaggcctcccaggcctcctnactctatgatcgactactaccgaaaggacgggccctacgtcgggacctaccgtccccgagtccccgtaagggtttccaagggttcggacgtaggggtcggggctaggggactagggtacttcgacctctaccacctatcgacgctagtcgtggacgaccgtagaagttgtttgacgttagtttacttagtcgtacgtagacgtacgtacgtacgtcgtacggttccggtacccggttaccggggttaacgttacggtttaccggaccggtaacggggtacctaacgggcgtaggaacgtaacgtaacgaaacgtacgtgggtacgtcgtacgtaccgactctcgttcgttaccg

SEQ ID NO: 161404 - DNA, 564 bp, Homo sapiens
  misc_feature: GYAE6OF01EV0IB.25.37.D04.1.454.CMB.1.raw
  modified_base (379)..(379): a, c, t, g, unknown or other
  misc_feature (379)..(379): n is a, c, g, or t
  modified_base (404)..(404): a, c, t, g, unknown or other
  misc_feature (404)..(404): n is a, c, g, or t
  modified_base (496)..(496): a, c, t, g, unknown or other
  misc_feature (496)..(496): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctggggggtccctgagactctcctgtgcagcctctgggttcagcgttagtcacagctacttgatctgggtccgccaggctccgagggaagggctgggagtgcgtctctagttatttatagcgaataactaccacctactacgcagactccgngaacggccgattcctatctccaganacattccagacacctctatcttacaaatgaaccgccctagacgacgccgaaggaccacgggaccgttgtaattactggtcgcgggcgggganagttacgtaggttggttatttcgattacttacctttcccgtagtcggggtcctagggttcccctcggg

SEQ ID NO: 161405 - DNA, 619 bp, Homo sapiens
  misc_feature: GYAE6OF01COGCM.25.37.D04.1.454.CMB.1.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttgttttaaaaggtgtccagtgtgaggtgcagctggcggagtctggaggaggcctgatccagccgtgggggtccctgagactctcctgtgcagcctcgtgggttcagtcgttagtcacagctacttgatcgtgggtccgccaggcctccgagggagggctggagtgcgtctcagtttattagagcgtaataactaccctaacctactacgcaagactccgtagaacgggtcctatttcccttatcctccaagacgactaattcccaaggaaccaccctatacttacctacaaactgaaccgtccctagaacgacgcccgaaggaccaccgggtcgttgtaacttacgtgtcgcgggtcgggagattacgtaggtttggttaactttcggtaactttaccgttacccttttaccctaaccggttgggggtaccctacggggtttcccctacggg

SEQ ID NO: 161406 - DNA, 578 bp, Homo sapiens
  misc_feature: GYAE6OF01DLUE2.25.37.D04.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
  modified_base (234)..(234): a, c, t, g, unknown or other
  misc_feature (234)..(234): n is a, c, g, or t
  modified_base (257)..(257): a, c, t, g, unknown or other
  misc_feature (257)..(257): n is a, c, g, or t
  modified_base (284)..(284): a, c, t, g, unknown or other
  misc_feature (284)..(284): n is a, c, g, or t
  modified_base (382)..(382): a, c, t, g, unknown or other
  misc_feature (382)..(382): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgctcgaggggaangccacctctccngcaggccagtcagagtnttancaggtacttagcctggtaccaanagaacctggccaggctcccaggcctcncatcatgatgcatccgaaggacggccagtggcagtccccagcccgtaaggttcaggttcggcgagggtggggctggggaaccaggtacgttcgactcncgaaccagtcagctagtcgtagggacgtaccgtagtaagtattttgacttagttttaacttacgttgtcagtcagtcgtagcgtagttcggtccgttaccgggttacgttacggttttacggccgacgggaccgtaaggccgtaggacgtactacgaaacgtaacgtgtagcgtacgacacctaactcgtgttacc

SEQ ID NO: 161407 - DNA, 644 bp, Homo sapiens
  misc_feature: GYAE6OF01DF7S7.25.37.D04.1.454.CMB.1.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagcgttagtcacagctacttgatcgtgggtccgccaggctccgaggggaaggggctggagtgcgtctcaagtttattatagcgtaataactaccacctactacgcagactccgtaggaacggccgtattccttatctccagaacgactaaattccaaggaacctaccctctatcttacaaatcgaaccgccctagacgacggaccgtagggaaccacgggtccgtagttaacttacgtgtggccggacgggggtatacgttaacgttaaggtttaggttttaacttttaccggtaacttttaacccgttaacccgtttttacccccgtaacggttccggggggtacccgttacgggggtttcccccgttacgggg

SEQ ID NO: 161408 - DNA, 687 bp, Homo sapiens
  misc_feature: GYAE6OF01C0WTV.25.37.D04.1.454.CMB.1.raw
  modified_base (178)..(178): a, c, t, g, unknown or other
  misc_feature (178)..(178): n is a, c, g, or t
  modified_base (205)..(205): a, c, t, g, unknown or other
  misc_feature (205)..(205): n is a, c, g, or t
  modified_base (304)..(304): a, c, t, g, unknown or other
  misc_feature (304)..(304): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacnccctgtctttgctccgaagggggaaancgcccaccctctcctgccgagggccagtcaagtagtgttatcgaggttacttagcctaggtaaccaacagaaacctggccaggcctcccgaggcctccnatctatgatgcatccgaaggcggccagtcggcactcccagccgtaggtcagtggcgagggtcggggctagggacagtagttccactctacacatcgagactagtcgtaggtacgtaccgtagtaagttagtttacgtacgtttaagttttacttacgttacgtactacggtacgtaacggtcgttaggtaccgttaacgggtttcccgggtacccggtttacccgggggtttaccgttaacggggtttttccgggaaccgggtaaccgggggtaaaccgtaacgggtaccggtacgggtaaacggtaaaccgtaaccggtaaaacggttaacggtagggtaccgacgttaccggaacctaccgttacgttcgttacgtttacc

SEQ ID NO: 161409 - DNA, 752 bp, Homo sapiens
  misc_feature: GYAE6OF01DM080.25.37.D04.1.454.CMB.1.raw
  modified_base (375)..(375): a, c, t, g, unknown or other
  misc_feature (375)..(375): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggtcgttttggctgagcttgggtttttccttgttgcttagttttaaaaggtgtccagtgtgaggtgcagcgtggcggagtcgtggaggaggcctgatccagccgtcggggggtcctgacgctctcctgtcgcacgcctcgtgggttcagtcgttagtcacgagtctacttgactccgtcgggtcccgccgaggcctaccggaaggggagggcgtgggagtcggcgttcttacgtatttattanagacgtaataactacccaacctactacgacacgtaccgtccgtaggaacgggtacccttacgtttccttaacgtcctaccgaagtaacgtaacctaaacgttcccgaaacggtaaccctacccgttacttacttacctaaacgtaaactaccggaacccgtcccgtaaggaccgaacggacccggaacggaacccgtaccgggtaccggtttagttaacgtttaccgtgggtaccgggaccgggtacgggggtaaagttaacgttacgggttaacggttttaggttttaaacgttttccggttaaatttttacccggttaccctttacccggttaccgggttcggggtacccgttaccggggtttccccgtaccggg

SEQ ID NO: 161410 - DNA, 792 bp, Homo sapiens
  misc_feature: GYAE6OF01BX2XX.25.37.D04.1.454.CMB.1.raw
  modified_base (388)..(388): a, c, t, g, unknown or other
  misc_feature (388)..(388): n is a, c, g, or t
  modified_base (683)..(683): a, c, t, g, unknown or other
  misc_feature (683)..(683): n is a, c, g, or t
tcagactgtacagtcacgaccggtgctcgatttagtagcatactggttgggtttggggggagaggagcccagcactgggattccgaggtgtttccattcggtgatcagcactgaacacagaggactcaccatggtcgttttggctgagtcgttgggttttccttgttagtcgttagttttaaaaggtgtccagtgtgaggtgcagcgtggcggtagtcgtgggaggacgggcctggactccgacggtccggtcggggggtccctgacgtctcctccgtgtcgcgcgtccgtcgttgggttccaggtcgttaacgtcaactaggtctacgttgacttccggtcgggtcccacgacggtccgtaaccggaaggggaaggcggtgtagggngtcggtccgttactcgttaagttttaattagacggtaacgttaaacttaaacctaaccctaccgtaacgttaccgacgaacggtacccgtaccgggttaagggaaccggtacccgttactttacccttaacgtccctaacgagtaaaccgtaacgttaaacccgttaacccggaaacgtaacccctacccctttattaacccttacttaaaccgtaaactaaccgtaaccccgacgttagggaacccgtcggacccgggaacggaccgtaccgggtcgttaagttaccttacggngggttccgggaccggtagggtaactaagttcgttaagggttgtttaacttaccgtaacttttaccgtacccttttcgacgggttcgggtcccggttaccgggtttcccg

SEQ ID NO: 161411 - DNA, 768 bp, Homo sapiens
  misc_feature: GYAE6OF01D3C3E.25.37.D04.1.454.CMB.1.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggtttttccttgttgctagttttaaaaggtgtcagtgtgaggtgcagctggcggagtcgtggaggaggcctgactccgagccggtcggggggtccctggacgtacctctcctgtcgcacgccgttcgtgggttcaggtcgttagtcacgtagtccttacgttgacgttccgtcggggtcccgccgaacgggtcccgtaccggaagggggaacggggtcgtaggggacgttcggccggttctacgttaaggttttatttaagtacgtacgtaaacttaaacctaacccaacccttaacgtaccgacctaacgtaccgtccgggtaggaaacgggtcccgttaactttcccttactacccgtaccaaggaacctaactaaaccgttaccgaaacgtaaccctacccttacttaacttccttaaacaaagtccgaaacccgtcccgtaagacgacggtccgaaggaccgacgggtcgttagtacttacgtcgggcggaccgggtacggggataacgttacggttagggtttagtttaacttttaccgaacgttttacccgttacccgtttaccccggttagggtacccggggtccttacccgggggtttcccttaccggg

SEQ ID NO: 161412 - DNA, 696 bp, Homo sapiens
  misc_feature: GYAE6OF01E43QS.25.37.D04.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (303)..(303): a, c, t, g, unknown or other
  misc_feature (303)..(303): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagaccaccctgtctttgctccgaaggggaaancgccaccctntcctgcagggccagtcagagtgttatcgaggttactagccgtaggtaaccaacgagaaacctggacccaggcctcccgaggcctcctnatctatgatcgacagtaccgaaagggtcgggccctaacgtggacccacgtaccccgaggacccgtagggttccagggtcggccgtagggtcggggcgtagggactaggtacgttcacgtctccactatcacgcgtagtcgtcggacgtccgtaggtaacgttgtttacggtacgttacgttttaacgttacgttcgtaccgtacgtcgtaggtaccggttaagtccggttacgggtttccgggtacccgggtttaccggggttacgttacggggttttaccggacccgggtaacggggtaacccgtaagggtaccggtagggtaacgtacgtaaccgaaacggtacgttacgggtcgtaccgtcgaccgtaaccgtcgtttccgtcgtttacc

SEQ ID NO: 161413 - DNA, 640 bp, Homo sapiens
  misc_feature: GYAE6OF01CKZ3D.25.37.D04.1.454.CMB.1.raw
  modified_base (177)..(177): a, c, t, g, unknown or other
  misc_feature (177)..(177): n is a, c, g, or t
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (369)..(369): a, c, t, g, unknown or other
  misc_feature (369)..(369): n is a, c, g, or t
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
  modified_base (421)..(421): a, c, t, g, unknown or other
  misc_feature (421)..(421): n is a, c, g, or t
  modified_base (432)..(432): a, c, t, g, unknown or other
  misc_feature (432)..(432): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctccagatagcaccggagaagttgtgttgacacagtcctcagacnccctgtctttgtctccgaaggggaaancgccaccctctccngcaggccagtcagtgtgttatcaggttatacgcctaggtaaccaagacggaaacctggccaggcctccgagcctcctcatctaatgatcgcactaccgaagcgggacctacgtgactaacgccccagtaccgtaggttcaggttcggacgngggttcggggactggggaacaggtagttcncttacnccacgactcgacgacnggtcgtacggngtccgttagtaacgtttagttacgtcgttaagttttaacgtttagttacgtacctagtcccgtaagttcgtaacgttcgtaacgggttcggtaaccccggggttcggggtttacgttagggtttaccgggaccggtacggggtaaccaggtccgtaggaacgcgtaacgaacggtctagggtcgtgacgactacacttcgagtttccg

SEQ ID NO: 161414 - DNA, 629 bp, Homo sapiens
  misc_feature: GYAE6OF01DYHJ4.25.37.D04.1.454.CMB.1.raw
  modified_base (202)..(202): a, c, t, g, unknown or other
  misc_feature (202)..(202): n is a, c, g, or t
  modified_base (294)..(294): a, c, t, g, unknown or other
  misc_feature (294)..(294): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctccagatagcaccggagaagttgtgttgacacagtctccagaccaccctgtctttgtctcgaggggaangccaccctctcctgcagggccagtcagagtgttatcgaggtacttagcctaggtaccaacagaaacctggccaaggcctacccaggcctccncatctatgatgcagtccaaggacgggccacgtggcactcccagccaggttcaggtgacgaggtggggctagggaccaggtacgttcacgttctccgacctagttaccagacgtacgtcgttagggacgtccgtagtaagttacgttttagtacttaagttttattaccgttgtacgtaggccgtaggtcgtagtccgtaggttccgggccgttaccggggtaacgttcggtttacgggaccgtacggggaacctaacggtcggttaggaacgtagtaacccgtaaacggtacggttcggtacggtacgtcgaactacctagttccgtgttacccg

SEQ ID NO: 161415 - DNA, 731 bp, Homo sapiens
  misc_feature: GYAE6OF01EV993.25.37.D04.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgctccaaggggaancgccaccctctcctgcagggccagtcagagtgttancgagtacttagccgtaggtaccaacagaaacctggccaggcctcccgaggctcctcatctatgatgctataccgaaggacgggccacgtcggcaacgtcccagccctaggttcaggtgccgagggtcggggctaggggactacggtacgtttacaccttacgttaccaccgtatccgaaaggtcaacggttccgtagggacgtacccgttaggtaaacgttattttcggacctttaagtttttaactttacgtttcgtacgtacgactaacggcgttaacgtccggttaagggttcccgggtacccgggtttacccggggttaacgtttacgggttttaccgggacccgggtaacggggggtaaacccctaaggggtaccggttaaccgggggaagtaaaccgttaaaccgggaaaaaccggtaccggttacgggtaggggttaccggtccggtaacccgtaaacccgtcgtttcccgttacggttttacccc

SEQ ID NO: 161416 - DNA, 648 bp, Homo sapiens
  misc_feature: GYAE6OF01DILCS.25.37.D04.1.454.CMB.1.raw
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
  modified_base (265)..(265): a, c, t, g, unknown or other
  misc_feature (265)..(265): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagaccaccctgtctttgtctcgaaggggaaancgccaccctctcctgcagggccagtcagtatgttancaggtacttgcctggtaaccaaanacgaacctggccaaggtcctacccgaggcctacctcatcctatgatgactactaccgaaggacgggccacgtcggcctactccccgacgcccgtaggttcaaggtcggacgagggtcggggcgtaggggactaggacgttcacgtcacaccgataccgagacgtagtcgtagggacgtaccgttagtaagtttacttttaaggctttaagttttacttaaccgtgttacgagtacgacgtcgtagcgtacggttccggtccgggttacgggttaccttaggggtttcggaccggtaacggggacctaaggtacgtaggtaggtaacgtaaaccgaaacggtactacgggtcgtacctcgaacctcctaacgttcgtgttaccc

SEQ ID NO: 161417 - DNA, 752 bp, Homo sapiens
  misc_feature: GYAE6OF01B5GXU.25.37.D04.1.454.CMB.1.raw
  modified_base (346)..(346): a, c, t, g, unknown or other
  misc_feature (346)..(346): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttagttttaaaaggtgtccagtgtgaggtgcagctggcggagtctggaggaggcctgactccgagccgtgggggtccctggacgacctctcctgtcgcacgcctcgtgggttcagtcgttagtcacagtctacttgactcgtcgggtccgccgtacggtccggtaccgggggaaggttcnggcgtaggtggtactttcacgttcctaagttgtcggttacgttaagcgttagtaaactttaaagttttgacgtcaaggtacgtcgggtaggaaccggtcccgttacaaccgtacttccgtaccgaagtaaccgaaccgtaaccggtacccgtaacgtttacctttcgttcctttaacgacgtaaactaaacgtcgaaacacgtcctaacgaacggtaccggaaccggacggtaaccggtaccgttacgttttacgttttacgtttccgtagggtcggtaacgggtaagggtaacggggtacgggttaacgggggaaacgttaaaaccgggtttcggaacccgtttaacggggttaaacggggtaggttaacggttacggtttacggtttcggtttttaaaccgggg

SEQ ID NO: 161418 - DNA, 779 bp, Homo sapiens
  misc_feature: GYAE6OF01CQA1G.25.37.D04.1.454.CMB.1.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcgttgggttttccttgtttgtcgttagttttaaaaggttgttaccgtagtgtgaggtgcgagcgtggcggaggtcgtgggagggaggccgtggactccgacggccggtcggggggtcccctggtacgaccgtccgtccgtgtcgcgacgccttcgttgggttacaggtcgttacgtctactacggtctaacgttgacgtcgtcggggtcccgccgaggcgtaccggaggggacgggcgtgggacgtgccgttctcgtagtttattagtacgtcgtaagttaacctacccgaaccttaacgacgtaccaacggtacctccggtaggaacgggtcccttaacgttcccttactaccgttacccgtaacgtaacggtaacctaaacgttaccccgaaacgggtaaccctaacccttaccttaacttaccttaacaaacgttacgaaacccgtcccgtacggaacgaacggaccggaacggaacccgtaccgggtccgttacgtaacttacgtggttacggacggtcggggaagtacgttaacgtacggttaggtttaacgtttaccgtaacgttttacccttaccgttttcccgttacggttaccggggacccttccggggtttccccgtaccggg

SEQ ID NO: 161419 - DNA, 594 bp, Homo sapiens
  misc_feature: GYAE6OF01B3XLW.25.37.D04.1.454.CMB.1.raw
  modified_base (454)..(454): a, c, t, g, unknown or other
  misc_feature (454)..(454): n is a, c, g, or t
tcagactgtacagtcacgaccggtgctcgatttagtagcatactgttgggtttggggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagcgttagcacagctacttgatcgtgggtccgccaggctccgaggggaaggggctgggagtgcgtctcagtttatttatagcgaataactacccacctactacgcagactccgtgaacgggccgtattccttatctaccagacgacaacttccaaggaaccacctctatcttacaaatcgaacnccctgacgacgccgagacaccggtacgtgtacttacgtgtcggcggacggggatacgttacgtaggttaggtttacgtttcgtactttaccttaaccttttcccgtacggttcggggtcctacggggtttcccttacggg

SEQ ID NO: 161420 - DNA, 634 bp, Homo sapiens
  misc_feature: GYAE6OF01BMDV4.25.37.D04.1.454.CMB.1.raw
  modified_base (495)..(495): a, c, t, g, unknown or other
  misc_feature (495)..(495): n is a, c, g, or t
  modified_base (508)..(508): a, c, t, g, unknown or other
  misc_feature (508)..(508): n is a, c, g, or t
  modified_base (544)..(544): a, c, t, g, unknown or other
  misc_feature (544)..(544): n is a, c, g, or t
  modified_base (560)..(560): a, c, t, g, unknown or other
  misc_feature (560)..(560): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtgggaggaggcctgatccagccgtgggggtcctgagactctcctgtgcagcctcgtgggttcagtcgttagtcacacgtcttacttgactcgtcggggtcccgccgaggccgtaccggaagggggtaacggggcgtgggagtcgccgttctacgtagtttattagtagacgtaataactacccgtacctaacgtacgcaacgtaccgtccggtaggaacggtccgtaacgtttccttatccctacgaaggactactaacttccgaacgaacctccctatacttctanaaacgtcgaaccnctagagaccgacgagaccgacggtcttagtacttcnggtcgcgggagggtanattaggtgttaggtttaactcgtaaatttcccgttacttcccggacggttacggggccttcgggttcccctagg

SEQ ID NO: 161421 - DNA, 699 bp, Homo sapiens
  misc_feature: GYAE6OF01ETB1R.25.37.D04.1.454.CMB.1.raw
tcagactgtacagtcacgaccggtgctcgatttagtagcatactgttgggtttggggggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctgggaggaggcctgatccaggccgtggggggtcccctgacgactctcctgtgcagcctcgtgggttcaggtcgttagtcacacgctacttgactcggtcgggccgccgaggcctaccgaggggaacgggctgggagtgccgtctctagtttattagagacgtaataactaccctaacctactacgacacgtactcccggtagaacgggctactttccttatctaccaagacgtaacaaagtttccccaacggtaaacctacccgttactaacttaccttaacaaacgttacgaacccgtccccgttaaggaccggtaacgacccgggaacggtaacccgacccggggtaccgttagttaaccgttacgtcggtcgggtacgggacggggtagaacgttaacggttacggttaggttttacttacggttactttaacccgttacgtttaccccgtacggttaccgggccggttaccgggttcccgttaccggg

SEQ ID NO: 161422 - DNA, 749 bp, Homo sapiens
  misc_feature: GYAE6OF01EUAPT.25.37.D04.1.454.CMB.1.raw
tcagactgtacagtcacgaccggtgctcgatttagtagcatactgttgggtttggggggagaggagcccagcactgggattccgaggtgtttccattcggtgatcagcaccgaacacagagactcaccatggtcgttttggctgagtcgttggttttccttgttgtcttattttagaggtgtcagtgtgaggtgctaggttggaggagtcggtggggagtcgttggtccgacgggtcccggggggttccctggaacgtaccttcctccgtgtcgcacgtccgttcgtaggtatttcgttagttttacgacgtaagttagttttaggacttggacgtcggtcgggtcccgccggacgggaccccggagggggtacgggtcgttagggtcggtacggtaacgaccaagtactaacgaacggaagtagtagggagtaacgaagtaaagtactagtcgacgtactcgtaggtacggtacgggcctacgttaccaacgtaccgtacctaccggaacggtaaccctaaaccgtaaccgaaactaacttacgtaaacgttaactacgttaccgtagtaactaaagtacgtaagttcggtaccgtaggacgaacgtaccggaaggtacccgtacggttcttcggtttacttacgtttacgtggtacggacggtaagtaccgtacccggacccgttaactccgtaacgtaacccgtaccttagttcttacgttagtacgttcgtggggtaacccgggg

SEQ ID NO: 161423 - DNA, 621 bp, Homo sapiens
  misc_feature: GYAE6OF01DL2RL.25.37.D04.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctccagatagcaccggagaagttgtgttgacacagtctccagacaccctgtctttgctccgaagggggaancgccaccctctcctgcagggccagtcagagtgttancaggtacttagcctggtaccaanagaacctggccaggcctccaggctccnatctatgatgcatccgaaggcggcccagtggacactcccaagccgaggttcaggtcggcaggtggggctggggaactggtacgtttcacgttctaccacatacgagtcagtcgtaggacgtccgtagtaagtatttcgacttagtttacttacgtgtcgagctaggtccgtagtaccgtaggttccggtcccggttaccggggtacgttacggtttcgggaccggtaacgggtaaccgtaacgtccggtagggaacgtaacgtaaccgaaaacggttacgtcgggtacgtaccggtcggtaaccctaccgtacgttccgttggtttaacccg

SEQ ID NO: 161424 - DNA, 660 bp, Homo sapiens
  misc_feature: GYAE6OF01E5QSU.25.37.D04.1.454.CMB.1.raw
  modified_base (269)..(269): a, c, t, g, unknown or other
  misc_feature (269)..(269): n is a, c, g, or t
  modified_base (555)..(555): a, c, t, g, unknown or other
  misc_feature (555)..(555): n is a, c, g, or t
  modified_base (574)..(574): a, c, t, g, unknown or other
  misc_feature (574)..(574): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgtttaaaaggtgtccagtgtgaggtgcagctgggcggagtcgtgggaggaggcctgatccaggccgtggggggtccctgacgacttcctcctgtgcagtcctntgggttcagtcgttagtccacgagtcttacgttgacgtcgtcggggtcccgccgaggccgtaccggagggggaacggggctagggagttcggcgttcgtcgtaagtttatttaagtggacgtaataactacccacctaactacgacaacgacgtaccgtaggaacggtcctacttccttatccaccgagacgaactaacttccgaacgtaaccacccttatacttcttaacaactcgaaccgcccaggacgacgccgaaggaccgacgggtcgtattacgttacgnggttacggcggcggggtanacgttacggttgtaggtttactttcggattttaccttacccgtttcccgtacggttccgggaccgttccggggttcccttaccggg

SEQ ID NO: 161425 - DNA, 808 bp, Homo sapiens
  misc_feature: GYAE6OF01CEIDX.25.37.D04.1.454.CMB.1.raw
  modified_base (572)..(572): a, c, t, g, unknown or other
  misc_feature (572)..(572): n is a, c, g, or t
  modified_base (667)..(667): a, c, t, g, unknown or other
  misc_feature (667)..(667): n is a, c, g, or t
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcttgggttttccttgttgtcttagttttaaaaggtgtccagtgtgaggtgcagcgtggcggagtcgtggaggaggcctgactccgacgtccggtcggggggtccctggacgaccgttcctcctggtcgcgtacgtccttcgtggttccaggtcgttagtcacgacgtcttacgttgacttcggtcgggtccgccgaggtccgtccggaaggggacgggcgtggacgtggtcgttctacgttagtttaagtttaagtacggtacgtaaattaaaccgtaaccctaaccgttaaccgtaaccgtaccgaaccgtaacccgttaccgggtaacggaaccgggtacccgttaaacgtttccctttaacgtaccgtaccgtaaggtaaccgtaacgtaaaccgttacccgaaacggtaccctaacccgttnttaaccttacgttaaacaacgtaccgtaacctcccgtaaggaaccgacggacccgacggtaacccgacgggtaccgttacgttaacgtttaccgngggtacggtccggggtaacgggtaagtacgtttaacggttacgggtttaggtttaccgtttcgtaaaccgtttaccgtttacccgttttacccgggtacggttaccgggggtacctttcccggggttcccctttaaccggg

SEQ ID NO: 161426 - DNA, 742 bp, Homo sapiens
  misc_feature: GYAE6OF01ENRRS.25.37.D04.1.454.CMB.1.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgtcttagttttaaaaggtgtccagttgtgaggtgcagctggcggagtctgggaggaggcctgatccagccggtgggggtcccctgacgtacctctcctgtgcagcctgtggtccaggtcgttagtcacagcttacttgacgtccgttcggggtcccgccgtacggtccgtaccgggaagggggtaacggggcgtgggacggtcggtcgttctacgttaagtttattaacgacggtaacgtaattaaaccgtaaccctaaccttaactaccgtaccaacgtacccgtcggtaaggaaccgggtaccttaacgtttaccctttacgtcccgtaacaaggaaccgtaacctacgttaaccgtaacgaaccccttaccgtaccttaactcctttaaacgaacgttaccgaaccgtcccgtaagacggacgtacccggaacgaccgtaccggtcgttagttaactccggtagtcggccgggtaagggattacgtacgtttagttagtttaacttcgtaaacgtttaccctttaccgttccgttaacgggtccggggttaccccttacgggttcccgttaccgg

SEQ ID NO: 161427 - DNA, 715 bp, Homo sapiens
  misc_feature: GYAE6OF01C4CHH.25.37.D04.1.454.CMB.1.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtagcacgccttcgtggggttcaggcgttagtcacagctacttgatcgtcgggtcccgccaggtcctccggaaggggaaggggcttgggagtggtccgttcgtcgtaagtttactttagtacggtacgtaactaaactaccctaccttaacgtacgccaacgtaccgtccggtaggaacggggtcccgttactttaccctttactcccgttaccgaacggtaacgtaacctaaactttacccgaacggaaacccttacccccttattaccttaccttaacaaaagtccgtaaccgtccccgtaggaacgacgggtacccgaagggacccgtacgggtccgttaggttaacttacgtggtacggcgggacggggatagtacgtaggttaggtttactttccggtaatttacccgttaccgttttacccctagggtcccggggtacctcggggttcccttacggg

SEQ ID NO: 161428 - DNA, 615 bp, Homo sapiens
  misc_feature: GYAE6OF01D9VF9.25.37.D04.1.454.CMB.1.raw
  modified_base (351)..(351): a, c, t, g, unknown or other
  misc_feature (351)..(351): n is a, c, g, or t
  modified_base (448)..(448): a, c, t, g, unknown or other
  misc_feature (448)..(448): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgctagttttaaaaggtgtccagtgtgaggtgcagcgtggcggagtcgtgggaggaggcctgatccagccgtgggggtccctgagactctcctgtgcagcctctgggttcagcgttagtcacagctacttgatctgggtccgccaggctccgaggggaaggggctgggagtgcgtctcagtttattanagcgataactaccacctactacgcagactccgtgaacgggccattccttatctaccagagacaattcccagaacacctctatctacaaatcgaaccnccctagagagccgaggaccacgggtccttagtacttacgtggtcggacggcgggggatagttaacgtagggtttaggttttaacgttttcgaaacttttaccgttaaccctttttacccccgtaacggttcgggggtaccccttaggggtttcccccgttaccgggg

SEQ ID NO: 161429 - DNA, 701 bp, Homo sapiens
  misc_feature: GYAE6OF01EPUWD.25.37.D04.1.454.CMB.1.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctagttttaaaaggtgtccagtgtgaggtgcagctggcggagtctgggaggaggcctgatccagccgtgggggtccctgacgactctcctgtgcagcctcgtggtcagtccgttagtccacagcttacttgactcgtcgggtccgccgaggccgtccggaggggaagggctgggacgtggcgttcgtactagtttatttagtacgacgtaataaactacccgaaccttactaccgcacgactccggtaggaaacggtcctaactttccttatcctccgaagaacgtaacaacttacccgaaacggtaaacctaccccgttacttaacgtctttaaaccgaaaagttccgaaacccgcccttaggacgaacggacccggaacggtaccgaccggtccggtttagttaacctttcgtagggtccggcgggtaacgggtagttaacgttacgttaaggtttcggtttaacttccgttaactttaaccgttcccttttaccccgtaggttaccggggtcccttacggggtttccctacggg

SEQ ID NO: 161430 - DNA, 739 bp, Homo sapiens
  misc_feature: GYAE6OF01ED9UA.25.37.D04.1.454.CMB.1.raw
tcagactgtacagtcacgaccggtgctcgatttagtagcatactgttgggttggggggagaaggagcccagcactgggattccgaggtgtttccattcggtgatcagcactgaacacagaggactcaccatggcgttttggctgtagctgggttttccttgttgctgtttaaaaggtgtccagtgtgaggtgcagctggcggagtctggaggaggcccgatccagccgttggggggtccctgagacctctccgtgtcgcacggccttcgtgggttacaggtccgtttaggtcacagtctaacttgactcgtgggtcccgaccaggcgtaccgaaggggaaggggtcctaggagtcgcgtactctaaggtttatttagacgtacgtaataacctaaccaccgtaacgtacgcaacgtactccggtaggaaacggtccgtaatttccttaatcgtaccaaggtacgtaactaacgttcccgaacggtaaaccaccccgttataacttccgttaaacaaaagttcgaaaccgcccttagaacgacgacccgaaggactaccgggtccgttagtaacttaaccgtggtaccggcggtacgggggtaacttacgtaacgttaaggtttcgggttttaatttaccgggtaacccttttaaaacccggttacccgttttacccccgtaacgggtacgggggtaccccgttaaacgggggttttccccctaagggggttaacccccc

SEQ ID NO: 161431 - DNA, 909 bp, Homo sapiens
  misc_feature: GYAE6OF01DH02N.25.37.D04.1.454.CMB.1.raw
tcagactgtacagtcacgaccggtgctcgatttagtagcatactgttgggtttgggggggagaggagcccagcactgggattccgaggtgtttccattcggtgatcagcactgaacacagaggactccacagtggtcgtttggctgagtcgtttcgggtttttccttgttgtcgtttaaggttttaaaagggtcgtacctaagttggtaggagggtcgacgtaacggttggggtagggtacggtcggggtgggggggacggtcggtttaggaaccgacggcccggaccggggtcccccggttccctacggaacctaccttccttccgtcgaccaacgaccgtcccgttacccggacttccgtttaccggttttgggcggacgctagtcgtacttagtccggtaccgggttccgggtccccgaccggacggtcccgtaaccggggaagggggtaacgggtcggtaggggtacgggttgggttccgggttttggggttaactaaaggttaaacggaaacggtaccggtaaacggtccgttagggttgggggtaacgggaactaaaccgaacgtaaacgtacccggccggtacgttaacgttaaacgggaaaacggcctaaagtacgttaccgaccgtccctacgaacggaagtagtactaacgtaacctaaaccgaaagtccgtactacccgtaccttagcctacgaactaacgtagtacgacgacgaccgtacggaagggaaacgtaacgggaccggtaaacggtacccttaacgggaccgggttaccgtttaagttttaacgtttttaccgtttacttttttaacgttttaaactttacccgttacggttaagggtaaacgggtttaggttttaaacgggtttttaaggttttaaactttttaaaaccc

SEQ ID NO: 161432 - DNA, 702 bp, Homo sapiens
  misc_feature: GYAE6OF01D20OW.25.37.D04.1.454.CMB.1.raw
  modified_base (290)..(290): a, c, t, g, unknown or other
  misc_feature (290)..(290): n is a, c, g, or t
  modified_base (591)..(591): a, c, t, g, unknown or other
  misc_feature (591)..(591): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgtttttggctgagcttgggtttttccttgttgcttgttttaaaaggtgtccagtgtgaggtgcagctgggcggagtcgtggaggaggcctgactccagccgtgggggtccctgagacctctctgtgcagcctcgtgggttcaggtcgttagcacngtctacttgacttcgtcgggtccgccgaggtccgtacggagggggaagggtctagggagtgtcgtcgtactaagtttatttagagacgtaacttaacgtacccaaccgtactaccgacaacgtaccgtccgtaggaacgggcccttagtttaccctttacgccgttaccaagtacgaactaaccttaccgaacggaaccctacccgttacttaacgttccttaaccgaaattaccgaacccgtcccgtaggaaccgacggaccggtaacggacctacggggccgtttagttacgttaccgnggtccggcggggagggtactaagttaccggtttaggttgtttaacgtttctactttaaccgtttacccttcccgacggttacggggacccttaccggggttccctacgggg

SEQ ID NO: 161433 - DNA, 732 bp, Homo sapiens
  misc_feature: GYAE6OF01CBX8U.25.37.D04.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (309)..(309): a, c, t, g, unknown or other
  misc_feature (309)..(309): n is a, c, g, or t
  modified_base (472)..(472): a, c, t, g, unknown or other
  misc_feature (472)..(472): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagaccaccctgtctttgtctccgaggggaaancgccaccctntcctgccagggccagtcagtagtgttancgaaggttacttagccgtaggtaaccaacacgaaacctgggaccaggcctcccgaggcctccgtanacttctatggatcgacctataccgaaacggacgggtcccacgttcgggacctaacgtcccccgaggccctaagggttccaaggtcggtccgaagggtcggggaccttagggggacctaaggtacgtttccgaactcgtaccaccgtatcgacgtcgtagtcgngtacgtccgtagtaagttagtttagcttaagtttacgttagtcgtacgtagccgttaggaccgttaggtaccgtacgggtttccgggacccgggttaccggggtttacgttacgggtttttaccggggaccggtaaacgggggtaacccgttaacgtccggttaaggggtaaccgtaacgttaacccgggtaaaacgtaaccgggtttcggtacggtccggtaactacccgaaaccgttccgtttcgtaccgttttcccg

SEQ ID NO: 161434 - DNA, 754 bp, Homo sapiens
  misc_feature: GYAE6OF01BZL1W.25.37.D04.1.454.CMB.1.raw
  modified_base (205)..(205): a, c, t, g, unknown or other
  misc_feature (205)..(205): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctagtctttgtctccgaggggaaanagccaccctctcctgcagggccaggtccagagtgttatcaggttacttagcctaggtaaccaacagaaaccgtggaccacggcctacccgaggccttcctctactccttatgaatgcctaactccgaaaggcgggtacccaacgtcggcctaactcccccgaaggtcccaagggtttccaagggttcggcgtacgggtgggggccttaggggactaaggtacgttccgaccttaccgtaacctaacccgaattccggaacgtccgtacggttacgtgggaaccggtacccgttaagggaaacgtttagtttttacgggacctttaagtttttaacgttacgttacggttaccgtaacggtccgtaacggtccgttaacggccgtttaaggggtttcccgggtacccggtttacccggggttaaccgtttacgggttttccggggaacccgtaggggggtaacccaagggtccgtaaggggtaacgtaccgtaaacgaaacggttacctagggtcgtacgtacgacaacccgtctttcgtcgtttacccg

SEQ ID NO: 161435 - DNA, 679 bp, Homo sapiens
  misc_feature: GYAE6OF01B5U6J.25.37.D04.1.454.CMB.1.raw
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagaccaccctgttctttgtctccgaaggggaaagcgccaccctctcctgcgagggccagtcagagttgttatcgaggttactagcctggtaaccaacacgaaaccgtggaccaggccctacccgaggcctccctcacttctatgactgaccactaccgaaggacgggacccacgtcggccacgtcccgagtcccgtagggttcaggtcggacgtagggtggggcgtagggaaccaggtacgttacaccgtctaccgacctactccgacgcgtacgttcgtacggacgtaccgtaggtaaagttcgtttacggactttaagtttacgttacgtcgtacgacgtcgtaggtaccgttcgtacgtacgggttcgggtacccggtttaccggggtacgttacgggtttccggaccggtaacgggtaccgtaggtaccggtagggagtaaccgtaacggaaaccgtcggtcggtacggaccgtacgacctacgtacttccgtcgttacccg

SEQ ID NO: 161436 - DNA, 541 bp, Homo sapiens
  misc_feature: GYAE6OF01AJ3R6.25.37.D04.1.454.CMB.1.raw
  modified_base (425)..(425): a, c, t, g, unknown or other
  misc_feature (425)..(425): n is a, c, g, or t
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
  modified_base (472)..(472): a, c, t, g, unknown or other
  misc_feature (472)..(472): n is a, c, g, or t
  modified_base (487)..(487): a, c, t, g, unknown or other
  misc_feature (487)..(487): n is a, c, g, or t
  modified_base (520)..(520): a, c, t, g, unknown or other
  misc_feature (520)..(520): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgtagcctccggattcgagtcttcagacaaatataggtgtagaacgtcgggtcccgccgacggctaccgagggtaaggggcgtagggaggtgggtcgcgtattcgtgagtagtagtagttacttaataaatactacgctagagtcgagtggacggctatcatctctcaaganaaccaacacgaagatcttatttgttctagacaatcgaangcngaagngaccgagtactcgtntcgtagttatgttgagcgagactaagagagagngtagcgtggcttgcttacggg

SEQ ID NO: 161437 - DNA, 852 bp, Homo sapiens
  misc_feature: GYAE6OF01CYUDQ.25.37.D04.1.454.CMB.1.raw
  modified_base (178)..(178): a, c, t, g, unknown or other
  misc_feature (178)..(178): n is a, c, g, or t
  modified_base (183)..(183): a, c, t, g, unknown or other
  misc_feature (183)..(183): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctccagatagcaccggagtaagttgtgttgacacagtctcagaccnccctntctttgtctccgaggggaacacgccaccctctcctgcgagggccagtcaggagttgttatcgtaggtacttagcctggtaaccaacgaacgtaaaccgtggacccacggtcctaccccgacggtcctaccctctaacttcctattacggattcgacctactaccgaaaggccgggacccacgtcggaccacgttaccccgacgccgtacggttacgaggtcgggtaccgtaggggtcggggtcgtacggggtactacggtacggttcccacgttctacccgaactaccgtacgacggtacctacgggttcgttaccgggaaccgttacccgttaaaggtaaacggttttacgtttttaacggtacggttttaacggtttttaacttaccggttcggtacgtaacggttccggacggttaccgtacgggttaccgttaccggggtttacccggggttacccgggtttaccgggggtttacgttttaacgggggttttaccgggggacccgggttaaacccgggggtaacccggtaacggttacgggtaacgggtaaaccggttaagtaaaccccggggttaaaacggttaacgggttccgggttacgggttaacccgtaccggtaaacccgttaaccgtttaccccggttcgtttcccgggttttacccc

SEQ ID NO: 161438 - DNA, 712 bp, Homo sapiens
  misc_feature: GYAE6OF01D86XH.25.37.D04.1.454.CMB.1.raw
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctaccagaccaccctgtctttgtcgtccgaagggggaaacacgccctaccctctcctgcacgggccagtcagtagtgttatcgaggtacttagcctaggtaaccaataagaaaccgtggaccgaggcctcccaggcctactcatntatnatgacacgtaccgaggaccggccacgtcggaccactacccgagtaccgaaggttccgaaggtcggaccgtaggggttcgggggccgttaggggaacgtaacggtacttaccgacctaccgttcaaaccgtataccgacgacgtaaggtccgtaggacgtacgttagtaagtttattttacgtaacctttaggttttaacttccgttagtacgacgtaacgagtacgtaacggtaccgtagggttaccggttacccgggtttaccggggttaacttacgggtttaccgggaccggaacgggggtaacctaacgggtccggttaaggaaacgttacgtaacggtaaacgttcgagggtccgagttacgacgtacccttagttccgttggttaaccc

SEQ ID NO: 161439 - DNA, 737 bp, Homo sapiens
  misc_feature: GYAE6OF01DZ7C4.25.37.D04.1.454.CMB.1.raw
tcagactgtacagtcacgaccggtgctcgatttagtagcatactgttgggtttgggggggagaggagcccagcactgggattccgaggtgtttccattcggtgatcagcactgaacacagagcactcaccagtggcgttttggctgagcgttgggttttccttgttgtcttagttttaaaaggtgtccagtgtgaggtgcagcgtggcggagtcgtgggaggaggcctgactccgacggccggtcgggggtccctgacgtacctctccgtgtgcacgtcctcgtggtcacggtcgttagtcacgtagtcttacgttgacgttcgtcgggtccgcgacggtccgtaccgggaggggacgggtcgtgggagtcgtcgtcgtacgtagtttattagacgacgtaataaactacctaacctacgtacacgtaacgtacccgtacggtacggaacggtccgttaactttccttatcccgtaacgaagaactaacctaacttaccgaaacgtaccctacccttatacttactaacgaaacgtccgaaccgtcctaggaacgtaccgaccggtaggaacccgtcggttaccgttaagttacgttacggtggtaccgggacgggtaacggggtaacttacgttaacggttaggttttacgggtttaacctttacggtaaccgttttaccctttacccgtttaccggaaacggggttccgggtcccggttacccggtttaccccgg

SEQ ID NO: 161440 - DNA, 564 bp, Homo sapiens
  misc_feature: GYAE6OF01APTRF.25.37.D04.1.454.CMB.1.raw
  modified_base (422)..(422): a, c, t, g, unknown or other
  misc_feature (422)..(422): n is a, c, g, or t
  modified_base (444)..(444): a, c, t, g, unknown or other
  misc_feature (444)..(444): n is a, c, g, or t
  modified_base (459)..(459): a, c, t, g, unknown or other
  misc_feature (459)..(459): n is a, c, g, or t
  modified_base (496)..(496): a, c, t, g, unknown or other
  misc_feature (496)..(496): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaggtgtccagtgtgaggtgcagctggcggagtctggaggaggcctgatccagccgtgggggtccctgagactctctgtgcagcctcgtgggttcagtcgttagtcacagctacttgatcgtacgggtccgcgaggcctccgaggggaacgggctggagtgcgtcgtcgtagtttactttagacgcgtaataacgtacccgacctactacgacagtaccgtccgtagaaggccgatttcctatctccagngacattccaagacctacctatntactacaagtgaacnccctagacgagccgagaccgacgtccgtagtattcgngtcggcgagggcgatacgtgtgttagttctaacttactacgttcctacgtacgggctaggttcctcgg

SEQ ID NO: 161441 - DNA, 783 bp, Homo sapiens
  misc_feature: GYAE6OF01DIBGO.25.37.D04.1.454.CMB.1.raw
  modified_base (280)..(280): a, c, t, g, unknown or other
  misc_feature (280)..(280): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggtcgttttggctgagcgttgggttttccttgttgcttagtttttaaaaggtgtccagtgtgaggtgcagcgtggcggagtcgtggaggaggtctgatccgacggccgttcggggggtccctgacgtaccttcctccgttggtcgacncgccgttcgttggggttccaggtcgtttaacgtcacgagtcctacttgactcgtcgggtccgcctaggtcgtaccgacggcgtaacgggggcgtgggagttgggcgttagggtacgtttacgttcggtctggaaacaagtaactaaatcgaactaagtactaccgacggaccgggtacggtcccggtagggacgggtcctagtttcccaaccgtacgtcccgtaccggaacgggtaactaaacgttaccgaaacgaacctaaccccttcgtaacgtacctgaaacctaaacttacgaaacgttacgttagggaaacgacgggttacggaacgggtaaccgttaacccgggtttaccgttttaacgttaccggttacggtccggtacccggtacccgttaacggaacggggttcggttaacgggtaacccggttaaaaggggtaaaacggtttcggttaaacggttcccgtaaccgttaaccccggtttcccgttaaccccggg

SEQ ID NO: 161442 - DNA, 1029 bp, Homo sapiens
  misc_feature: GYAE6OF01E20D1.25.37.D04.1.454.CMB.1.raw
tcagactgtacagtcacgaccggtgctcgatttagtagcatactgttgggtttggggggggagaggagcccagcactgggattccgaggtgtttccattcggtgatcagcactgaacacagagactcaccatggtcgttttggctggagtcgttgggttttccttgttgtcgttagttttaaaaggtcgtccagttgtgaggtgcagcgtggcggtagtcgtggagggacggcctgactccgacggcccggttcgggggtccctgacgtaccttcctccgtggtcgcgacgtccgtgtacggttcgtacgtcgttagtaccaacgtagtcctttagtcggtacttccggtccgggtcccgacccggacgggcccggtaccgggaaggggggtaacggggtccgttaaggggtcgttcggtcccgtttcgtacgtttaagtttaatttaagacggtaacgtaaacttaaacctaacccgtaacccgttactaacccgacgtaaccggtacccggttaaccgggtacgggtaaaccgggtacccttaaccggttttacccttacgttcccgtaacccggaaggtaaacccgtaaacctaaacccggtttaaccccggaaaacggttaaaacccccttccccgttttaaccgtttaaccctttacccgtttaaaaccgtaaaaccgttaccccgggtaaacccccgttccccgggttaaacggaaccggggaaacccgggtaaccccggtaaaccgggggtaaccccgttaaaccccggggggtttaacccgttttaagggtaaccggttttttacccgggagggttacccgggggtaaccgggggtaaccggggggttaaaccttaacggggtttttaaaaccggttttaacgggggtttttacgtttaaaccggtttttaacccgtttaaacgttttaacccccgtttttaccccgttttaccccggggttaaccggtttaccccggggggtacccccgtttttcgggggttacccccggtttacccggg

SEQ ID NO: 161443 - DNA, 776 bp, Homo sapiens
  misc_feature: GYAE6OF01BF39U.25.37.D04.1.454.CMB.1.raw
  modified_base (178)..(178): a, c, t, g, unknown or other
  misc_feature (178)..(178): n is a, c, g, or t
  modified_base (204)..(204): a, c, t, g, unknown or other
  misc_feature (204)..(204): n is a, c, g, or t
  modified_base (237)..(237): a, c, t, g, unknown or other
  misc_feature (237)..(237): n is a, c, g, or t
  modified_base (296)..(296): a, c, t, g, unknown or other
  misc_feature (296)..(296): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtcctcagacnccctgttctttcgctcgaggggaacncgccacctctcctgcgagggccagtcagagttntatcgaggtacttacgcgttaggaccaacacgaacgtcggcctaggcctcccgagtccncctacattctagtgatcactacgtaccgaagggacggacctacgtcggacctacctacccgagacccggttaggtacctagggtcggtacgtacgggggtcggggtaccggttaggggaacgtaacgttacggttacctaccgttccgtacctaaccgtacgttaccgaacgggtacctacgggtcggtacgggtacgtaccgttaaggtaaacgtttcgtttaacgtacgttttaacgttttaacttcgtaggttacctacggtccgtagtaaccgggtcgtacgggttcggttaccgggtacccgggtttcgggttaacgttttccggggtaacggttaccggggaacggttaaccggtacggtaccgggttaaacggtaacgtaaacccgtaaagggtaaaccgggttaacggttccgggtacggtacccgtacggtaccccgttaacgccgtttttaccggtacggtttacccccg

SEQ ID NO: 161444 - DNA, 730 bp, Homo sapiens
  misc_feature: GYAE6OF01CU9YQ.25.37.D04.1.454.CMB.1.raw
  modified_base (238)..(238): a, c, t, g, unknown or other
  misc_feature (238)..(238): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctccagatagcaccggagaagttgtgttgacacagtctccagacaccctgtctttgtctcgaggggaaagcgccacctctccgtgcgaggccagtcagagtgttancagtactagcctggtaccaacagaaccgtgcaggctccgagctctcatctatgatcgacacgtaccgaagacggccaacgtggaccactccccgaagtccgaggtttccaggtcggcgtaacgggtgggggtctacggggaaactacggtaacgtttccaaccgttcctacggaaaccctaatccgaagacgtacggtcgtacggtacgtaccgtaggtaagtttaatttacgtacgtttaacgttttacgtttaacgttcgtacgtaacgtacgtacggtacgttacggtaccgttaacgggtttccgggtacccgggttaaccggggttaaccgttaggtttttaccggggaccggtaaacgggggtaacccgtaaacgggtaccggttaagggaacggtaaacgttaaaccggtaaaaccggtaaaccggttacggtttacggacgttaaccgtacccgaaaccttaaccgttcgtttacggttaaccg

SEQ ID NO: 161445 - DNA, 834 bp, Homo sapiens
  misc_feature: GYAE6OF01EGHIH.25.37.D04.1.454.CMB.1.raw
tcagactgtacagtcacgaccggtgctcgatttagtagcatactgttgggtttgggggggagaggagcccagcactgggattccgaagtggtttccattcggtgatcagcactgaacacagaggactcaccatggcgttttggctgagctgggttttccttgttgctagttttaaaaggtgtccagtgtgaggtgcagcgtggcggagtcgtggaggaggcctgatccagccgtggggggtccctgacgactctcctgtgcagcctgtggtacagtcgtacgtcacagtctacttgactcgtcgggtccgccgagggtccgtaccgtagggggaaacggggtctaggggtaacgttggtccgtactacgtaggtttaatttacgagtacggtaacttaaacgtaccctaaccttacgaacgtccgaacgtacccgtccgtaggtaacggggtacctactttcccgttaatcccgtaaccgaagtaacgaacctaaattacccgaaacggtaaaccctacccgtacttaaacgtccgtttaaaccaaagttacccgggaaacccgtccccgttaagggaacccgacgaaccccggggaaggtaccccggtaaaccgggtcccggtttaagtttaaacttaccgggttaacgggtcggggaaccccgggtgggggggtaaaacttaaccggttaaccgggtttaaggttttacggggttttaaacttacccggggtttaaaacttttaacccccttttaacccgtttcccccggttaaaaacccggggtttccgggggtcccccggttaacgggggttttcccccgttaaccgggg

SEQ ID NO: 161446 - DNA, 869 bp, Homo sapiens
  misc_feature: GYAE6OF01D40AZ.25.37.D04.1.454.CMB.1.raw
  modified_base (215)..(215): a, c, t, g, unknown or other
  misc_feature (215)..(215): n is a, c, g, or t
  modified_base (777)..(777): a, c, t, g, unknown or other
  misc_feature (777)..(777): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggcctccagatacgcaccggagaagttgtgttgaacacgagtctccagacctacctgttctttcgtccgaccggaaggggaaacncgccctaccctctccgtgaccgaacggccagtactaggtacgttagttaactacgtacggttaacttacggtccgtacggtaaaccaaacgtaaacttaaaacccgtcggacccgtaaggtcccgtaccccgacgggtacccttcccgtacttacgttaccttagtaccgtagtaccgtactaaacgtaccccgggaaaggaccggttacccgaaccgggttcggaccgttaaccccacccgtaaccggtaccggtttaaccgggttaccgtaaaggggttccgggacggggtacggggggtcggggtaacgggtacgggtaaacgtaccgggtacggtttacccaccgttacccgtacctaacccgtaacgtaccgtaccggtacgttaacggttcgttaccgggtaacgttaaacccgtaaggttaacggtttacttttggaacttttacgtttaacgtttcggtactacgtacgtacgacggtacgtacggttcgtaacgggttccggtaccgggtttacgaccgggtttacgtacggaccgggtaaggttaaccccgnggtaccgtcgggtaacgtaactaaacgggttaaccgttaagggtcggttacgtaccggtcgtaccgtaacttcccgtttgttcgttaacccc

SEQ ID NO: 161447 - DNA, 937 bp, Homo sapiens
  misc_feature: GYAE6OF01DFA4K.25.37.D04.1.454.CMB.1.raw
tcagactgtacagtcacgaccggtgctcgatttagtagcatactgttgggtttgggggaggaactgctcagttaggacccagaagggaaccatggaagccccagctcagcttctcttcctcctgctactctggcctccagatacgcaccggagaagttgtgttgacactagtcctaccgacgacctacccttggttacctttttcggaccttaccggaaggggggaaaaacgccgtcccctaacccccttccgttacccgtcggaccggaacggggtcccaaaggttccgaaaggtaccgtttggttttaacgtaccgtaacgggttttaacctttacggaccccgtttaagggttaaaccccaaaacgaaccggtaaaacccgttgggacccccgtaagggtcccccttaccccggtaacgggtccctttaccccactagttaccttaagttcggtaacgtacgttacccgtaacgtaacccggaaacggggtaccggtacccgtacgtaacgggcccctaacgtcccccggtaaggaccccggttagggttaccacggggttcgggacgtacggggggtttcgggacggttagggaaccacgggttacgtccctaccgtaccgacctactacgtactagacgtacgtcggttacggacgtacgttaacggtaagtttacgttttacgtacgtttaacgttttaacgttaccgtagtacgtacggtacgtacgtgtaccggtacgtttacgggttccggtaccccggggtttacgggttacgggtttaccggtttaccggggacccgggtaagggtacccgtagggtacgtaccggggtaaacgtaaacggtaaaccgttaaccgggttacgggttaacggtaccggttaccgtacggggttaacccaccggtttatacccgggtttcgttacccc

SEQ ID NO: 161448 - DNA, 850 bp, Homo sapiens
  misc_feature: GYAE6OF01D7INZ.25.37.D04.1.454.CMB.1.raw
  modified_base (185)..(185): a, c, t, g, unknown or other
  misc_feature (185)..(185): n is a, c, g, or t
tcagactgtacagtcacgaccggtgctcgatttagtagcatactgttgggttgggggggagaggagcccagcactgggattccgaggtgttccagttcggtgatcagcactgaacacagaggactcaccatggtcgtttggctgagtcgttgggttttccttgttgtcgttagttttaaaaggtntccgagtgtgaggtgctagcgtggcggtagtcgtggaggtggtctgactccgaggtcccggtgggggtccctaggacgtacctcctccgtgtcgcacggtcctagttcggtacgagtcgttagtcaacgtataccttacgtgtacgtccggtcggggtccgtaccgtaggttcgaccggagggacggtaaggggtcgtagggtacgtgggtaccgttacgggttagtttacgtcggaacgtaggaaccaaagtaacaaacgtgtaacacgttaccgacggacgggtaccggtacggtacccggggtagggtaccgggtaacccgtacttacccgtaaccgtacgttacgaaccggtaaacggtaactaaacccggttaaccgaacgtaacccgttaaccttacgttacgtacgttaccgaaacgtaaacgtacgtaaacggttaacgtacggaaggttaaccgggtaaggaacggtttaacccggttacgtttaaccccgtttaggttaaaccgtcggtaacccggtaaaccgtacccggttaacgggtaaggttaccgggtaaacggtaaaccgggttaaaagggttaaaaaccggttccggtttaaacccgtaacccggtttaaccccggtttaccccggttaaccccgggttaaccccgggg

SEQ ID NO: 161449 - DNA, 828 bp, Homo sapiens
  misc_feature: GYAE6OF01EM92U.25.37.D04.1.454.CMB.1.raw
  modified_base (220)..(220): a, c, t, g, unknown or other
  misc_feature (220)..(220): n is a, c, g, or t
  modified_base (259)..(259): a, c, t, g, unknown or other
  misc_feature (259)..(259): n is a, c, g, or t
tcagactgtacagtcacgaccggtgctcgatttagtagcatactgttgggtttgggggaggaactgctcagttaggacccagagggaaccatggaacgccccagctcagcttctcttcctcctgctactctggcctccagatcgcgacggagtaagtttgtgttgaacactagtctaccagaccaccgttgttcctttcgtactaccggaaggggaaacncgtaccctaccctctccgtgacgacggcctagtcaggtnttagttacgtacgtagtacgttacgcgtacgtaaaccaacgtaacgaaccgtcggaccacgtcctaccgaggtcctaccttacacttcgtagtcgacgtacgaccgtaaccgtaccggaaacgggaccggtacccgaggtacgacctacctacccgaacggtaccggtaggttcgaggggtaccgggtaggacgggggttacggggacggtacgggtaacgtaacggttacgttacccgttaccttccctaaccgtaactaacggtaccgaggtaaccggtaacgttacgtaccggggttaactaccgggtttaagttaaccgtttaaggtttaccgtttaacgtttaacgtttttaacggtttctaccggtaacgtcgtacggtaacggttcgtacggttaacggtccgggttacgggtccgggtttaacgggttcgtttacggtaccgggtacgggtaacgggtaacctaacggtcggtaccgggtaacgtaacggttaacggaaacggttcggttaaaggtccgacggttacctacctaaggtttccctttgtaccccgtttcccg

SEQ ID NO: 161450 - DNA, 967 bp, Homo sapiens
  misc_feature: GYAE6OF01EWSXE.25.37.D04.1.454.CMB.1.raw
  modified_base (172)..(172): a, c, t, g, unknown or other
  misc_feature (172)..(172): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctgctccagatagcgacggagtagttgtgtgacacagtctcganaccacccttgttcttgtcgtacgaagggaanacgccacctctccgngcgaggccagtcgagtcgttagttacgtcgtaggttacttacggtaccgtacggtaacccaaacggaacgtaaacccggtccggaccgtacggaccccgtacccgaaccggttcctccccttatacttacggttatggaagtccgaccgtaacgtacccggaaaaggggtcccgggtacccctaacgggaccggtaccctaacccgttaaccccccggaagggttaccccgtaaccggggttttccgaagggggtttcggggaaacggtcccggggggttggggggtacccgttaggggggtaaaccttaaacggtttccgttaacccgttcccggtaaccccttccggtaaaaccctgtaacggtaccggtacgtaccggttaccggtacgggtaccggtacggttaacggtaaacggttttacttttcggtaaaccgttttaaggtttttaaccgtttaacggtaccgttaccgtaagggtacccgttaacggttacgggtaaaccggtttcgggtttacccgggggtttacccgggttcccccggggtttaaggggggtttaaccccgttttagggttaccccggggggtaaacggggtacccgggttaaaccgggacggggggttaactaacccggggtaacgggtaaaccgttaaaccgggttaaaggtaccggttaccgggggttaacctacgggtaacccgtaccgtaaccccgtttacgttaccggtttacccgtttaacc

SEQ ID NO: 161451 - DNA, 679 bp, Homo sapiens
  misc_feature: GYAE6OF01D6PQP.25.37.D04.1.454.CMB.1.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctcgaggggaanagccaccctctcctgcagggccagtcagagtgttatcgaggtacttagccttaggtaaccaanacgaaaccgtggaccaagggcctacccgaggtccttcctcatctatgatgcatacgaaggcggccacgtgcactccgagccgtaggttcaggtggacgagggtgggctagggacaggtacgttcactccgacaccgtataccgagctacgtcgtagggactaccgttaaggtaacgtttagttttacgtaacgtttaagttttacgttacgtgttacgaagtacgtaggtacggttacggtacgttacgggtttccggtacccgggttacggggttaactttcggggttttaccgggaccgggtaaacgggggtaccctaaggggcccgttaaggggtaaacgtaaccgttaaccggtaaaacggtcggttgggtacgtacgtacgaccctaacgttcgttacgtcgtttaccc

SEQ ID NO: 161452 - DNA, 827 bp, Homo sapiens
  misc_feature: GYAE6OF01BXM1H.25.37.D04.1.454.CMB.1.raw
tcagactgtacagtcacgaccggtgctcgatttagtagcatactgttggggtttgggggggagaggagcccagcactgggattccgaggtgtttccattcggtgatcagcactgaacacagaggactcaccatggtcgttttggctgagtcgttgggtttccttgttgtcgttaggttttaaaaggtcgtccgtagtgtggaggtcgacagcgtggacggtagtcgtagggaggacggccgtagactccgacggtccggtcgggggtcctagacgtactcgtccgtggtcgacgaccgtcgtcgttcgggtaccgtaggtcgttagtaccgactacgtaccttagttcggtacgtcggttaccgggtacccggaccggtacgggtacccggtaccgggtagggggtaacggggtcggttaacgggtcggtcggtcgttaccgttacgtttaacgtttattaacggtacgtaacgttaaactaaacccttaccctaccgttaaccgtaccgtaccgtaaccgtaccgttacgggtaacggtaaccgggtaccttactttaccgtactcctaacgaacgtacgaaaccttacgacccgtaaacgaacccttaccctaattaccgttactaacgtaaccgtacgacccgttcgaaggacgaacgtaccggaacgtacccggaacgttacgtacttaacgtcggtaggtcccgggtaagggtaccggtaagttaaccgttacgtttagggttacgttttacttaacggtttacctttaccgttttacccgacggtttccgggacggttaccgttccgggttcccggtaccg

SEQ ID NO: 161453 - DNA, 929 bp, Homo sapiens
  misc_feature: GYAE6OF01EL2BK.25.37.D04.1.454.CMB.1.raw
tcagactgtacagtcacgaccggtgctcgatttagtagcatactgttgggtttgggggaggaactgctcagttacggacccaggagggaaccagtggaacgccccagctcagccttctcttcctcctgctactcgtggccctcccgagatacgccgaacggtagtaagtttgtagttacgacctacgtaggtccttaccgaagaaccctccctttgtttaccgttttcgtaccgttacccgggaaagggggtaaccacccgacccctacccgttcctacccggttggaccggaacggtacccgaaggtacgtaacggtgtttagtttaaccgacgttaaggtttacccgttacggacccgttaaccggaaccaaagtaccggaaccgtcggaacccgaccgtcccgtacccgaggtcctaccgtactacttaccgtagtacgtacgtcgacctaaccgtaccggaagggtacccgtacacggtccgactaccgtcgaaccgtcgttagtacggtaggacgtcggacggggtcggaacgtcgggaaacgtcggtaccgttactaccgtaccctaaacggacctacgtacccgcgtaaccggttggtaacccggtacggtaccgtacccggttaagttaaccgtttacggtttaaccggtttacctttaagttttaacgtacgttaccggttacgaaccgggttcgtaaccgggttacggtaacggttcccgggtttaacggggtttaccccggtttaacggggtacccgggtttttattcccgggggttaaaccgggaacccgggttaacggtaccggttagggtaacggtaccgtaaaggttaacccggttaaacggtaacccggttggtaacccggttccgaacgttccgtaaccggtaactcccggtttaacgtccttttaacccgg

SEQ ID NO: 161454 - DNA, 595 bp, Homo sapiens
  misc_feature: GYAE6OF02HEUDN.25.37.D04.1.454.CMB.1.raw
  modified_base (303)..(303): a, c, t, g, unknown or other
  misc_feature (303)..(303): n is a, c, g, or t
  modified_base (519)..(519): a, c, t, g, unknown or other
  misc_feature (519)..(519): n is a, c, g, or t
tcagactgtacagtcacgaccggtgctcgatttagtagcatactgttgggttgggggagaggagcccagctactgggattccgaggtgtttccgattcggtcgatcagctactgaacacagaggactcgaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagcgttagtcacagctacttgatctgggtccnccgaggctccgaggggaaggggctggagtgcgtctcagttattatagcgataataccacctactacgcagactccgtggaacgggccgtatttccttatcctccagacgaacaattccaaggaacctaccctactactcttacaaatcgaaaccgccctagacgacgccgaagggaccacggtccgtagttaacttaccgtgtcgcggcggggganagtacgtaggttcggtttatttccgtaatttaccttacctttcccgtagtcggggtaccctacgggttccctcggg

SEQ ID NO: 161455 - DNA, 692 bp, Homo sapiens
  misc_feature: GYAE6OF02JK1C1.25.37.D04.1.454.CMB.1.raw
  modified_base (203)..(203): a, c, t, g, unknown or other
  misc_feature (203)..(203): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctccagatagcaccggagaagttgtgttgacacagtctccagacaccctgtctttgtctccgaggggaaangccaccctctcctgcagggccagtcagagtgttatcaggtacttagcctggtaccaacagaaacctggccaggcctcccgaggctcctcatctatgatgcatccgaaggacgggccacgtggacactcccgagcccaagggttcaggtcggcaggggttcggggcgtacgggggacagggtacgtttaccgacttaccgtaccaacccgtatacccgaaggtcctacggttaccgtcgggaacggtcccgtagggtaaacgttagttttacggacttaaggttttacttaacgttcggttacacggtcgtaaggtccgttaggacgtaggttccgggtacccggttaccgggggttacgttacgggttttccggaccggtaacgggggaacctaacgggtcgtagggaacggtaacgttaacggaaacggtaaccgtaggtacgggtaccgttacggacccgtaaccgtacgttaccgttacggttacc

SEQ ID NO: 161456 - DNA, 545 bp, Homo sapiens
  misc_feature: GYAE6OF02JE4NI.25.37.D04.1.454.CMB.1.raw
  modified_base (342)..(342): a, c, t, g, unknown or other
  misc_feature (342)..(342): n is a, c, g, or t
  modified_base (441)..(441): a, c, t, g, unknown or other
  misc_feature (441)..(441): n is a, c, g, or t
  modified_base (489)..(489): a, c, t, g, unknown or other
  misc_feature (489)..(489): n is a, c, g, or t
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctggggggtccctgagactctcctgtgcagcctctgggttcagcgttagtcacagctacttgatctgggtccgccaggctccgaggggagggctggagtgcgtctcagttatttanagcgataataccacctactacgcagactccgtgaacgggccatttccttatctccagagacaattccaggaaccaccctctatccttacaaatcgaacnccctagacgagccgagaccacggccgtgtattactgtcgcgcgggganagtacgtgttggttattcgattacctactttcctacgtgggcctagggttccctgg

SEQ ID NO: 161457 - DNA, 579 bp, Homo sapiens
  misc_feature: GYAE6OF02I6CMT.25.37.D04.1.454.CMB.1.raw
  modified_base (415)..(415): a, c, t, g, unknown or other
  misc_feature (415)..(415): n is a, c, g, or t
  modified_base (433)..(433): a, c, t, g, unknown or other
  misc_feature (433)..(433): n is a, c, g, or t
  modified_base (452)..(452): a, c, t, g, unknown or other
  misc_feature (452)..(452): n is a, c, g, or t
  modified_base (508)..(508): a, c, t, g, unknown or other
  misc_feature (508)..(508): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctggagactctcctgtgcagcctctgggttcagcgttagtcacagctattgatctgggtccgccaggctccgagggggaaggggctgggagtggcgtctcgagtttatttatagcgtaataaatacccacctactacgcagactccgtagaacgggccatttccttatctccaganacaattccaagacacctntatcttacaaatcgaaccnccctagagagaccgaggaccgacggtccgtgttacttacgtgtggcgggacggganaagttacgtaggttggttactttcgatttaccttactttcccgtagtcggggacctacgggttccctcggg

SEQ ID NO: 161458 - DNA, 509 bp, Homo sapiens
  misc_feature: GYAE6OF02GHL9K.25.37.D04.1.454.CMB.1.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaaangccaccctctcctgcagggccagtcagagtgttancaggtacttagcctggtaccaacagaaacctggccaggctcccaggctcctcatctatgatgcatccaagagggccactggcatcccagccaggttcagtggcagtggggctgggacagagttcactctcaccatcagcagtctggacgctgaagtatttgcgtagtttattactgtcagcagcgtagcagttggccgtcgggtactagttttcggcgtacgggacgagcgtggagtatacgtaaatgaacgtgtggcgtgcaccatctcg

SEQ ID NO: 161459 - DNA, 544 bp, Homo sapiens
  misc_feature: GYAE6OF02G0OZ6.25.37.D04.1.454.CMB.1.raw
  modified_base (262)..(262): a, c, t, g, unknown or other
  misc_feature (262)..(262): n is a, c, g, or t
  modified_base (310)..(310): a, c, t, g, unknown or other
  misc_feature (310)..(310): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaaagagccaccctctcctgcagggccagtcagagtgttatcaggtacttagcctggtaccaanagaaacctggccaggctcccaggctcctcatctatgatgcatccaagnggccacgtggccatccagccaggttcagtgcaggtgggctgggacagagttcactctcacatcagcagtctggacgccgtagaagtatttgactagtttattacttgtacagtcagcgtagcgtagttcggccgtcgggtactggtttcggccgaacggggtaccaaggtcgtagggagtaacgtacgaaacgtacgttaggtggtacgtcggaccaccgtacgttcgtgttcc

SEQ ID NO: 161460 - DNA, 524 bp, Homo sapiens
  misc_feature: GYAE6OF02H21M2.25.37.D04.1.454.CMB.1.raw
  modified_base (298)..(298): a, c, t, g, unknown or other
  misc_feature (298)..(298): n is a, c, g, or t
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
  modified_base (463)..(463): a, c, t, g, unknown or other
  misc_feature (463)..(463): n is a, c, g, or t
  modified_base (475)..(475): a, c, t, g, unknown or other
  misc_feature (475)..(475): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatcagccgtgggggtcctgagactctcctgtgcagcctctgggttcagcgttagtcacagctacttgatctgggtccnccaggctccgagggagggctggagtgcgtctcagttattatagcgaataataccactactacgcagactccgtagaacggccaattcctatctccagagacaattcaacgaacacctctatcttanaatgaacncctgagagccgagaccacggccgtatactcngtcgcgcggganatacgtgtgttattcgattacttacttccagtcgggctacggtcctcgg

SEQ ID NO: 161461 - DNA, 567 bp, Homo sapiens
  misc_feature: GYAE6OF02JA29J.25.37.D04.1.454.CMB.1.raw
  modified_base (346)..(346): a, c, t, g, unknown or other
  misc_feature (346)..(346): n is a, c, g, or t
  modified_base (496)..(496): a, c, t, g, unknown or other
  misc_feature (496)..(496): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctggggggtccctgagactctcctgtgcagcctctgggttcagcgttagtcacagctacttgatctgggtccgccaggctccgaggggaaggggctgggagtgcgtctcagttatttanagcgataataccacctactacgcagactccgtgaacgggccgattccttatcctccagagacaattccagaaccaccctctactcttacaaatgaaccgccctagagacgccgaggaccacggccgtgtacttacgtgtagcgcgggganagtacgtagtaggtttattcgatttaccttacctttcccgtacgttggggcccttacgggttcccctcggg

SEQ ID NO: 161462 - DNA, 563 bp, Homo sapiens
  misc_feature: GYAE6OF02IRU82.25.37.D04.1.454.CMB.1.raw
  modified_base (344)..(344): a, c, t, g, unknown or other
  misc_feature (344)..(344): n is a, c, g, or t
  modified_base (405)..(405): a, c, t, g, unknown or other
  misc_feature (405)..(405): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagcgttagtcacagctacttgatctgggtccgccaggctccgaggggaggggctggagtgcgtctcagttattanagcgtataataccacctactacgcagactccgtaggaacgggccatttcctatctccaganacaattccaggaaccaccctactatcttacaaatcgaaccgcctgacgagccgaggaccacggccgtgtacttactggtcgcgngggganagttacgtggttaggttatttacgatttactacctttccctacgtcggggacctacgggttccctcgg

SEQ ID NO: 161463 - DNA, 543 bp, Homo sapiens
  misc_feature: GYAE6OF02HM078.25.37.D04.1.454.CMB.1.raw
  modified_base (261)..(261): a, c, t, g, unknown or other
  misc_feature (261)..(261): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaaagagccaccctctcctgcagggccagtcagagtgtatcaggtacttagcctggtaccaanagaaacctggccaggctccagctctcatctatgatgcatccaagcggccacgtggcatccagccaggttcagtgcaggtggggctgggacaggagttcactctcaccatcagcagtcgtggacgcgtagtaagtatttgtactagtttattacgtgtactagcgagtcgtagtcgtagttcggccgttaccgggtacgtaggtttcggaccggtagggaccgagcgtaggacggtactacgaaacgtaacgtgtacggcgtcgacctacgtcgtctcgttac

SEQ ID NO: 161464 - DNA, 645 bp, Homo sapiens
  misc_feature: GYAE6OF02I1IOC.25.37.D04.1.454.CMB.1.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctgggaggaggcctgatccagccgtggggggtccctgagactctcctgtgcagcctcgtggggttcaggtcgttagtcacagtctacttgatcgtcggggtcccgccgagggcctaccggaagggggaacggggcgtgggacggtgccgttctcgtaagtttatttaagtaggcgtaataaactacccaccttactacgacacgaccgtccggtaggaacgggtcctactttccttatcctaccaagacgaactaacgttacccgacggaacctaccctactacttaccttaacaaatcgaaccgcccgtagacgaacggccgacgaccgccggtcgtagttacttacgtgtggcggacgggagtacgtacgtaggttagttatttacggacttttaccgtactttcccgtacggtcgggccgttacgggttccctcgg

SEQ ID NO: 161465 - DNA, 804 bp, Homo sapiens
  misc_feature: GYAE6OF02G45XD.25.37.D04.1.454.CMB.1.raw
tcagactgtacagtcacgaccggtgctcgatttagtagcatactgttgggtttggggggagaggagcccagcactgggattccgaggtgttccattcggtgatcagcactgaacacagaggactcaccatggcgttttggctgagctggtttcctgttgctgtttaaacggtgtccagtgtgaggtgcagctggcggagtcgtaggaggacggcctgactccgagtccgtacgggggtccctaggtacggaccttccgtaccgtcggtcgacgtacgtccgttcgtcgggtacacgtacggttacgtaccaccgtagtaccgttacgttacgtacgttccgtacgggtcccgacgtacggtaccgttacccggtaaggggtaaccgggtcgttacgggtacggttcgtaccggttaccgttaccgttaacggtttactttaacgtacggtaacgttaacgttaaccgtaccgtaccgttacgtacggactacggtaaccgttccgtaacgacgggtccgtatttccgttagcccgttaacggagttaacggacctaaacggttcccgaaaaggtaccccttaccgtagtacttacgtaacaacgttcgaccggttctagggacgtacgccgtaagggacccctacgggttacccgttagtaaccgtttacgtcggaccgggttaccggggtaccggttaactagttacccggtttagggtacccgtttaccttaggttaaacccttcgtttaacccggttaccggtaggtcccgggggttacttacccggggtttcctaccggg

SEQ ID NO: 161466 - DNA, 593 bp, Homo sapiens
  misc_feature: GYAE6OF02FUV61.25.37.D04.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaaangccacctctcctgcagggccagtcagagtgttatcaggtacttagcctggtaaccaanagaaacctggccaggcctcccagctcctcatctatgatgcatccaagacgggccacgtggacactcccagccgaggttcagtggcaggtggggctgggacagtacgtcactcgtcacatcagcagtctggacgcgtaggaagtatttgacttagtttattacgtgttcagctaggcgtagctaggtcggtaccgttaccggggttactacgggttttcgggccgtaaggggtaaccgtaaggtcgtagggaacggtaacggtaaccgaaaacggtaaccgttcggtaacggtccgttacggaccctaacggtaacttccgtaggtttacccg

SEQ ID NO: 161467 - DNA, 620 bp, Homo sapiens
  misc_feature: GYAE6OF02GEBGO.25.37.D04.1.454.CMB.1.raw
  modified_base (302)..(302): a, c, t, g, unknown or other
  misc_feature (302)..(302): n is a, c, g, or t
  modified_base (334)..(334): a, c, t, g, unknown or other
  misc_feature (334)..(334): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttcctcgttgctcttttaagaggtgtccagtgtcaggtgcagctggtggagtcgtgggggaggcgtggtccagcctgggaagtccctgacgactctcctgtgcaacatctggattcgccttcagttaacttggcatccactgggtccncaggctccgaggcaagggactagaggtgggtntacttttatgggctagtgatggcagtgaataaagcctaagtcgacagacctccggtacaaggggtcccgtcttcctccctactccgtaccgaagacgaaccgaaccgacccgaaagaaacggtaccggttccgttttacgacgtaaatacggaaaacgtccctaggaaccgacccggaacggaaccgacggactaagttacgttaactttacgtggtacgacggaagtacggaccgaggtacggaaggtacggtggacgtaggtcggccgtacgggacgtaccggg

SEQ ID NO: 161468 - DNA, 718 bp, Homo sapiens
  misc_feature: GYAE6OF02H3U10.25.37.D04.1.454.CMB.1.raw
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctgggaggaggcctgatccagccgtggggggtccctgagactctcctgtgcagcctctgggttcagtcgttagtcacagctacttgatcgtgggtcccgcaggctccgaggggagggctggagtgcgtctctagtttattanagcgattaaacnccaactactacgcaagacctccgtaggaacggccgtactttccctttaatcctcccgaagacgaactaaacgttcccgaaacggtaaacccaccccttacttaacttcccctttaaagaaaaacgttcggtaaaaccccgcccgttaggaaacgggacgacccccgggtaagggaacccgacccggggtaccgtttacggttaaacttttccgagggttccggccggggtaaccgggggataaccggtttacgtaagggtttcggggtttaactttttaccgggaattttacccgtttacctttttacccccggtaggttccggggggaccccttacgggggtttacccccttcgggg

SEQ ID NO: 161469 - DNA, 779 bp, Homo sapiens
  misc_feature: GYAE6OF02F5Z0T.25.37.D04.1.454.CMB.1.raw
tcagactgtacagtcacgaccggtgctcgatttagtagcatactgttgggtttgggggggagaggagcccagcactgggattccgaggtgtttccattcggtgatcagcactgaacacagaggactcaccatggctagtttggctgagtcgttgggttttccttgttgcttaggttttaaaggtgtccagtgtggtaggtgcagtcgtgggcggtagtcgtagggaggacggtcctgactccgacggtccgggttcggggggtccctggacgtaccttccgttccgtggtcgccgacgtcccttcggttcggggttcaacggtcgtttacgtaccacgtgtcctttacgttgtacgttccggttacggggtccccgcgacgggtccgtaccgggaagggggaacgggtcgtggggtacgtcggtccgttcttacgttaaggttttatttacgacggtacgtaaacttaaaccgtaccctaacctaaccgtacgacgacgtaccgttccgggtaagggtaaccggggtaccttacgtttccttactccgtaccgaagaacgtaacttaacgtaccgaaacgtaaccctacccttattacttacctaacgtaaacgtaccgaacccgtccgtaggacgtaccggaccggacggaccgtaccgggtcgttagttaacttcggtggtcgcgggtaggacgtacgttacgttaggtttgttaacgttcgtaactttaccgttacccgtttcccgacgggttccgggtaccgttcggttaccccg

SEQ ID NO: 161470 - DNA, 533 bp, Homo sapiens
  misc_feature: GYAE6OF02GCZTB.25.37.D04.1.454.CMB.1.raw
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (259)..(259): a, c, t, g, unknown or other
  misc_feature (259)..(259): n is a, c, g, or t
  modified_base (368)..(368): a, c, t, g, unknown or other
  misc_feature (368)..(368): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgctccaggggaaangccacctntcctgcagggccagtcagagtgttatcaggtacttagcctggtaccaanagaaacctggccaggctccaggctctcatctatgatgcatccaaggagggccactggcatcccagccaggttcagtcgcaggtgggctgggacagagttcactctcacntcagcagtctggagcctagaagtatttgacttagtttattactgtcagcagtcgtagctagttcgggccgtccggggtactaggttttcggccgtaggggaaccaaggtcgtagggagtagtaccgaaacggacttggtaggctacgccgactacgtctgttacc

SEQ ID NO: 161471 - DNA, 682 bp, Homo sapiens
  misc_feature: GYAE6OF02HDWLQ.25.37.D04.1.454.CMB.1.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagcgttagtcacagctacttgatctgggtcccgccaggctccgaggggagggctgggagtgccgtctctagtttatttatagcgtataaactacctacctactaaccgcaacgacctccgtaggaacgggccctatttccttatcctaccagacaactaacttaccgaacggaacctacccttactactaccttacaaacttgaaacccgtccctaggacgacggaccgacggaccgaccgggtcccgttagttacgtttaacgtcggtacggtccgggacgggggtactacgttaacggttacgggtttaggttttaacttttccgggtaactttttaacccgtttaccccgtttttccccgtacgggttccgggttaccggggggttacccctaccggggttttcccccgg

SEQ ID NO: 161472 - DNA, 728 bp, Homo sapiens
  misc_feature: GYAE6OF02HU91H.25.37.D04.1.454.CMB.1.raw
  modified_base (314)..(314): a, c, t, g, unknown or other
  misc_feature (314)..(314): n is a, c, g, or t
  modified_base (366)..(366): a, c, t, g, unknown or other
  misc_feature (366)..(366): n is a, c, g, or t
tcagactgtacagtcacgaccggtgctcgatttagtagcatactggttggggtttgggggggagaggagcccagcactgggattccgaggtgtttccattcggtgatcagcactgaacacagaggactcaccatggcgttttggctgagctgggttttccttgttgcttagttttaaaaggtgtccagtgtgaggtgcagctggcggagtctgggaggaggcctgatccagccgtggggggtccctggagactctcctgtgcacgcctcgttgggttcagtcgttagtcacagctacttgattcgtgggtcccnccgaggcctccggagggggaagggctgggagtcgcgtctcgtagtttattanacggacgaattaactacccaccttaactaccggcaacgtacctccgtaggaaaccgggccgttaatttcccttaactccttacccgaaaggaacgtaaacctaaacgttcccgaaacgggtaaaccctaccccttacttaaccttaccggtttaaactaaaaacgtcggtaaacccgtcccttaggaacggacggacccggtaaggaccgtacgggtcccggttattaacgtttacgtgcggtacgggagggggacttagtacggttaggtttaccggtttaatttaccgtaacgttttaaccttacccgttttacccgtaacgggttcggggtaccctttacggggttccccttaccgggg

SEQ ID NO: 161473 - DNA, 585 bp, Homo sapiens
  misc_feature: GYAE6OF02FL0BD.25.37.D04.1.454.CMB.1.raw
  modified_base (346)..(346): a, c, t, g, unknown or other
  misc_feature (346)..(346): n is a, c, g, or t
  modified_base (427)..(427): a, c, t, g, unknown or other
  misc_feature (427)..(427): n is a, c, g, or t
  modified_base (435)..(435): a, c, t, g, unknown or other
  misc_feature (435)..(435): n is a, c, g, or t
  modified_base (446)..(446): a, c, t, g, unknown or other
  misc_feature (446)..(446): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctggggggtccctgagactctcctgtgcagcctctgggttcagcgttagtcacagctacttgatctgggtccgcaggctccgaggggaaggggctgggagtgcgtctctagtttattanagcgtaataactaccctactactacgcacgactccgtgaacgggtccgatttcctatctcagagacattccagaccacctntatcttanaaatcgaaccncctgacgagcccggagacgacggtccgtagttacttactggtcgcggagggagagtacgtaaggttcggtttaagtttcgtaactttacgttaccttttacccgtacggtcggggtcccttacgggtttcccctacggg

SEQ ID NO: 161474 - DNA, 758 bp, Homo sapiens
  misc_feature: GYAE6OF02IR2LN.25.37.D04.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
tcagactgtacagtcacgaccggtgctcgatttagtagcatactgttgggtttgggggaggactgctcagttaggacccagagggaaccatggaagccccagctcagcttctcttcctcctgctactctggctcccagatagcaccggagaagttgtgttgacacagtctccagacaccctgtctttgtctccgaagggaancgccaccctntccngccagggccagtcagagttgttancgaggtacttagccctaggtaaccaagacgaaaacctggaccacgggtcctacccgaggccttcccgtacaacgtccgttaatgaacgttcgacctaactacccgaaaggacggggtacccctaacggtcggtaccaaaccgttccccacggtaccccgaaggttaccgaaggttcggaccgaggggttcggggacgtacggggaaccgtaaggtacgtttccgaacgttcctccaaccgtaactcgaggtcgtaacgttcgtaagggacgtaccgtagggtaacgttaacgttttcgacgtttaagttttacgttaaccgttacggttaccgtacgtacggttacgaccggttagtacgggtacggtttccggtcccggttaacggggtacgttttagggttccggtaaccggtaacggggttaccacggtacggtggtaaccggtaagttaaccgaaacggttacgttacgggttcggtacgtacggtaccctaacggtacttcggttaccgttac

SEQ ID NO: 161475 - DNA, 623 bp, Homo sapiens
  misc_feature: GYAE6OF02GQLHY.25.37.D04.1.454.CMB.1.raw
  modified_base (204)..(204): a, c, t, g, unknown or other
  misc_feature (204)..(204): n is a, c, g, or t
  modified_base (264)..(264): a, c, t, g, unknown or other
  misc_feature (264)..(264): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccgaggggaaanagcccaccctctcctgcagggccagtcagagtgttatcaggtacttagcctggtaccaanagaaacctggccaggcctcccaggcctcctcatctatgatgcatccgaaggacgggccacgtggaccacgtccccgagcccgtaggttccaggttcggccgaggtcgggggctaggggacaggtacgtttccacgttctccaaccagtcgagctagtcgtggacgtccgtagtaaagttactttgacgttagttttacttacgtgtacagtcgagtcgtagcgtaggttccggtaccggttcggggttacgttacgggtttcggaccggtaacggggtaccaaggtcgtagggtacgtaacgtaaccgaaacggtacgtaggtacggtacgtcggaccgtaccgtagttccgtagttcc

SEQ ID NO: 161476 - DNA, 655 bp, Homo sapiens
  misc_feature: GYAE6OF02G6777.25.37.D04.1.454.CMB.1.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagcgttagtcacagctacttgatcgtcggggtcccgccgaggtcctcccggagggggaacgggggcctaggggaggtcggccggtctctagtttaatttagagcgtaataaactaccacctaactacgcagactccggtagaacgggccgtatttccttatcctaccaagacgactaaacttccaaggaacctacccttctacttcttacaaatcgaaaccgcctagacgacgccgaaggaccgaccgggtccgtagttaacttaccgtggtcggcgggtacggggatacgttaacgttagggttcggttttaactttccggtaattttacccgttaccttttaccccgtagtcgggggtacccttacgggggttccccttacggg

SEQ ID NO: 161477 - DNA, 671 bp, Homo sapiens
  misc_feature: GYAE6OF02JHJOM.25.37.D04.1.454.CMB.1.raw
  modified_base (579)..(579): a, c, t, g, unknown or other
  misc_feature (579)..(579): n is a, c, g, or t
  modified_base (619)..(619): a, c, t, g, unknown or other
  misc_feature (619)..(619): n is a, c, g, or t
tcagactgtacagtcacgaccggtgctcgatttagtagcatactgttgggtttgggggggtaggagggagcccagcactgggattccgaggtgtttccattcggtgatcagcactgaacacagaggactcaccatggcgtttggctgagctgggttttccttgttgctgtttaaaggtgtccagtgtgaggtgcagcgtggcggagtctgggaggaggcctgatccgagccgtggggggtccctggagactctcctgtagcacgcctgtggttcagtcgttagtcacagctacttgatcgtggtccgccaggctccgagggaagggcctgggacgtggcgtctcgtagttattataggactagtaaactaccaacccgttactaccgctaacgtaccgttacccgttaggaaaccggggtcccgaacgttttacccgttaactcccgttaccctaagggacggtaacctaaacgttacccgtaaggaaaccctaccccttacgttaacttccttacgaaattcggaaacccgtcctacgacgacgtaccgaggtaccaacgggtccgtagtacttacgngtacgcggaggggatatacgtaggttcgttagttaccgtntttaaccgttactttccccgaggttcggggaccctacgggttcccctacggg

SEQ ID NO: 161478 - DNA, 696 bp, Homo sapiens
  misc_feature: GYAE6OF02JWLMN.25.37.D04.1.454.CMB.1.raw
  modified_base (311)..(311): a, c, t, g, unknown or other
  misc_feature (311)..(311): n is a, c, g, or t
  modified_base (438)..(438): a, c, t, g, unknown or other
  misc_feature (438)..(438): n is a, c, g, or t
tcagactgtacagtcacgaccggtgctcgatttagtagcatactgttgggtttgggggggtaggagggaggcccgagcactgggattccgaggtgtttccattcggtgatcagcactgaacacagaggactcaccatggcgttttggctgagctgggttttccttgttgctgtttaaaggtgtccagtgtgaggtgcagctggcggagtcgtggaggaggcctgatccagccgtggggggtccctgacgactctccgtgtgcagcctcgtgggttcagtcgttagtcacagctacttgatctcgggtcccncgacgtctaccgaggggaacgggctgggagtgcgtcgtcgtaaggtttattagtacggcgtaataaactacccaccttaactacgcaacggtactccggtagaacggggtccctatttcccgttaanccttaacccaggtacgaaccctaacgttacccgaacggtaaacccaccccttagtaactccgttaacaaaagttcgaaacccgcccgttggaaaccgacgtcccggaaaggaccgaaccggtcccggttaagttaacttccgtggaaccggcggtaggggaattcgttaacgtagggtttggtttaaccttacgtaccgtttacttaacccggttttcccgaaggttcgggggaccccttaggggtttccccctaggg

SEQ ID NO: 161479 - DNA, 595 bp, Homo sapiens
  misc_feature: GYAE6OF02IN2LM.25.37.D04.1.454.CMB.1.raw
  modified_base (511)..(511): a, c, t, g, unknown or other
  misc_feature (511)..(511): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaggtgtccagtgtgaggtgcagctggcggagtctggaggaggcctgatccagccgtgggggtccctgagactctcctgtgcacgcctcgtgggttcagtcgttagtcacagctacttgatcgtgggtccgcaggctccgaggggagggctggagtgcgtctctagttatttatagcgaataactaccacctacgtacgcagacctcgagaacgggcctatttccttatcctacagacgacaacttaccaaggaacaccctctactcttacaaatcgaaccgccctgacgacgaccgagggaccacggtccgtagttaattcgtgtggcggacgggganagttacgtaggtttacgttacgtttacgtacgtttaacttaccctttccgtaccgtcggggaccgttaccgggttccctacggg

SEQ ID NO: 161480 - DNA, 755 bp, Homo sapiens
  misc_feature: GYAE6OF02JSNSL.25.37.D04.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (248)..(248): a, c, t, g, unknown or other
  misc_feature (248)..(248): n is a, c, g, or t
  modified_base (275)..(275): a, c, t, g, unknown or other
  misc_feature (275)..(275): n is a, c, g, or t
  modified_base (309)..(309): a, c, t, g, unknown or other
  misc_feature (309)..(309): n is a, c, g, or t
  modified_base (412)..(412): a, c, t, g, unknown or other
  misc_feature (412)..(412): n is a, c, g, or t
tcagactgtacagtcacgaccggtgctcgatttagtagcatactgttgggtttgggggaggaacgtgctcagttaggacccagagggaaccatggaagccccagctcagcttctccttcctcctgctactctggctcccagatagcaccggagaacgttgtgttgacacagtctccagacaccctgtcttgtctccgaggggaaancgccacctntcctgcctagggccaggtcaaggtacttgttanctaggtaccttagcctggtaacctaanacgtaaacctggaccaggcctccaggcctcctanactctatgatgactactccgaaagcgggccactggctacgtcccagtccagggttccaaggtcgctaggtgggacttcgggactaggattcccgaacgtttcncccgtaacccgtagttaccgacggtaccgtagtacccggttaggaacgtccccggttaagtaaccgttaagtttaccggtaccgttaaggttttaacgttacgtttacggtacgtaaaccggtacgttaacggtaccggttaacggtacgtaaccgggtttaccgggtacccgttaccgggggttaaccttaacgggttttccggaacccggttaacggggtaacccgtaaacgggtccgttaacgggtaccggaaacgtttaccggaaaccgttaacggtccggttaaccggttaccgtaacggtacccgttaaccggacggtttaccttacggttaacccg

SEQ ID NO: 161481 - DNA, 684 bp, Homo sapiens
  misc_feature: GYAE6OF02H1UDO.25.37.D04.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctccagatagcaccggagaagttgtgttgacacagtctccagacaccctgtcttttgtctccgaggggaaangccaccctctctgcagggccagtcagagttgttatcaggtacttagcctggtaaccaanagaaacctggccaggctccaggctctcatctagtgatgactataccgaaggtcgggcctaacgtcggcaactcccgaggccctagggttctaggtcggcgtagggtcggggactcggggaactaggtacgtttccacttcctacgtaacacgttaccagactaggttcgtacgggtacgtaccgttaggtaaagttacgttttcgacgtttagttttaacgttacttgttaacaggtacgaggtcgtaggtcgttacggttacgggtcccggttaccggggtacgtttacgggttttcgggaaccggtaggggtaaccctaagggtaccgtagggaacggtaacgtaaccggtaaaacggtaaccgttaggtccgggttaccgtacgtaacccgtaccgttacgttccgtcgttttacccg

SEQ ID NO: 161482 - DNA, 753 bp, Homo sapiens
  misc_feature: GYAE6OF02JXQ5C.25.37.D04.1.454.CMB.1.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
tcagactgtacagtcacgaccggtgctcgatttagtagcatactgttgggtttgggggaggaacgtgctcagttaggacccagagggaaccatggaagccccagctcagcttctcttcctcctgctactctggctccagatagcaccggagaagttgtgttgacacagtctccagacaccctgtcttgtactcgagggaangccacctctcctgcgaggccagtcagngtcgttancaggtattacgcctggtaaccaagagaaaccgtggaccaggctcccgaggtcctccgtacatctatggatcgacactacaaggacgggccaactcgggactacgtaccccgaaggtccaaacgggttttcgaacggttcggaccgtaaggggtcggggggtacttacggggggactaacgggtcctttaccaacggttcccgaactaccccggaatttcgacccgggtacgtacgggtttaccggtaggggtaacccgtacccggtaaggttaaacggtttaaacgttttcccgggtaactttaaacggtttttaacgtttacgtttacggttacgaccggttacggtaacgggtacgttaccggtagttaacgggttccggttacccggtaccggggtacgtttacgggtttacggaccgggtacggggtaaccgtacggtcggaggtaacggtctaaccggtaacgaacggtttacgcggttcgtacgaccgtaccgtaggttcctagttacccg

SEQ ID NO: 161483 - DNA, 738 bp, Homo sapiens
  misc_feature: GYAE6OF02GRQ5A.25.37.D04.1.454.CMB.1.raw
  modified_base (207)..(207): a, c, t, g, unknown or other
  misc_feature (207)..(207): n is a, c, g, or t
tcagactgtacagtcacgaccggtgctcgatttagtagcatactgttggggtttgggggaggaactgctcagttaggacccagagggaaccatggaagccccagctcagcttctcttcctcctgctactctggctcccagatagcaccggagaagttgtgttcgacacagtctaccagacaccctgtctttgtctccgaggggaaancgccaccctctcctgcgagggtccagtcagagttgttaatacaggttacttagcctaggtaacccaagacgaaacctcggccacggctccccaggcctcctcattctatcgaagtcgaccgactaccgaacggacgggacctacgtgggaccacgtcccgacggtaccgtacgggttccaaggttcggacggtaacggtcggggggtcctagggggaacacggtacgtttaccaggttccctacgaaccctataccgaagcctaggttaccggtacggtacgtacgtaggtaaacgttacgttttcggaactttacggttttaacttacgtttcgttacgaagtacgtacggtcgttaacggtcgtacggttccgggtacccggtaccggggttaactttcgggtttttaaccgggaccggtaaacgggggtacctacgggtacggtacggtaacgtaacggtaacctaaaccggttacggttacggtacgtacggtcctaacgacccgttacttacgttcgttaacccgg

SEQ ID NO: 161484 - DNA, 777 bp, Homo sapiens
  misc_feature: GYAE6OF02G3Y6V.25.37.D04.1.454.CMB.1.raw
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtcctcagaccaccctgtctttgtctccgaaggggaagcgcccaccctctcctgcagggccagtcagagttgttatcgaggttactagcctggtaaccaagacgaaacctggccaggcctccgaggcctcctcatcctatgatcgcactaccgaaggacgggccacgttggacacctccgagcccgtaggttcgaggtacggctaaggggtcggggacgtacggggaactaggtaacgtttccgaacttcccggtacaacctaacgttccgaagtaccgtacggttaccgtacgggtacgtacccggttaagtaaacggtttagttttacggtaaccgtttaaggtttttaacttaacggttcggttaccgtaacgtccgtaaacggtacgttaacggtcgttaaccggggtttccgggtaacccggtttacccgggggttaaacgtttccggggttttaccgggaccgggtaaaccggggttacctaaaacgggtcgtaagggtaccggttaaccgtaaaaccggtaaacgggttaaccgttcgggtaaccgggttaccgtaacggtaccgtaaaccccggtttagttacccggttacgtttaacccgg

SEQ ID NO: 161485 - DNA, 631 bp, Homo sapiens
  misc_feature: GYAE6OF02F81LA.25.37.D04.1.454.CMB.1.raw
  modified_base (498)..(498): a, c, t, g, unknown or other
  misc_feature (498)..(498): n is a, c, g, or t
  modified_base (542)..(542): a, c, t, g, unknown or other
  misc_feature (542)..(542): n is a, c, g, or t
  modified_base (554)..(554): a, c, t, g, unknown or other
  misc_feature (554)..(554): n is a, c, g, or t
tcagactgtacagtcacgaccggtgctcgatttagtagcatactgttggggtttggggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgactccagccgtgggggtccctgagactctcctgtgcagcctcgtgggtcagtcgttagtcacgagtctacgttgactcgtcgggtccgccgacggcctccggacggggaacggggctagggagtcgtcgtctctagtttattactagacgaataacctaccacctaactacgcacgacgtccgtacggaacgggtacctactttccttacgtcctaccgaagtaacactaacgttccgaaacgacctaccctctactacttaacaagtcgaaccnccctagacggacgccggaaggccaccgggtctagttactcgtgnggacggtggganacttacgtaaggttgttactcttacttacccttcgtttacccgtacggtcgggtacccgttacgggttccctaccgg

SEQ ID NO: 161486 - DNA, 868 bp, Homo sapiens
  misc_feature: GYAE6OF02H2F6P.25.37.D04.1.454.CMB.1.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttagttttaaaaggtgtccagtgtgaggtgcagcgtgggcggagtcgtgggaggacggcctgactccgaggccggttcggggggtccctggacgtacctccgttccgtggtcgacgacggtccgttcggttcggggtttacacggtcggtttaggtaccaacgtacgtccttaccttgtacttccggttcgggtccccgaccgacggtccgtaccgggaacgggggtaacggggtccgtaggggacgttcggccgttccgttacgttagttttaatttaacgtacggtaacgtaattaaactaaccccgtaaccttaacgtaccgacgaacgtaccgtccggtacggaaacgggtcccgtaacttttacccgttacgttacctacccgaaggtaaccgtaaactaaccgtttacccggaaacggtaaacccctacccgtttaccttaaactttaccgtttaacgtaaaacgttaccggtaaacccgtacccgtaggaccggtaacgggacccggaacggaccgtaccgggtaccgttagttacgttcgtcggacgggtaccgggtaggggtaacgttacgttacggtttaagggtttcgggtttttacttaaccgttttaacgttttaacccgtttacccgtttttacccggacgggtttaccccgggggtccgttacccggggttttccccgttacccggg

SEQ ID NO: 161487 - DNA, 647 bp, Homo sapiens
  misc_feature: GYAE6OF02JH52Q.25.37.D04.1.454.CMB.1.raw
  modified_base (288)..(288): a, c, t, g, unknown or other
  misc_feature (288)..(288): n is a, c, g, or t
  modified_base (345)..(345): a, c, t, g, unknown or other
  misc_feature (345)..(345): n is a, c, g, or t
  modified_base (443)..(443): a, c, t, g, unknown or other
  misc_feature (443)..(443): n is a, c, g, or t
  modified_base (449)..(449): a, c, t, g, unknown or other
  misc_feature (449)..(449): n is a, c, g, or t
  modified_base (472)..(472): a, c, t, g, unknown or other
  misc_feature (472)..(472): n is a, c, g, or t
tcagactgtacagtcacgaccggtgctcgatttagtagcatactgttgggtttgggggggaggaggagcccagcactgggattccgaggtgttccattcggtgatcagcactgaacacagaggactcaccatggcgtttggctgagctggtttccttgttgctgtttaaaggtgtccagtgtgaggtgcagctggcggagtcgtgggaggaggcctgactccgagccgtggggggtccctggacgactctcctgtacgcacgcctcgtgggttcagtcgttagtcacngcttatgactcgtcggtccgccgtagccgtccgaggggaagggctcggagtgcgtcncgtacgttattatagcgtaataactaccaccttactacgacagacctcggtagaacgggcctatttcctatccaccgagacgacaacttcgagtaacncccgtntacgtctaataaactcggaaccncctaggactacggaccgtacgaccgtaacgggtccgtagttacttaacgtggtacgccgggtacggggaatacggtaacgtttaagggttcggtttaactttacggaccgttttaaccttaccggtttcccgtaaaggttcggggggtacccttcccgggtttacccgtaccggg

SEQ ID NO: 161488 - DNA, 720 bp, Homo sapiens
  misc_feature: GYAE6OF02FR484.25.37.D04.1.454.CMB.1.raw
  modified_base (205)..(205): a, c, t, g, unknown or other
  misc_feature (205)..(205): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagaccaccctgtctttgtctccgaggggaaancgcccacctctcctgcagggcctagtcagagttgttatcgaggtacttagcctaggtaccaactagaaaccgtggccaggcctaccccgaggcctccctcactctaatgatgcataccgaagacgggcctacgtggcactcccaggcctaggttcaggttcggacgtacggggtgggccgtaggggactaggtacgttcacgtctaccgactatcgagctacggtcgtacgggactccgtaaggttaacggtacttttacggacttacgtttttaacgttaccgtcggttacacgttacgacggttaccgggtaggtccgttaacgggttcccgggtaacccgggtttaccgggggtttaactttacggggtttttaccggacccgggtaaacgggggtacccgaacgggttcggtaacgggtaacggtaacgtaaacccggtaaaccgggtacgttacgggttaccggtacgttacggtaacccgtaaccgtctttaccggttaggtttacccc

SEQ ID NO: 161489 - DNA, 765 bp, Homo sapiens
  misc_feature: GYAE6OF02JW8VM.25.37.D04.1.454.CMB.1.raw
  modified_base (599)..(599): a, c, t, g, unknown or other
  misc_feature (599)..(599): n is a, c, g, or t
  modified_base (673)..(673): a, c, t, g, unknown or other
  misc_feature (673)..(673): n is a, c, g, or t
tcagactgtacagtcacgaccggtgctcgatttagtagcatactgttggggtttgggggggagaggagcccagcactgggattccgaggtgtttccagttcggtgatcagcactgaacacagaggactcaccatggtcgttttggctgagtcgttgggttttccttgttgtcttaggttttaaaaggtgtccagtgtgaggtgcagcgtggcggtagtcgtagggagggacggcctagactccgacggtcccgggttcggggggtccctggacgacctccgttccgtggtcgcgacgtccgttcggttcgggttacacggtcgttagtccaacgtacgtaccttattgtacgttccggtccgggtcccgccgacggtccgtaccgggagggggtaacgggtcgtagggacgtcggccgttactacgttaagtttattacgtacgacgtaagtaacctacccgtaactacgtaccgactaacgtaccgtaccggtaggtaaccgggtcttacgtttaccttactccgtacgtaagtacgtaactaacgtacccgaacgtaaccctacctacttaacttactaactaaacgtacgtaaccnccgtagacggacggaaccggacgtaccgtccggttaccttgttaacgttacgcggtacgggacggacgggttanagttacggttggtttacgttacgttaacgttacctttaaccgttccgtttacccggagggttacccggttcgttaccgggttccctaaccgg

SEQ ID NO: 161490 - DNA, 693 bp, Homo sapiens
  misc_feature: GYAE6OF02GKVQX.25.37.D04.1.454.CMB.1.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
  modified_base (313)..(313): a, c, t, g, unknown or other
  misc_feature (313)..(313): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggcctccagatagcaccggagaagttgtgttgacacagttctccagaccacccttgtctttgacctcgaggggaaancgaccaccctntacctgacagggccagtcagtagttgttaancgtaggtactgccttaggaaccaacagaaacctcgacaggctccgaggcctcncatctagtgangtcactaccgaaagacgggtaccatcgggactacgtcccacggtccgttaacggtccgtaggttacggcgtaacggggtcgggtacggtaaggggaccgtaaggtacgttacgaaccgttcgaccaacctacgtacagtaccgtaagtacggtgaccggtccgtaggtaaacgttagtttactaggttaactttagttactcggttacgtaactcgaacgtccggtagtcgtaggttccggtacgggttccgggtaacgttgttttaccgggaacggtacgggtaacgtacggttaggacggtacggaaacgttaccgaaacggtaacggttaggaccgggttacacggtaccgaccttacggtacttaccgttacccgg

SEQ ID NO: 161491 - DNA, 560 bp, Homo sapiens
  misc_feature: GYAE6OF02FJCFW.25.37.D04.1.454.CMB.1.raw
  modified_base (306)..(306): a, c, t, g, unknown or other
  misc_feature (306)..(306): n is a, c, g, or t
tcagactgtacagtcacgaccggtgctcgatttagtagcatactgttggttttgggggaggaactgctcagttaggacccagagggaaccatggaagccacagctcagcttctcttcctcctgctactctggctcccagatagcaccggagaagttgtgttgacacagtctccagacaccctgtctttgtctccgaggggaaagagccaccctctcctgcagggccagtcagagtgttatcaaaaaaggtcttagcctggtaccaacagaaacctggccaggctcccaggctcctcatccacggtncatccaccagggccactggaattccagccaggttcagtggcagtgggtctgggacagacttctctctcaccatcagcagcctgcagtctgacgtattttgctagtttattactgtcagctaagttaataaaacgtgggtaccgtaacttaggttttacggccgtaaggggtaaccaagcgtagggacacgtacaggaacgtaacgtggtggtccgtcgaccgtaccacgttccgtcgttacttcctattccccg

SEQ ID NO: 161492 - DNA, 692 bp, Homo sapiens
  misc_feature: GYAE6OF02H432L.25.37.D04.1.454.CMB.1.raw
tcagactgtacagtcacgaccggtgctcgatttagtagcatactgttgggtttggggggggagaggagcccagcactgggattccgaggtgtttccattcggtgatcagcactgaacacagaggactcaccatggcgttttggctgagcttgggttttccttgttgctagttttaaaaggtgtccagtgtgaggtgcagcgtggcggagtctgggaggaggcctgatccagccgtgggggtccctgagactctcctgtgcagcctcgtggtcagcgttgtcacagctacttgatcgtgggtcccgcaggccgtacgaggggagggctgggagtgcgtctcgtagttattagtagcgtaataactaccacctactacgcagtactccgtaggacgggtccgtatttcccttatcctaccgagaagaacctaacttaccgaaggaaccctaccccgttctaacttccttaactaaactacgaaccctaccgtaggaacgacgcccggaacgggacccgaacccgggtccgttacgttactttacggtacggtcggccgggacgggtagtacgtaaccggttaagggtttacggttttacgtttaacgttaccttttaacccgtttaaccccgtttttccccgttaacgggttcccgggggtacccggtttaccggggttccccgttaacccggg

SEQ ID NO: 161493 - DNA, 549 bp, Homo sapiens
  misc_feature: GYAE6OF02FQT3U.25.37.D04.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (262)..(262): a, c, t, g, unknown or other
  misc_feature (262)..(262): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaaanagccaccctctcctgcagggccagtcagagtgttancaggtacttagcctggtaccaanagaaacctggccaggctcccaggctcctcatctatgatgcatccaagacggccagtggcatcccagccaggttcagtcggctaggtcggggctggggacagacgttcacgtctacacctatcagcagtctggacgcctagaagtatttgctagtttattactgtcagcagtcgtagctaggttcggccgttaccggggtacttagtttcggaccgtacgggaccgaaggtcgtaggagtacgtacgaaacgtacgtaggtggctcgccacgtacgttcgtgttaccg

SEQ ID NO: 161494 - DNA, 922 bp, Homo sapiens
  misc_feature: GYAE6OF02H939C.25.37.D04.1.454.CMB.1.raw
tcagactgtacagtcacgaccggtgctcgatttagtagcatactgttggggtttggggggggagaggagcccagcactgggattccgaggtgtttccattcggtgatcagcactgaacacagaggactcaccatggtcgtttttggctgagtcgttgggttttccttgttgtcttaggttttaaaaggtgtccagtgtgaggtgcgagcgtggcggtagtcgtgggagggcggcctgactccgaggtcccggttcggggggtccctgacgtacctccgtcgtgtcgccacgtcccttcggttcggggttacacggtcgtttaacgcaacgtacgtcttacgttgaacgttcggttacgggccccggtcctacgggtccgtaccgggaaggggggtaacgggtccggtagggtaggttcggtaccgttctacgttaaggttacttaggtacgtaacgaaacttaaaccgttaaccctaccttaaaccgtacggtacctaacggtacccgttaccggtaacggggtaaccgggtacccgttaacttttacccttacgtcccgaacgaaggtaaccgtaaacctaaccgttaacccggaacgtaaaccctacccgtttactaaccgtttaaccttaaacgtaaaaccgttacccgtaaccggtacccgtagggtaaaccggaccgggacccgggtaaacgggacccgtacccggggttaaccggtttacggtttaaacttccgggtacggtaaccggggaccgggggtacgggttaaacggtaacgtttaccggttttaagggtttaaccgggtttttacgtttaaacggtttcccgttttaaaccctttcccggttttaccccgggtaacgggtttaacccgggggtttaccccgttaccggggtttccccgttaaccccgggg

SEQ ID NO: 161495 - DNA, 591 bp, Homo sapiens
  misc_feature: GYAE6OF02HFKG2.25.37.D04.1.454.CMB.1.raw
  modified_base (282)..(282): a, c, t, g, unknown or other
  misc_feature (282)..(282): n is a, c, g, or t
  modified_base (356)..(356): a, c, t, g, unknown or other
  misc_feature (356)..(356): n is a, c, g, or t
  modified_base (480)..(480): a, c, t, g, unknown or other
  misc_feature (480)..(480): n is a, c, g, or t
  modified_base (514)..(514): a, c, t, g, unknown or other
  misc_feature (514)..(514): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagcgttagtcacngtctacttgatcgtgggtcccgccaggccgtccgaggggaaggggctgggagtcgcgtctcgtagtttatttanagcgaataactacctacctaacgtacgacagtaccgtccgtgaacgggcctatttcccttatcctccgaagaacgactaacttaccgaaggaacctacccgtatactaccttacaaatcgaacnccctgacgacgcgaagcgaccggcgtagtattcngtcgcggcgggatagtacgtaggttgttattcgtatttaccgttacttcccgtacgtcgggtacctcggttccctgg

SEQ ID NO: 161496 - DNA, 690 bp, Homo sapiens
  misc_feature: GYAE6OF02I647S.25.37.D04.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggctccagatagcaccggagaagttgtgttgacacagtctccagaccaccctgtctttgtctccgaaggggaaancgcccaccctctcctgccagggccagtcagtagtattancgaggttactagcctaggtaaccaacgagaacctggccacggcctcccaggcccttcctacacttcgtatgatcgaccagtaccgaaggcgggacctagtcggacaccttcccgagacccgtaggttcaggttcggacgtaggtcggggctaggggactaggtacgtcgtacttcgaccgactacgtcgacgtccgacggttacgcggaccgtcgtaaggtaagtttcgtttacggactttagttttaacgttacgttgtacgtcgtaccgagtacgtaacgtcgttacgggttccgtacccgggttacggggttacctttacgggtttacggacccgggtaacggtaccgagggttcgagggtacgttaaccgtaaccgtaaacggtacgttacggtccggtaacgttcccgtaaccgtaaccgtcgtttaccgtagtttacccg

SEQ ID NO: 161497 - DNA, 653 bp, Homo sapiens
  misc_feature: GYAE6OF02GJ40W.25.37.D04.1.454.CMB.1.raw
  modified_base (443)..(443): a, c, t, g, unknown or other
  misc_feature (443)..(443): n is a, c, g, or t
  modified_base (558)..(558): a, c, t, g, unknown or other
  misc_feature (558)..(558): n is a, c, g, or t
tcagactgtacagtcacgaccggtgctcgatttagtagcatactgttgggtttggggggggagaggagcccagcactgggattccgaggtgttccattcggtgatcagcactgaacacagaggactcaccatggcgtttggctgagctgggtttcctgttgctgtttaaaggtgtccagtgtgaggtgcagctggcggagtctgggaggaggcctgacgtccgaggtccggtcggggggtccctggacgtactcctcctgtgcacgtcctcgttcgggtcaggtcgttacgtcacagtctacttgactcgtcgggtcccgccgacggcctaccggagggggacgggcgtagggaggtcgacgttctacgtagtttattagagacgaataacgtaacccacctactacgcacgtacctcggtaggaacggtcctatttcctacnctaccgagacactaactccgacgtaacccaccttactacttcttaacaaacgtcgaaccgtccgtagaccgtaacggccggaaggaccgtaccgggtcgttagttacttaccggnggtacggacgggtacgggatacgtacggttagggttagttacttcggtaactttccgttaccgttccgacggtcggggccttacgggttcctcgg

SEQ ID NO: 161498 - DNA, 662 bp, Homo sapiens
  misc_feature: GYAE6OF02IWKDU.25.37.D04.1.454.CMB.1.raw
  modified_base (177)..(177): a, c, t, g, unknown or other
  misc_feature (177)..(177): n is a, c, g, or t
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
  modified_base (264)..(264): a, c, t, g, unknown or other
  misc_feature (264)..(264): n is a, c, g, or t
tcagactgtacagtcacgaccggtgctcgatttagtagcatactgttgggtttggggaggaactgctcagttaggacccagagggaaccatggaagccccagctcagcttctcttcctcctgctactctggctcccagatagcaccggagaagttgtgttgacacagtctccagacnccctgtctttgctccgaggggaanagcccaccctctcctgcgagggccagtcagagtgttancgaggttacttagcctggtaccaanagaaacctggaccaggcctcccgagcctcctcatctatcgatcgacagtaccgaaggacgggtccacgtggacctaacgtccccgagtccctaagggtttccaaggttcggacaggggtcgggggcttaggggacaggtacgttccaacttctaccgacaagtcaagcgtagtcgtcggacgtcccgtagtaaacgttagttttcgacgtttaacggttttacttaaccgtttgttacgacgtacgtaggtacgtcgacgtacggtttaccggtcccgtttaccggggtactttacgggttttcggacccggaaggggtacccgaaggtccggtaggtacggtaactacgaaacggtacgttaggtggtactcggacctaccgtattccgtcgttacc

SEQ ID NO: 161499 - DNA, 726 bp, Homo sapiens
  misc_feature: GYAE6OF02I2RJD.25.37.D04.1.454.CMB.1.raw
  modified_base (485)..(485): a, c, t, g, unknown or other
  misc_feature (485)..(485): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttgtttaaaaggtgtccagtgtgaggtgcagctggcggagtcgtggaggaggcctgactccaggccgtggggggtccctggacgactctcctgtcgctacgcctgtgggttcgagtacgttacgtcacacgtccttaacttgtatcgtcgggtcccgccgacggccgtaccggaacgggggaagggtcgtgggtacgtggccgtcgttccgtaagtttacttttaatacggtacgtaaattaactaacccgtacccttaaccgtacgacgtaacgtaccgttaccggtacggaaccggggaccttacgtttaccctttanacccgttaccgaggaacgtaactaacgtttacccgagaacccgtaaccttacgtaacttacgttacaaattaccggaacctcccgtagacggtaacgaaccggaccggaccgtaccggtccgttagtactttacggtcgtcgacgggacgggtagtaacgttcttaaggttaacggtttattccgttaacgtttacgttaccctttccggttaccggtcggccggtttacggttccctacg

SEQ ID NO: 161500 - DNA, 811 bp, Homo sapiens
  misc_feature: GYAE6OF02IP8MK.25.37.D04.1.454.CMB.1.raw
  modified_base (212)..(212): a, c, t, g, unknown or other
  misc_feature (212)..(212): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcgtggtttcgtgttagctgtttaaaagtgtcagtgtgaggtgcagctggcggagtcgtgggaggnggtcctgactccgagccgttcgggggcctgagtacctctcctgtgcacgcctcgtaggttcaggtcgttaagtcacgacgtcttacgttgtactccggtcgggtcccgaccgtacggtccgtaccggggaaggggtaacggggtcgtagggtacggtcggtccgttccgttacgttaagttttaatttaacgtacggtacgttaaacgttaaaacctaaccccgtaacctttaaaccgtaccggtaccgtaaacggttacccgttaacccgggttaacgggaaaccggggtcccttaacgttttaccttaacttaccgttacccgaaagtaccggtaaccttaaccgtaccgtaaacgtaaacccgtacccttaacgtacttaaccttaactaaacgtaacgtaacccgtccgtaacgacggtaacgaccggtacggtaacccgacggtaccgttacgtttaacttacggtacggtacgggtacgggtaccggggtatacggttaacggttcggtttacgtttagtttaaccggttactttaaccgtttaccgtttaccgtaccgggttacggtaaccggttccggttacccgttccgg

SEQ ID NO: 161501 - DNA, 620 bp, Homo sapiens
  misc_feature: GYAE6OF02HPNBE.25.37.D04.1.454.CMB.1.raw
  modified_base (420)..(420): a, c, t, g, unknown or other
  misc_feature (420)..(420): n is a, c, g, or t
  modified_base (452)..(452): a, c, t, g, unknown or other
  misc_feature (452)..(452): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttagtttttaaaaggtgtccagtgtgaggtgcagctggcggagtcgtggaggaggcctgatccagccgtgggggtccctgacgactctcctgtcgcagtcctcgtgggttcagcgtttagcacagctacttgactcgtggtcccgccgaggcctccggaaggggacgggctgggagtcgcgtctacgtagtttattagagactataactaccactactacgcacgtactcgtaggacgggtcactttccttacnccttccaagacgaacctagtaccacgaaaccnccctatattccttataacgacaaccgcctagacgacgaccggaggaccacgggtccttagtacttcgtgtacgcgggacggggactagttaacgtcggtttacgttagtttctaatttaccgttactttcccgtaaggttccggggaccttaccgggttcccttacgg

SEQ ID NO: 161502 - DNA, 647 bp, Homo sapiens
  misc_feature: GYAE6OF02I5495.25.37.D04.1.454.CMB.1.raw
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
  modified_base (375)..(375): a, c, t, g, unknown or other
  misc_feature (375)..(375): n is a, c, g, or t
  modified_base (430)..(430): a, c, t, g, unknown or other
  misc_feature (430)..(430): n is a, c, g, or t
tcagactgtacagtcacgaccggtgctcgatttagtagcatactgttgggtttgggggaggaactgctcagttaggacccagagggaaccatggaagccccagctcagcttctcttctcctgctactctggctcccagatagcaccggagaagttgtgttgacacagtctccagacacccctgtcttttgtctccgaggggaaangcccaccctctcctgcacgggccagtcagngtgttatcaggtacttagcctggtaccaacagaaaccgtggccaggcctccccaggcctcctcacgtcttatgatgccatccgaaagcgggccacgtggccatcccagtcaggttcaggtcggcaggtgggctgggaacnggtacgttcacgtctaccactagtcagctacgtcgtggtacgacctggtaacgtntttacggactagttttacttacttgtacaacgtcgtaagtcgttaacgcgtacggttccggacccggtttaccggggttaaccttacgggttttccggaacccgggtaaggggtaacccgtaagggttccggttaagggtacgtaacggtaaccgtaaaacgtcggttaaggttcgaccgttcgtaacccgaccgtaccgttccgtagtttaccccg

SEQ ID NO: 161503 - DNA, 749 bp, Homo sapiens
  misc_feature: GYAE6OF02GAUK8.25.37.D04.1.454.CMB.1.raw
  modified_base (210)..(210): a, c, t, g, unknown or other
  misc_feature (210)..(210): n is a, c, g, or t
tcagactgtacagtcacgaccggtgctcgatttagtagcatactgttgggttgggggaggaactgctcagttaggacccagaggaaccatggaagccccagctcagctctcttcctcctgtctactctggctcccagactagcaccggagaagttggtcgttgacacagtctaccgagacaccctgtctttgtcgtaccgaaggggaaancgccaccgtctcctaggcctacgggccaagtccgagtagttcgttacgcgagttaccttagccgttagggtaacccaaacgacggaaaccgtggaccgaggcctcccgacggtcctacacgtactacgtatcggtaactcggctactaccgaacggacgggaccacgtacggactacgtccccagtcctaaggtcaggtcggacgtaggggtcgggtacgtaggggacgtaacggtacgtacctaaccgttcgtaacctacgtaactaccgtacggacgtacggtcgtacgggtaacgacggttaggaaacgttcgtttaggacgttttaacgttaatttacgtgtatacgtactacgtaaacggaaggttaaccggtacggtaccgttaaccgtatttaccgttaccgttaacccggtttcggaacccgttaccggggtaaccttaacgggtagttaaccgtaaaccgtaaccggtaaaaccgtacgggttaacggtacgttaccgtccggtaccctagtaccttcgtacttaacccg

SEQ ID NO: 161504 - DNA, 626 bp, Homo sapiens
  misc_feature: GYAE6OF02H0P0O.25.37.D04.1.454.CMB.1.raw
  modified_base (420)..(420): a, c, t, g, unknown or other
  misc_feature (420)..(420): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
  modified_base (478)..(478): a, c, t, g, unknown or other
  misc_feature (478)..(478): n is a, c, g, or t
  modified_base (518)..(518): a, c, t, g, unknown or other
  misc_feature (518)..(518): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttagttttaaaaggtgtccagtgtgaggtgcagctggcggagtcgtggaggaggcctgatccagccgtcgggggtcctgagactctctgtgcagcctcgtggttcagtcgttagtcacagcttacttgattcgtcggtccgccgaggctaccggaggggaacgggcgtggagtcgcgtctcgtagttatttatagacgtaataactaccaacctactacgacaacgactccgtagacgggccgtactttccttancctaccgagaacactaactccgaaacgacccnccttntaactcttaacgaatcgaccncgtagacgcgaccgagaccgacgggccttagtactttcgnggtcgcggtacgggatacgtacgtggtttcggtttaattaccggtaactttacctttacccgttttcccgtacgggttccggggtaccctttacggggtttccctcgg

SEQ ID NO: 161505 - DNA, 824 bp, Homo sapiens
  misc_feature: GYAE6OF02IUIW7.25.37.D04.1.454.CMB.1.raw
  modified_base (171)..(171): a, c, t, g, unknown or other
  misc_feature (171)..(171): n is a, c, g, or t
  modified_base (214)..(214): a, c, t, g, unknown or other
  misc_feature (214)..(214): n is a, c, g, or t
  modified_base (455)..(455): a, c, t, g, unknown or other
  misc_feature (455)..(455): n is a, c, g, or t
  modified_base (513)..(513): a, c, t, g, unknown or other
  misc_feature (513)..(513): n is a, c, g, or t
  modified_base (723)..(723): a, c, t, g, unknown or other
  misc_feature (723)..(723): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggcctacccagtatagccaccggagaagttgtgttgacacngtcctcagaccacccgtgttcttcgtcaccggaaggggaaacncgaccctacccgttctaccgtgaccggacgggaccagtcgagtacgttagttacgacgtacggttacgtcgtccgtaggtaaccaacaacgtaaccgtcggacacggtcctaccgacgtacctcacctatacggtactaggtactaccacgtaaccgtaccggaaacggttacccgggcctaggttacccggacctacccgttaaccgaccggaccggtttaaccggtcgtaaaccggggnggtacccggtaggggtaccggggtgggtacggtaaacccggtaggtcccggtttaacncccggtaccttaacccgaaacgtcggaacgttaacccgaggttacgtcggtaacgggaaccgtcgtaaggtttaattaccggttataaccgttaaccttgttaacgtttacgaaacttaaacggttaaacgtttacgtacccttacgttccgttaacgttacccggtacgggtacggtaccgggaaacgtaacgggtgtaaaccggttanaaacgttacccggagttacgggtaacggtcccttaagggaacccttaggttccttacgggtttaccctacggttacccgtactttcccccgtaaccgtacg

SEQ ID NO: 161506 - DNA, 841 bp, Homo sapiens
  misc_feature: GYAE6OF02HMW2Z.25.37.D04.1.454.CMB.1.raw
tcagactgtacagtcacgaccggtgctcgatttagtagcatactgttggggtttgggggggagaggagcccagcactgggattccgaggtgtttccattcggtgatcagcactgaacacagaggactcacatggcgtttggctgagctgggttttccttgttgcttagtttaaaaggtgtcagtgtgaggtgcagctggcggagtctgggaggaggcctgatccaggccgtgggggtccctgagactctcctgtagcacgccttcgtgggttacagtcgttacgtacaacgagtcttaactggtaacttcggttcggggtacccgccgaacggtcctaccggaagggggtaacgggcgtgggaaggtcgtcgtctacgtagtttattacaggtacaattaacaaccctacctaacgtaccgctaaacggtacctacgggtacggaaaaccggggttccgtaaattttacccgtttaacttaccgtaccccgtaaaagggtaaaccgttaaacccgtaaaacgttaccccggtaaacgggtaaaacccttacccccggtttaacttaaacttaacctttaacctaaaacggttaacgtaaaaccccggttcccgaggtaaaccggaaccggtaccgggtaacggaaccgaaccgggttccgtttaagttaacttttaacggcggttaacgccggggtaggggtaaattacccgttaaggttaaccggttttgggtttaaacccgtttacgtaaacggttttaaccccttttacccgtttaccccggttaaggggtaccccgggggtttaacccgttaccgggggtttacccccttaaccggg

SEQ ID NO: 161507 - DNA, 868 bp, Homo sapiens
  misc_feature: GYAE6OF02GTXM4.25.37.D04.1.454.CMB.1.raw
  modified_base (745)..(745): a, c, t, g, unknown or other
  misc_feature (745)..(745): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcgtgggtttctgtgctagtttaaaggtgtccagtgtgaggtgcagctggcggagtcgtgggaggtaggcctgactccgagccggtggggggtccctaggacgactcctccgtgtcgcacgcctcgttgggttcaggtcgttagtcacgagtcttacgtgtacttccggtcggggtccccggcccgaacggggtcccgtaccgggaaacggggggaacggggtccgttagggggacgttcgggtcccggttaccttacggttaaaggtttttatttaaggtaacggtacgttaaaacttaaaccgttaaacccccttaaccgttaaccgtaacccggtaccggtaaaccggtaccccgtttacccgggtaaacgggggtaaacccggggtccccggtttaaacctttttaccccgtttaacttcccccggtaaccgtaaaggtaaccccgttaaaccgtaaaccctttacccgggaaaacgggtaaacccctacccccttggttaaccttaccgttaaacaacgttacgaacccgtccgtagaaccggtacgacccgggtaagacccggtaccggggtccttacggtttaattaccggnggtacggacggggtacgggacttaagttaccggtagggttttaacgtttcttaaccggtaactttccggttttaaccctacggtttccgggtacgggtccgttacccgggttccccgtacggg

SEQ ID NO: 161508 - DNA, 749 bp, Homo sapiens
  misc_feature: GYAE6OF02JA6JU.25.37.D04.1.454.CMB.1.raw
  modified_base (206)..(206): a, c, t, g, unknown or other
  misc_feature (206)..(206): n is a, c, g, or t
  modified_base (282)..(282): a, c, t, g, unknown or other
  misc_feature (282)..(282): n is a, c, g, or t
  modified_base (296)..(296): a, c, t, g, unknown or other
  misc_feature (296)..(296): n is a, c, g, or t
  modified_base (643)..(643): a, c, t, g, unknown or other
  misc_feature (643)..(643): n is a, c, g, or t
  modified_base (655)..(655): a, c, t, g, unknown or other
  misc_feature (655)..(655): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttaggttttaaaggtgtccagtgtgaggtgcagctgggcgngtcgtggaggcggcctgatccaggccgtcggggggtccctggagcctccgtcctgtgctcgcccgtcgttgggtcngtcgttgtaccacngtaccttactggacgttcgtcgggtcccgtccgacggtccgtaccggagggggaacggggtcgtagggacggttcggccgttaccttacgttaagttttattttaagacgaccgttaaattaacctaacccctaaccgttaaccgtacgaccgtaacgtacccgtaccggtacgggtaaccgggtcccgtttactttacccgttactcctaaccctaagggaactaaccgtaaacgttcccggaaccggtaaccctacccttccttaacttaccttaaactaaagtaccggtccccaccgttggacggacgaccggtacgaccggaccgtcgttacgtaccttacgnggtcggacgggngggtagtacgtacgtttggtacggtttacttacgttacgtttacctttaccgttaccggttacgtcggggtacccttcggggttcccgtaccgg

SEQ ID NO: 161509 - DNA, 761 bp, Homo sapiens
  misc_feature: GYAE6OF02HF9DX.25.37.D04.1.454.CMB.1.raw
  modified_base (289)..(289): a, c, t, g, unknown or other
  misc_feature (289)..(289): n is a, c, g, or t
  modified_base (328)..(328): a, c, t, g, unknown or other
  misc_feature (328)..(328): n is a, c, g, or t
tcagactgtacagtcacgaccggtgctcgatttagtagcatactgttgggtttggggggggagaggagcccagcactgggattccgaggtgtttccattcggtgatcagcactgaacacagaggactcaccatggcgttttggctgagcttgggtttttccttgttgcttagttttaaaaggtgtcagtgtgaggtgcagctggcggagtcgtgggaggacggcctgactccaggccggtcggggggtccctggacgaccttcgtcctgtgcacgccttcgtgggttcngtcgtttagcacagtctattgactcgtcggtcccgccgnggcctccggaggggaacggggtcgtgggagtcggtctcgttacgttagtttattatacggacgtaactaacttaacccaccttaacctaacgaccgtaacgtaccgtaccgggtaggaaaccgggtcccgttacttttcccgttattcccgtaccgaggtaaccaaccgtaacttacccgaaacggaaccctacccgttaacctttaactacctttaacaaacttacggaacccgtaccgtacggacggtaacgaccggaaccggacgtaccgggccgttaaggttaccttaggtcgtcgggacgggtacggggtagtaacgttacggttaggtttacggtttaacgtttacgttacgttttaacccgtttaccctttttaccccggaggtttacccggggttacccgttaccggggtttccccggttaccgg

SEQ ID NO: 161510 - DNA, 896 bp, Homo sapiens
  misc_feature: GYAE6OF02I4JMN.25.37.D04.1.454.CMB.1.raw
tcagactgtacagtcacgaccggtgctcgatttagtagcatactgttgggtttgggggggagaggagcccagcactgggattccgaggtgtttccattcggtgatcagcactgaacacagaggactcaccatggtcgttttggctgagtctggttttccttgttgcttagttttaaaaggtgtccgagtgtgaggtgcagcgtggcggagtcgtgggaggaggccgtgatccacggtccgtcgggggtccctgacgactctcctgtcgcacgccgtcgttcggttcacggtcgttacgtaccacgtagtccttacgtgtacgttcgtccgggtccgaccgacggtccgtaccggaggggaacggggcgtacggagtacgtccgtcgtacgtaaagtttagtttacgtaacggtacgaacgttaaaccttaaccgtacccgttacgtaaccgacgtacgtaacccgttaccgtaacgggtaaccgggtaccgtaccgtttacccgtttaactccccgtaacgaacggtaactaaaccgtaacccgttaacctaaaccgggtaaaccctaacccccgttattaaccctttaccgtaaaccttaaacggtaccccgttaaaccgtccccgtaacggaaacgttaccccgggaccggttaaacccgggccgtaaaccccggggttcgttaaacgttaaccggttttccacgggtttacccggtaacccgggggacgggtttaccgtaaagttttaccggggttaaacggtttttacgggtttaaccgtttaaccgtttaaacccggttttttaaacccgtttaccccgggtttttacccgaccgggtttttacccgggggaaccccgttttaacccgggggttccccgtttaaacccggg

SEQ ID NO: 161511 - DNA, 866 bp, Homo sapiens
  misc_feature: GYAE6OF02FM7NT.25.37.D04.1.454.CMB.1.raw
  modified_base (609)..(609): a, c, t, g, unknown or other
  misc_feature (609)..(609): n is a, c, g, or t
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtgggaggaggcctgatccgagccgtggggggtccctgagactctccgtgtgcacgtcctcgtgggttcagtcgttagtcacagtcttacttgacttcgtcggggtccccgccgacgggtcctccggaagggggacgggggcgttaggggaggttcggtccgttccgttcgttaagttttaagttttaagtaggtaccgtaaacgttaaacctaacccctaacccgttaaccgtaccgacccgtaacgtacccgttccggtagggaaaccgggtcccggtaacttttaccctttacttcccgtaccgaaggtaacctaaaccttaactttacccggaaacggtaaaccccgtcccctttaacttaaccgtttactttaaaccgaaattaaccggtaaccccncccggttacggaaaccggtcgggaaccccgggacgggtaaacccgacccggggtttaccggtttaggttaaaccgtttacggttcgggtcgggtacccgggggtacgggggtaataccggtttaaccggtttagggtttacggggtttttaacctttacgggttaacttttaaccccgtttaccccgtttttaacccccggtagggttaccccgggggtttacccgtttacccgggggttttcccccgttaccgggg

SEQ ID NO: 161512 - DNA, 673 bp, Homo sapiens
  misc_feature: GYAE6OF02I37PB.25.37.D04.1.454.CMB.1.raw
  modified_base (205)..(205): a, c, t, g, unknown or other
  misc_feature (205)..(205): n is a, c, g, or t
  modified_base (437)..(437): a, c, t, g, unknown or other
  misc_feature (437)..(437): n is a, c, g, or t
tcagactgtacagtcacgaccggtgctcgatttagtagcatactgttgggtttgggggaggaactgctcagttaggacccagagggaaccatggaagccccagctcagcttctcttcctcctgctactctggcctcccagatagcaccggagagttgtgttgacacagtctccagaccaccctgtctttgctaccgaaggggaanacgccaccctctcctgcgagggccagtcagagttgttaatccaaggttacttagccttaggtaaccaacgaagaaacccgtggacccaaggtcctcccgaggtcctacctcattactaagtgaatcgacacgtacgaaggcggcctacggtcgacctactccccaggtaccctaggttacgaggcgtacggaagggttcgggatacggggaacagtaacgttcaccgttacnccgaacgtacgtcgaacgtcgtaacgtcgtaggacgtacgtagttaacgttacgtttacgaactttagtttaacgttacgtacgttacgagtacgtacggtacgtacgtacgttacggtccggtacggtaccgggttagtacgggtttcggacgacgggtaacaggtacgacggtagtaaccgaacgtaaacgtaccgtagtacgtacgtcgaccgtacgtacgtacgtacttccg

SEQ ID NO: 161513 - DNA, 749 bp, Homo sapiens
  misc_feature: GYAE6OF02JU58H.25.37.D04.1.454.CMB.1.raw
  modified_base (505)..(505): a, c, t, g, unknown or other
  misc_feature (505)..(505): n is a, c, g, or t
tcagactgtacagtcacgaccggtgctcgatttagtagcatactgttgggtttggggggagaggagcccagcactgggattccgaggtgttccattcggtgatcagcactgaacacagaggactcaccagtggtcgttttggctgagcgttgggttttccttggttgcttaggttttaaaaggtcgtaccgagtgtgaggtgcgagtcgtggacggtgtcgtggaggagccgtgacgtccgacggtcggtcgggggtcctaggacgtacctccgttccgtggtcgtacgacgtccgtcggtcggttacgacgttacgttagtccgacgtacgtccttacgtgactcggtacgggtcccgacgacgtaccgtacgtaaggggacggcgttggacgttcgtcgttactagttacgtttattacgtacgacgtaaactaaccgttaccgtaacttaccgtacgacgtactacgttacggtacggtaacggtcctacgtttacgttacncgttaccaaggtacctaaactcgtacccgaaagtaacccctattcgtaactacgttaacgattacccggaacccgttgtaagtcggaactccggtaacgtacggtccggtacttagttaacgccgttgggcgacgggaggtttactagtttacccggtggtttaacctttaacgtcccgtaacgttttaacccggttaccgttaccgggtagggccggtttaacgggtccccttaaccggttcg

SEQ ID NO: 161514 - DNA, 889 bp, Homo sapiens
  misc_feature: GYAE6OF02HFE46.25.37.D04.1.454.CMB.1.raw
  modified_base (208)..(208): a, c, t, g, unknown or other
  misc_feature (208)..(208): n is a, c, g, or t
tcagactgtacagtcacgaccggtgctcgatttagtagcatactgttgggtttgggggggagaggagcccagcactgggattccgaggtgtttccattcggtgatcagcactgaacacagacggactcaccatggtcggttttggctgagcgttgggttttccttgttgcttagttttaaaaggtgtaccgagtgtggaggttcgacngtcgtgggcggtagtcgtgggaggaggtccttgactccgacgtccggttccggggggtccctcggaagtcctccgttcctggtacgtctacgtccgttcgttcggtcacggttcgtacgtcacacggtacttaacttgacgttcggtacggggtccgacccggtaaggtcccgttaccgggaaggggggtaacggggtccgtttaagggggacggtttccggtacccggtttacggttaaccgttaagggtttttaacttacggttaacggaaccttaacgttaaaacccgtaacccttaacccggtttaacgtacccggtaaccgaacccgttacccgttaccggggaaacgggtacccggggttccttaaccgttttccctttaacgtccgttaccgggaacgtaaacgtaaccgtaacgttaaccgtaacggtaccctacctttacctccgttaactacgttaacgtacgacccgtacgtacggacggtccgaaccgggagtacccggtcgttaccggtcttaacgttccggttacggccggttagggacggtacggttacgttaacgggttacggttacggttttaacgttaaccggttttaaccttttaccgttaccgttttacccggtaaccgggttcggggttaaccccggttacgggttttccccgtaacggg

SEQ ID NO: 161515 - DNA, 809 bp, Homo sapiens
  misc_feature: GYAE6OF02HW1OU.25.37.D04.1.454.CMB.1.raw
  modified_base (284)..(284): a, c, t, g, unknown or other
  misc_feature (284)..(284): n is a, c, g, or t
tcagactgtacagtcacgaccggtgctcgatttagtagcatactgttgggtttggggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcgagtctggaggaggcctgatccagccgtgggggtccctgagacctctcctgtgcagcctcgtgggttcagtcgttagtcacngctacttgacttctcggggtcccgcgaacggtctcccgaagggggaacggggtcgcggtaggtggcgttacgtcgtagttattttaacgagtacgaactaaagttaaccccaccgttaaccacgtcgaacgaacttcccgtacggaaacgggacccgtacgtttacccttaacttacccgaccgtacgaaaaggtaacctaaaacgtttaccctaaagggaaaccctaacccccgttactaaaccttacgtttaaccgtaaacttaaacgaaccgtacccggttaccgaaggtaacggaaccccgggaacggtacggtaacccgggacccgttagggtttaacgttttaaccgtcggttcgggacggggacccgggggtaagggtaattaacccggttaaggttttaaccgggttttaaggttttaaccttaaccgttttaacccgtttaacccgtttttacccccggttttaacgtaggggggtaacccccggtttacccggggttttccccttaacccggggg

SEQ ID NO: 161516 - DNA, 906 bp, Homo sapiens
  misc_feature: GYAE6OF02G766P.25.37.D04.1.454.CMB.1.raw
tcagactgtacagtcacgaccggtgctcgatttagtagcatactgttgggtttgggggggagaggagcccagcactgggattccgaggtgtttccattcggtgatcagcactgaacacagaggactcaccatggtcgttttggctgagtcgttcgggttttccttgttggcttaggttttaaaaggtgtccagtgtggaggtgcagcgtgggcggtagtcgtagggagggaggtcctgactccgacggtccgggttcggggggtccctagggacgtaccttcctcctggtcgacacgtccgttcggttcggggtttaccaacggttcggttttaacggcctaacgtaacggtacctttaacgttttcggtacgttccgggttccgggggtacccccgtacccggtaacggtcccgttaaccggggaaagggggggaacgggggtccgtaggggggtacggttccgggaccgttcgttaccgttaaaggtttttaaacttttaacggtacggtacggtaaaattaaacccgttaacccgaaaccttaaaccgtaccggacgtaaacgtcccgttaaccggtcggaaacgggtcccttaacgttttacccgtaattcccgtaacgaacggtaaccgtaaccctaaacgttaacccgaaacgtaaaccctaccccgttaacttacgttaaccttaacgaaactaccggtaacccgtccgtagaacggtccgaaccggagtaccgacccgtgtaacgttcgttagtacgtcgggccggtaacggggtacttaggtaaccggttacgggtttaccgttaaacggtttcttaaaccgttttcccgtttaacccgttttaacccggtccggttaccggggggtaccccgttccggggtttacccgttacccgg

SEQ ID NO: 161517 - DNA, 695 bp, Homo sapiens
  misc_feature: GYAE6OF02G9HJM.25.37.D04.1.454.CMB.1.raw
  modified_base (153)..(153): a, c, t, g, unknown or other
  misc_feature (153)..(153): n is a, c, g, or t
  modified_base (160)..(160): a, c, t, g, unknown or other
  misc_feature (160)..(160): n is a, c, g, or t
  modified_base (182)..(182): a, c, t, g, unknown or other
  misc_feature (182)..(182): n is a, c, g, or t
  modified_base (206)..(206): a, c, t, g, unknown or other
  misc_feature (206)..(206): n is a, c, g, or t
  modified_base (246)..(246): a, c, t, g, unknown or other
  misc_feature (246)..(246): n is a, c, g, or t
  modified_base (286)..(286): a, c, t, g, unknown or other
  misc_feature (286)..(286): n is a, c, g, or t
  modified_base (432)..(432): a, c, t, g, unknown or other
  misc_feature (432)..(432): n is a, c, g, or t
  modified_base (453)..(453): a, c, t, g, unknown or other
  misc_feature (453)..(453): n is a, c, g, or t
  modified_base (662)..(662): a, c, t, g, unknown or other
  misc_feature (662)..(662): n is a, c, g, or t
tcagactgtacagtcacgaccggtgctcgatttagtagcatactgttgggtttggggggaggaactgctcagttaggacccagagggaaccatggaagccccagcctcagcttctcttcctcctgctactctggcctccagatagcaccgganaagttgngttagacacagtctccagaccnccctgtctttgctacgaggggaanacgcccaccctcgtcctgcgaggccagtcagtagtgttancgagttacttagccgtaggtaacccaacaacgtaacccgnggccctaggccctacccgagtcctccgtcatctatgacgtgaccagtaccgaaggccggtccagtcggacacctcccgagtccccgtagggttcagggtcggacgtaggggtcgggtaccggtagggaactcggggtactttaccnccgtaccttaaccacgttacnccgaagtaccgtacggttacgtacgggtaccgtacgttacggttaatttacggtttacgttacgtttaagttttacgttagtcgtactacgtacgtaggtacgtggtacggttcggttcgggttacccgggttacggtttacgttacggtttaccgggaccggttacgggacctacggtgtaggacgtactaacggaacgtaggtacgnggtacgtaccgataccgtcgttacgtcgttacc

SEQ ID NO: 161518 - DNA, 349 bp, Homo sapiens
  misc_feature: GYAE6OF01BZORI.23.4.A04.1.454.CMB.1.raw
  modified_base (342)..(349): a, c, t, g, unknown or other
  misc_feature (342)..(349): n is a, c, g, or t
tcagacgcgagtatcacgaccggtgctcgatttagagtagtgatcagggggtcaatcacctagattgctcatatactgggcgtctacgcgggaatccgggtccctgagcgattcattggcagcggatctgggacagatttcagtctcaccgtcagcagcctgcaggctgaggatggcggcgtatttattactgtcacctaattattttgaggtctccgttctacgtttcggccgaggggaccaagggtggagctcgaggcgaactggtggctgcaccatctgtcttcatccttcccgcatctgaactctcgcgtctgaggcgggtctggcaaggcgcaatgnnnnnnnn

SEQ ID NO: 161519 - DNA, 335 bp, Homo sapiens
  misc_feature: GYAE6OF01C91OE.23.4.A04.1.454.CMB.1.raw
  modified_base (331)..(335): a, c, t, g, unknown or other
  misc_feature (331)..(335): n is a, c, g, or t
tcagacgcgagtatcacgaccggtgctcgatttagagtagtgatcagggggtcaatcacctagattgctcatatactgggcgtctacgcgggaatccgggtccctgagcgattcattggcagcggatctgggacagatttcagtctcaccgtcagcagcctgcaggctgaggatgcggcgtatttattactgtcaccaatatttgaggctccgttcactttcggccaggggaccaaggtggagctcaggcgaactgtggctgcaccatctgtcttcatcttccccgcatctgaactactcgcgtctgacgcgggctggcaaggcgcatagnnnnn

SEQ ID NO: 161520 - DNA, 391 bp, Homo sapiens
  misc_feature: GYAE6OF01EF820.23.4.A04.1.454.CMB.1.raw
  modified_base (364)..(364): a, c, t, g, unknown or other
  misc_feature (364)..(364): n is a, c, g, or t
  modified_base (370)..(391): a, c, t, g, unknown or other
  misc_feature (370)..(391): n is a, c, g, or t
tcagacgcgagtatcacgaccggtgctcgatttagagtagtgatcagggggtcaatcacctagattgctcatatactgggcgtctacgcgggaatccgggtccctgagcgattcattggcagcggatcgtgggacagatttcagtctcaccgtcagcagcctgcaggctgaggatggcggcgtattttattactgtcacctaattagttttgagtctccgttctacgtttcggccgaagggaccaagggtggacgctcgaggacgtaactggtcggctgcacctatctgttcctctacttccttcccgcctatctacgaacttcgcgtcgtctggacggtcgggactgggacgtaaggccgtanagtagnnnnnnnnnnnnnnnnnnnnnn

SEQ ID NO: 161521 - DNA, 341 bp, Homo sapiens
  misc_feature: GYAE6OF01BBNHK.23.4.A04.1.454.CMB.1.raw
  modified_base (332)..(341): a, c, t, g, unknown or other
  misc_feature (332)..(341): n is a, c, g, or t
tcagacgcgagtatcacgaccggtgctcgatttagagtagtgatcagggggtcaatcacctagattgctcatatactgggcgtctacgcgggaatccgggtccctgagcgattcattggcagcggatctgggacagatttcagtctcaccgtcagcagcctgcaggctgaggatgcggcgatttattactgtcaccaatattttgaggctccgttcactttcggccaggggaccaaggtggagctcgaggcgaactgtggctgcaccatctgtcttcatccttcccgcatctgaatactcgtctctgacgcgggctggcaaggcgcagtagnnnnnnnnnn

SEQ ID NO: 161522 - DNA, 350 bp, Homo sapiens
  misc_feature: GYAE6OF02JXE2Z.23.4.A04.1.454.CMB.1.raw
  modified_base (321)..(321): a, c, t, g, unknown or other
  misc_feature (321)..(321): n is a, c, g, or t
  modified_base (328)..(350): a, c, t, g, unknown or other
  misc_feature (328)..(350): n is a, c, g, or t
tcagacgcgagtatcacgaccggtgctcgatttagagtagtgatcagggggtcaatcacctagattgctcatatactggcgtctacgcgggaatccggggtcctgagcgattcattggcagcggatctgggacagatttcagtctcaccgttcagcagccttgcaggctgaggatgcggcgatttattactgtcaccaatattttgaggctccgttcactttcggccaggggaccaaggtggagctcaggcgaactgtggctgcaccatctgtcttcatcttcccgcatctgaatctcgcgtctgagcggctggcaaggcncatagannnnnnnnnnnnnnnnnnnnnnn

SEQ ID NO: 161523 - DNA, 333 bp, Homo sapiens
  misc_feature: GYAE6OF02II2ZB.23.4.A04.1.454.CMB.1.raw
  modified_base (321)..(321): a, c, t, g, unknown or other
  misc_feature (321)..(321): n is a, c, g, or t
  modified_base (326)..(333): a, c, t, g, unknown or other
  misc_feature (326)..(333): n is a, c, g, or t
tcagacgcgagtatcacgaccggtgctcgatttagagtagtgatcagggggtcaatcacctagattgctcatatactgggcgtctacgcgggaatccggggtccctgagcgattcattggcagcggatctgggacagatttcagtctcaccgtcagcagcctgcaggctgaggatgcggcgatttattactgtcaccaatatttgaggctccgttcactttcggccaggggaccaaggtggagctcaggcgaactgtggctgcaccatctgtcttcatcttcccgccatctgaatactcgcgtctgagcggctggcaggcnatagnnnnnnnn

SEQ ID NO: 161524 - DNA, 336 bp, Homo sapiens
  misc_feature: GYAE6OF02JBZV5.23.4.A04.1.454.CMB.1.raw
  modified_base (320)..(320): a, c, t, g, unknown or other
  misc_feature (320)..(320): n is a, c, g, or t
  modified_base (326)..(336): a, c, t, g, unknown or other
  misc_feature (326)..(336): n is a, c, g, or t
tcagacgcgagtatcacgaccggtgctcgatttagagtagtgatcaggggtcaatcacctagattgctcatatactgggcgtctacgcgggaatccgggtccctgagcgattcattggcagcggatctgggacagatttcagtctcaccgtcagcagcctgcaggctgaggatgcggcgatttattactgtcaccaatattttgaggctccgttcactttcggccaggggaccaaggtggagctcaggcgaactgtggctgcaccatctgtcttcatcttcccgcatctgaatctcgcgtctgagcgggctggcaaggcncatagnnnnnnnnnnn

SEQ ID NO: 161525 - DNA, 380 bp, Homo sapiens
  misc_feature: GYAE6OF02F7GWH.23.4.A04.1.454.CMB.1.raw
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (347)..(347): a, c, t, g, unknown or other
  misc_feature (347)..(347): n is a, c, g, or t
  modified_base (349)..(380): a, c, t, g, unknown or other
  misc_feature (349)..(380): n is a, c, g, or t
tcagacgcgagtatcacgaccggtgctcgatttagagtagtgatcagggggtcaatcacctagattgctcatatactgggcgtctacgcgggaatccggggtccctgagcgattcattggcagcggatctgggacagattttagtctcaccgtcagcagcctgcaggctgaggatgcggcgatttattactgtccaccaatattttgaggcttccgttcactttcggccgaggggaccaaggtggacgctacgaggcgaactgtggctgccaccatctgtcttcnctcttcccnctctctgaactactccgcgtctggagccgggcgtggacgaagcggcactagcngnnnnnnnnnnnnnnnnnnnnnnnnnnnnnnnn

SEQ ID NO: 161526 - DNA, 294 bp, Homo sapiens
  misc_feature: GYAE6OF01ELB3N.25.9.A09.1.454.CMB.1.raw
  modified_base (274)..(274): a, c, t, g, unknown or other
  misc_feature (274)..(274): n is a, c, g, or t
  modified_base (281)..(294): a, c, t, g, unknown or other
  misc_feature (281)..(294): n is a, c, g, or t
tcagactgtacagtcacgaccggtgctcgatttagcgagacgcgcaggggggcgtttgacgtatttttggggtggttattatacccccttaattcctctctttgacctctggggccagggaaccctggtcaccgtctcctcagccctccaccaagggcccatcggtccttccccctggccgccctgctccaggagccacctcgagagcacagccggcctgggctgcctggtcaaggctactccatgtacagtctgagcgggctggacaaggtcncagtagnnnnnnnnnnnnnn

SEQ ID NO: 161527 - DNA, 301 bp, Homo sapiens
  misc_feature: GYAE6OF01B2NRJ.25.9.A09.1.454.CMB.1.raw
  modified_base (281)..(282): a, c, t, g, unknown or other
  misc_feature (281)..(282): n is a, c, g, or t
  modified_base (284)..(284): a, c, t, g, unknown or other
  misc_feature (284)..(284): n is a, c, g, or t
  modified_base (286)..(301): a, c, t, g, unknown or other
  misc_feature (286)..(301): n is a, c, g, or t
tcagactgtacagtcacgaccggtgctcgatttagcgagacgcgcaggggggcgtttgacgatttttggggtggttattatacccccttaattcctctctttgacctctggggccagggaaccctggtcaccgtctcctcagcctccaccgaagggcccatcggtccttccccctggccgccctgctccaggagcacctccgagagcacagcggccctgggctgcctggcaaggactacttccactgtacagtctgacgcgggctggacaaggcgcatagnngntnnnnnnnnnnnnnnnn

SEQ ID NO: 161528 - DNA, 284 bp, Homo sapiens
  misc_feature: GYAE6OF02FRRXN.25.9.A09.1.454.CMB.1.raw
  modified_base (275)..(284): a, c, t, g, unknown or other
  misc_feature (275)..(284): n is a, c, g, or t
tcagactgtacagtcacgaccggtgctcgatttagcgagacgcgcagggggcgtttgacgattttggggtggttattatacccccttaattcctctctttgacctctggggccagggaaccctggtcaccgtctcctcagcctccaccaagggcccatcggtcttccccctggcgccctgctccaggagcacctccgagagcacagcggccctgggctgccctggtcaaggactacttccactgtacagtctgagcggctggcaaggcgcatagnnnnnnnnnn

SEQ ID NO: 161529 - DNA, 384 bp, Homo sapiens
  misc_feature: GYAE6OF02GB5QB.25.9.A09.1.454.CMB.1.raw
  modified_base (369)..(369): a, c, t, g, unknown or other
  misc_feature (369)..(369): n is a, c, g, or t
  modified_base (375)..(384): a, c, t, g, unknown or other
  misc_feature (375)..(384): n is a, c, g, or t
tcagactgtacagtcacgaccggtgctcgatttagcgagacgcgcagggccagtcagagtattaccaactacttagcctggtaccaacagaaacctggccaggctcccaggctcctcatctatgatgcagccaacagggccactggcatcccagccaggttcagtggcagtgggtctgggacagacttcactctcaccatcaccagcctagagcctgaggattctgcagtttactactgtcagcagcgtagccactggcctcagacgttcggccaagggaccaaggtggagatcaaacgaactgtggctgcaccatctgtcttcatcttccgctatctgaactgtacagtctgagcggctggcaaggcncatagnnnnnnnnnn

SEQ ID NO: 161530 - DNA, 617 bp, Homo sapiens
  misc_feature: GYAE6OF02HQRUA.25.9.A09.1.454.CMB.1.raw
  modified_base (226)..(226): a, c, t, g, unknown or other
  misc_feature (226)..(226): n is a, c, g, or t
  modified_base (545)..(545): a, c, t, g, unknown or other
  misc_feature (545)..(545): n is a, c, g, or t
  modified_base (577)..(578): a, c, t, g, unknown or other
  misc_feature (577)..(578): n is a, c, g, or t
  modified_base (580)..(580): a, c, t, g, unknown or other
  misc_feature (580)..(580): n is a, c, g, or t
  modified_base (583)..(583): a, c, t, g, unknown or other
  misc_feature (583)..(583): n is a, c, g, or t
  modified_base (587)..(587): a, c, t, g, unknown or other
  misc_feature (587)..(587): n is a, c, g, or t
  modified_base (590)..(592): a, c, t, g, unknown or other
  misc_feature (590)..(592): n is a, c, g, or t
  modified_base (594)..(595): a, c, t, g, unknown or other
  misc_feature (594)..(595): n is a, c, g, or t
  modified_base (597)..(600): a, c, t, g, unknown or other
  misc_feature (597)..(600): n is a, c, g, or t
  modified_base (602)..(608): a, c, t, g, unknown or other
  misc_feature (602)..(608): n is a, c, g, or t
  modified_base (611)..(612): a, c, t, g, unknown or other
  misc_feature (611)..(612): n is a, c, g, or t
  modified_base (614)..(617): a, c, t, g, unknown or other
  misc_feature (614)..(617): n is a, c, g, or t
tcagactgtacagtcacgaccggtgctcgatttagcgagacgcgcagggccagtcagagtattaccaactacttagcctggtaccaacagaaacctggccaggctcccaggctcctcatctatgatgcagccaacagggccactggcatcccagccaggttcagtggcagtgggtctgggacagacttcactctcaccatcaccagcctagagcctgaggtattcngctagtttacactgtcagcagcgtagccactcggcctacgaggtaccggtttcggacccgaaaaggggaccctaaaggggtcgggaagtactaaccgaaaaccggtaacgtggttcgggacctggacctaacctaagttccttacggttcctttacctaacgtttccccgtttacccccggaccttaacgtttacccgttaacgtaaaaccgtttcggttaaacccgtacggtttaccggtagggaaccggggtcccggggggtacctttacgggggaacccggtaaacggggtcccgtaacgtaaacgtttaacgggnacgtacgtgtacgcgtcgtcgtacgacgctcnngngangcgnacnnncnncnnnngnnnnnnncgnngnnnn

SEQ ID NO: 161531 - DNA, 541 bp, Homo sapiens
  misc_feature: GYAE6OF02JBFT0.25.9.A09.1.454.CMB.1.raw
  modified_base (231)..(231): a, c, t, g, unknown or other
  misc_feature (231)..(231): n is a, c, g, or t
  modified_base (507)..(507): a, c, t, g, unknown or other
  misc_feature (507)..(507): n is a, c, g, or t
  modified_base (511)..(541): a, c, t, g, unknown or other
  misc_feature (511)..(541): n is a, c, g, or t
tcagactgtacagtcacgaccggtgctcgatttagcgagacgcgcagggccagtcagagtattaccaactacttagcctggtaccaacagaaacctggccaggctcccaggctcctcatctatgatgcagccaacgagggccactggcactcccagccaggttcagtggcaggtgggtctgggacagacttcactctcaccatccaccagcctagagcctgaggtattcgngactagttttaccactgtcagcagcgtaacgccctacgtggccctcgaagtaccggttccgggaccgaaacggggacccgaaggggtggaacgatacgaaaaaccgtacgtgggtacgggaccttacggacccaaccttattcccgttacggttcctttaactacccgtttccccttttacccccgacctacgtttctaacgtaaccgttacgtaacgtacggttcggtaggcggggtcgggtaccgtgggaaccgtaacgggccgacaagtaggnagtnnnnnnnnnnnnnnnnnnnnnnnnnnnnnnn

SEQ ID NO: 161532 - DNA, 214 bp, Homo sapiens
  misc_feature: GYAE6OF01EMNBF.48.25.C03.1.454.CMB.1.raw
  modified_base (214)..(214): a, c, t, g, unknown or other
  misc_feature (214)..(214): n is a, c, g, or t
tcagagtatacatacacgaccggtgctcgatttagtagtgtagatttgggtttggggatcaggactcctcagttcaccttctcacaatgaggctccctgctcagctcctggggctgctaatgctctgggtcccaggaactgtggctgcaccatctgtcttcatcttcccgccatctgatatgtatactctgagcgggctggcaaggcgcatagn

SEQ ID NO: 161533 - DNA, 215 bp, Homo sapiens
  misc_feature: GYAE6OF01BGG32.48.25.C03.1.454.CMB.1.raw
  modified_base (214)..(215): a, c, t, g, unknown or other
  misc_feature (214)..(215): n is a, c, g, or t
tcagagtatacatacacgaccggtgctcgatttagtagtgtagatttgggtttggggatcaggactcctcagttcaccttctcacaatgaggctccctgctcagctcctggggctgctaatgctctgggtcccaggaactgtggctgcaccatctgtcttcatcttcccgccatctgatatgtatactctgagcgggctggcaaggcgcatagnn

SEQ ID NO: 161534 - DNA, 216 bp, Homo sapiens
  misc_feature: GYAE6OF01BQOAQ.48.25.C03.1.454.CMB.1.raw
  modified_base (215)..(216): a, c, t, g, unknown or other
  misc_feature (215)..(216): n is a, c, g, or t
tcagagtatacatacacgaccggtgctcgatttagtagtgtagatttgggtttgggggatcaggactcctcagttcaccttctcacaatgaggctccctgctcagctcctggggctgctaatgctctgggtcccaggaactgtggctgcaccatctgtcttcatcttcccgccatctgatatgtatactctgagcgggctggcaaggcgcatagnn

SEQ ID NO: 161535 - DNA, 216 bp, Homo sapiens
  misc_feature: GYAE6OF01CJN43.48.25.C03.1.454.CMB.1.raw
  modified_base (214)..(216): a, c, t, g, unknown or other
  misc_feature (214)..(216): n is a, c, g, or t
tcagagtatacatacacgaccggtgctcgatttagtagtgtagatttgggtttggggatcaggactcctcagttcaccttctcacaatgaggctccctgctcagctcctggggctgctaatgctctgggtcccaggaactgtggctgcaccatctgtcttcatcttcccgccatctgatatgtatactctgagcgggctggcaaggcgcatagnnn

SEQ ID NO: 161536 - DNA, 216 bp, Homo sapiens; identical to SEQ ID NO: 161535
  misc_feature: GYAE6OF01CSC5A.48.25.C03.1.454.CMB.1.raw
  modified_base (214)..(216): a, c, t, g, unknown or other
  misc_feature (214)..(216): n is a, c, g, or t

SEQ ID NO: 161537 - DNA, 497 bp, Homo sapiens
  misc_feature: GYAE6OF01A4GN5.48.25.C03.1.454.CMB.1.raw
  modified_base (493)..(493): a, c, t, g, unknown or other
  misc_feature (493)..(493): n is a, c, g, or t
tcagagtatacatacacgaccggtgctcgatttagtagtgtagatttgggtttgggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcacatcagcagcctgcagtctgaagtattttacattttatactgtcagcagtatcgtaagtgactccgacgtttgccaagggccaaggtgaagtcaaacgactgtgctgcacatctgtcttcatcttcccgcatctgatatgtactctntagg

SEQ ID NO: 161538 - DNA, 216 bp, Homo sapiens; identical to SEQ ID NO: 161534
  misc_feature: GYAE6OF01A557Q.48.25.C03.1.454.CMB.1.raw
  modified_base (215)..(216): a, c, t, g, unknown or other
  misc_feature (215)..(216): n is a, c, g, or t

SEQ ID NO: 161539 - DNA, 511 bp, Homo sapiens
  misc_feature: GYAE6OF01EWOQO.48.25.C03.1.454.CMB.1.raw
  modified_base (477)..(477): a, c, t, g, unknown or other
  misc_feature (477)..(477): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagcctcccaggctcctcatttatgatacatccaccagggccactggtcgtcccagccaggttcactggcggtggtctgggacagagttcactctcaccatcagcagcctgcagtctgaagtattttacattttattactgtcagcagtatcgtaagtggactcgacgtttggccgaaggaccaagggtgaagtacgaaacgtacgtgtggctgcaccatctgtcttnacttctcccgcatctgtacttatgtatctgtacg

SEQ ID NO: 161540 - DNA, 501 bp, Homo sapiens
  misc_feature: GYAE6OF01ENSJP.48.25.C03.1.454.CMB.1.raw
  modified_base (181)..(181): a, c, t, g, unknown or other
  misc_feature (181)..(181): n is a, c, g, or t
  modified_base (499)..(499): a, c, t, g, unknown or other
  misc_feature (499)..(499): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccagggggaaanagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagtattttacattttattactgtcagcagtatcgtaagtgactcgacgtttgccaaggaccaggtgaagtacaaacgatgtgctgcacatctgtcttcacttcttcccgcatctgtattatgtatactntg

SEQ ID NO: 161541 - DNA, 514 bp, Homo sapiens
  misc_feature: GYAE6OF01ADXEB.48.25.C03.1.454.CMB.1.raw
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
  modified_base (479)..(479): a, c, t, g, unknown or other
  misc_feature (479)..(479): n is a, c, g, or t
  modified_base (487)..(487): a, c, t, g, unknown or other
  misc_feature (487)..(487): n is a, c, g, or t
  modified_base (511)..(511): a, c, t, g, unknown or other
  misc_feature (511)..(511): n is a, c, g, or t
tcagagtatacatacacgaccggtgctcgatttagtagtgtagatttgggtttgggggaggactgctcagttaggacccagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaaggcctggccagcctcccaggctcctcatttangatacatccaccagggccactggtctcccagccaggttcactggcggtgggtctggggacaggagttcactctcaccatcagcagcctgcagtctgaagtattttacattttatactgtcagctagtatcgtaagtgactcgtacgttcggaccgaagggaccagggtgagtcaaacgtatgngctgcacntctgtcttcacttccttcccgctntcg

SEQ ID NO: 161542 - DNA, 496 bp, Homo sapiens
  misc_feature: GYAE6OF01CR6Z0.48.25.C03.1.454.CMB.1.raw
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (460)..(460): a, c, t, g, unknown or other
  misc_feature (460)..(460): n is a, c, g, or t
  modified_base (493)..(493): a, c, t, g, unknown or other
  misc_feature (493)..(493): n is a, c, g, or t
tcagagtatacatacacgaccggtgctcgatttagtagtgtagatttgggtttgggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcgtggtctgggacagagttcactctcaccatcagcagctgcagtcngaagnttttacattttatactgtcagcagtatcgtaagtgactcgacgtttgccaagggacaaggtgaagtcaaacgaactgtaggctgcaccatcngtcttcgatcttcccgcatctgatatgtatctntgg

SEQ ID NO: 161543 - DNA, 235 bp, Homo sapiens
  misc_feature: GYAE6OF01DYDB9.48.25.C03.1.454.CMB.1.raw
  modified_base (217)..(235): a, c, t, g, unknown or other
  misc_feature (217)..(235): n is a, c, g, or t
tcagagtatacatacacgaccggtgctcgatttagtagtgtagatttgggtttgggggagtcaggactcctcagttcaccttctcacaatgaggctccctgctcagctcctggggctgctaatgctctgggtcccaggaactgtggctgcaccatctgtcttcagtcttcccgcatctgagtatgtatactctgagcgggctggcaaggcgcatagnnnnnnnnnnnnnnnnnnn

SEQ ID NO: 161544 - DNA, 552 bp, Homo sapiens
  misc_feature: GYAE6OF01D1FFY.48.25.C03.1.454.CMB.1.raw
  modified_base (273)..(273): a, c, t, g, unknown or other
  misc_feature (273)..(273): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctccaggctcctcatttangatacatccacagggccactggtcgtcccagccaggttcacgtgggcggtggtctgggacagagttcactctcacatcagcagcctgcagtctagaagatgtggctaggttttatactgtacagtctagtttggttttggcggtttctccggtacgtttcgggacgggtagggaccgtaagggtggaacgggttaccgaaaacggtacgttggtggctaggcctacctattccgtgttcttccagttccttcccgcctatcctgattatcgttatctcg

SEQ ID NO: 161545 - DNA, 248 bp, Homo sapiens
  misc_feature: GYAE6OF01CHX4U.48.25.C03.1.454.CMB.1.raw
  modified_base (223)..(224): a, c, t, g, unknown or other
  misc_feature (223)..(224): n is a, c, g, or t
  modified_base (226)..(248): a, c, t, g, unknown or other
  misc_feature (226)..(248): n is a, c, g, or t
tcagagtatacatacacgaccggtgctcgatttagtagtgtagatttgggtttgggggagtcaggactcctcagttcaccttctcacaatgaggctccctgctcagctcctggggctgctaatgctctgggtcccaggaactgtggctgcaccatcttgttcttcattcttcccgccatctgatatgtatactctgaggcgggctgggcgaagggcgcatagnngnnnnnnnnnnnnnnnnnnnnnnn

SEQ ID NO: 161546 - DNA, 214 bp, Homo sapiens; identical to SEQ ID NO: 161532
  misc_feature: GYAE6OF01ELQMU.48.25.C03.1.454.CMB.1.raw
  modified_base (214)..(214): a, c, t, g, unknown or other
  misc_feature (214)..(214): n is a, c, g, or t

SEQ ID NO: 161547 - DNA, 511 bp, Homo sapiens
  misc_feature: GYAE6OF01DHU0P.48.25.C03.1.454.CMB.1.raw
  modified_base (203)..(203): a, c, t, g, unknown or other
  misc_feature (203)..(203): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtctgacagctcctagcctggtacaacaaggcctggcagcctccaggctcctcatttatgatacatccaccagggccactggtcgtcccagccaggttcactggcggtggtctggggacagagttcactctcacatcagcagcctgcagtctgaagattttacattttatactgtcagtcagtatcgtaagtggactcgacgtttggccgtaagggaccaaggtggaagtacaaaacgtatgtagctggacacatctgtcttcacttcttccgctatcg

SEQ ID NO: 161548 - DNA, 552 bp, Homo sapiens
  misc_feature: GYAE6OF01C6X6A.48.25.C03.1.454.CMB.1.raw
  modified_base (179)..(179): a, c, t, g, unknown or other
  misc_feature (179)..(179): n is a, c, g, or t
  modified_base (273)..(273): a, c, t, g, unknown or other
  misc_feature (273)..(273): n is a, c, g, or t
  modified_base (531)..(531): a, c, t, g, unknown or other
  misc_feature (531)..(531): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtcccagccaccctgtctgtgtctccaggggaaanagtcaccctctcctgcagggccagtgagagtcttgacagctccttagcctggtaccaacaaaggcctggccagcctccaggcctcctcatttangatacatccaccgagggccacgtggtctcccagcctaggttcacgtggcggtggtctgggacaggtacgttcactctcgacatcagcagcctgcagtctagaagttattttactattttatacttgtcagtcagttatcgtaagtcggtacttcgtacgtttggaccaagggtacctaagggtacggaaagtacgaaacgtaactggtacggctaggcaaccgtatcgtcgttcttcgacttccttcccgcctatctnacttatagtactcgtcgtagg

SEQ ID NO: 161549 - DNA, 512 bp, Homo sapiens
  misc_feature: GYAE6OF01BVG95.48.25.C03.1.454.CMB.1.raw
  modified_base (204)..(204): a, c, t, g, unknown or other
  misc_feature (204)..(204): n is a, c, g, or t
  modified_base (489)..(489): a, c, t, g, unknown or other
  misc_feature (489)..(489): n is a, c, g, or t
  modified_base (510)..(510): a, c, t, g, unknown or other
  misc_feature (510)..(510): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccagggggaaangtcaccctctcctgcagggccagtgagagtcttgacagctccttagcctggtaccaacaaaggcctggccagcctcccaggctcctcatttatgatacatccaccagggccactggtgtcccagccaggttcactggcggtggtctgggacagagttcactctcaccatcagcagcctgcagtctgaagtatttacattttatactgtcagcagtatcgtaagtgactcgacgtttggaccgtaagggaccaaggtggaacgtcaaacgactgtaggcgtgcacntctgtcttcatcttcccgctntc

SEQ ID NO: 161550 - DNA, 523 bp, Homo sapiens
  misc_feature: GYAE6OF01DOGSN.48.25.C03.1.454.CMB.1.raw
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctccaggctcctcatttatgatacatccacagggccactggtcgtcccagccaggttcactggcggtgggtctgggacagagttcactctcaccatcagcagcctgcagtctgaagtattttacattttattactgtcagctagtatcgtaagtgtactccgtagtttcggccaagggaccaagggtggaaagtcaaacgtacgtgtacggctgcacatctgtcttcgacttccttcccgccattctagtactattgttactctgtagg

SEQ ID NO: 161551 - DNA, 537 bp, Homo sapiens
  misc_feature: GYAE6OF01BZK7F.48.25.C03.1.454.CMB.1.raw
  modified_base (368)..(368): a, c, t, g, unknown or other
  misc_feature (368)..(368): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatctatggtgcgtccaccgagggccactggcatcccagacaggttcagtggcaggtgggtctgggacagacttcactctcaccatccaccagactggacncctgatgtattttgctagtttgttttctgtcagctagttatgggtaagttcgaccgtcggactacgttccgggaccgacggggaacctaagggtacggaaatcgaaacgtacgtgtggctgcacctatcgtgttcttcacttccttcccgctactctagtatgtgttac

SEQ ID NO: 161552 - DNA, 502 bp, Homo sapiens
  misc_feature: GYAE6OF01D263K.48.25.C03.1.454.CMB.1.raw
  modified_base (203)..(203): a, c, t, g, unknown or other
  misc_feature (203)..(203): n is a, c, g, or t
  modified_base (495)..(495): a, c, t, g, unknown or other
  misc_feature (495)..(495): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaaggcctggccagcctcccaggctcctcatttatgatacatccaccagggccactggtgtcccagccaggttcactggcggtggtctgggacagagttcactctcaccatcagcagcctgcagtctgaagtattttgcggtttatactgtcagcagcgtgccaactggcctctcacgttcggcggaggaccaggtgacagtacgaaacgacgtgtgctgcacatctgtctcntctcccg

SEQ ID NO: 161553 - DNA, 526 bp, Homo sapiens
  misc_feature: GYAE6OF01CW7UM.48.25.C03.1.454.CMB.1.raw
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (503)..(503): a, c, t, g, unknown or other
  misc_feature (503)..(503): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaagagtcaccctctcctgcagggccagtgagagtcttgacngctccttagcctggtaccaacaaggcctggccagcctcccaggcctcctcatttangatacactcccacagggccacgtggtcgtcccagccaggttcacgtggcggtggtctgggacagagttcactctcaccatcagcagcctgctagtctagaatattttacattttatactgtcagctagtatcgtaagtgactccggtagtttcggacctaagggaccaagggtcgaagtacgaaacgtactggtagctgaccacntctgtcttcattcctccgctgtc

SEQ ID NO: 161554 - DNA, 638 bp, Homo sapiens
  misc_feature: GYAE6OF01BBFG7.48.25.C03.1.454.CMB.1.raw
  modified_base (182)..(182): a, c, t, g, unknown or other
  misc_feature (182)..(182): n is a, c, g, or t
  modified_base (345)..(345): a, c, t, g, unknown or other
  misc_feature (345)..(345): n is a, c, g, or t
tcagagtatacatacacgaccggtgctcgatttagtagtgtagatttgggtttggggaggacggaaccatggaagccccagcgcagcttctcttcctcctgctactctggctcccagattccactggacaaatagtgatgacgcagtccccagccaccctgtctgtgtctccgaggggaaanagtccaccctctcctgcgagggccagtgagagtcttgacagctcttagcctggtaccaacaaggcctggccagcctccgaggcctcctctatttatgatacatccaccgagggccacgtggtcgtcccagcctaggttcacgtgggcggtggtctgggacagngttcactctcacatcagcagtcctgcagtctagaatattttactattttatactgtacagtctaagttactacggtaagtgggtaaccttcggtaacggtttggacccgtaaaggggacctaaagggggtacggtaaaacgtacgtaaaaccggtacgttagggtaggtacttacgaccgtaaccctattaccgttcggttaccttaccgtaacttttccccgtaccccccggtaccttaaagttccctttaggtaacttaacgtttacgttaacttaaccgttcggtacggg

SEQ ID NO: 161555 - DNA, 511 bp, Homo sapiens
  misc_feature: GYAE6OF01BXFMR.48.25.C03.1.454.CMB.1.raw
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagtattttacattttattactgtcagctagtatcgtaagtggactccgacgtttggccaagggaccaagggtggaagtcaaacgactgtggctgcacatctgtcttcacttcttcccgccatctgtatatgtactctctagg

SEQ ID NO: 161556 - DNA, 561 bp, Homo sapiens
  misc_feature: GYAE6OF01AKO93.48.25.C03.1.454.CMB.1.raw
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggacgcctgatgtatttgctagttgttttctgtctagtctagttatgggtaagttcaccgtcggactagttccgggaccgtaacggggaaccgtaagggtacggaaacgtaccgtaaacgaacgtaggtacggctgaccaccgtatcgtcgttcttactacttcccgttccccgcctacttctagtacttgtgttaac

SEQ ID NO: 161557 - DNA, 511 bp, Homo sapiens
  misc_feature: GYAE6OF01ALOJT.48.25.C03.1.454.CMB.1.raw
  modified_base (297)..(297): a, c, t, g, unknown or other
  misc_feature (297)..(297): n is a, c, g, or t
  modified_base (490)..(490): a, c, t, g, unknown or other
  misc_feature (490)..(490): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttangatacatccaccagggccactggtgtccccagccaggttcactggcggtgggtctggggacagagttcactctcaccatcagcagcctgcagtctgagtattttacattttattactgtcagcagtatcgtaagtggactccgacgtttggcctaagggaccaaggtggaagtcaaacgactgtggctgcacntctgtcttcatcctccncntc

SEQ ID NO: 161558 - DNA, 259 bp, Homo sapiens
  misc_feature: GYAE6OF01DLVVH.48.25.C03.1.454.CMB.1.raw
  modified_base (217)..(259): a, c, t, g, unknown or other
  misc_feature (217)..(259): n is a, c, g, or t
tcagagtatacatacacgaccggtgctcgatttagtagtgtagatttgggtttgggggagtcaggactcctcagttcaccttctcacaatgaggctccctgctcagctcctggggctgctaatgctctgggtcccaggactgtggctgcaccatctgtcttcatccttcccgcatctgatatgtattactctgagcgggctggctaaggcgcatagnnnnnnnnnnnnnnnnnnnnnnnnnnnnnnnnnnnnnnnnnnn

SEQ ID NO: 161559 - DNA, 229 bp, Homo sapiens
  misc_feature: GYAE6OF01BOMCL.48.25.C03.1.454.CMB.1.raw
  modified_base (215)..(229): a, c, t, g, unknown or other
  misc_feature (215)..(229): n is a, c, g, or t
tcagagtatacatacacgaccggtgctcgatttagtagtgtagatttgggtttgggggatcgaggactcctcagttcaccttctcacaatgaggctcctgctcagctcctggggctgctaatgctctgggtcccaggaactgtggctgcaccatctgtcttcatcttcccgccatctgatatgtatactctgagcgggctggcaaggcgcatagnnnnnnnnnnnnnnn

SEQ ID NO: 161560 - DNA, 216 bp, Homo sapiens; identical to SEQ ID NO: 161535
  misc_feature: GYAE6OF01BR0MS.48.25.C03.1.454.CMB.1.raw
  modified_base (214)..(216): a, c, t, g, unknown or other
  misc_feature (214)..(216): n is a, c, g, or t

SEQ ID NO: 161561 - DNA, 574 bp, Homo sapiens
  misc_feature: GYAE6OF01DFYND.48.25.C03.1.454.CMB.1.raw
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcacctctcctgcagggccagtgagagtcttgacagctccttagcctggtaccaacaaaggcctggccagccctccaggcctcctcatttatgatacatccacagggccatggtcgtccagccaggttcacgtgggcggtggtctgggacagagttcactctcaccatcagcagcctgcagtctagtaagtattttactatttttaattactgtcagctagttatacgtaagtggacttccgtacgttttggaccgaaaggggtaccaagggtggaaagtacgaaaacgtacgtgtcggctggccaaccgtatccgtagttccttacgtacttccctttaccccggccctagttccttagtaactttaagttgtttaacttacttcgtaggg

SEQ ID NO: 161562 - DNA, 538 bp, Homo sapiens
  misc_feature: GYAE6OF01DC2YM.48.25.C03.1.454.CMB.1.raw
  modified_base (206)..(206): a, c, t, g, unknown or other
  misc_feature (206)..(206): n is a, c, g, or t
  modified_base (375)..(375): a, c, t, g, unknown or other
  misc_feature (375)..(375): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccaccctgtctgtgtctccgagggggaaancgtcaccctctcctgcagggccagtgagagtctgacagctctagctggacaacaaaggcctggccagcctcccaggctcctcatttatgatacattccaccgagggcccagtggtgtcccagccaggttcacgtggccggtggtctggggacagtagtcactctcaccntcagcagcctgccagtctagaaagtattttaactattttattatgtcagctagtatcgtaagtcgactcgaacgtttggaccaagggtaccaagggtgaaagtccaaacgtactggtacggctcgccacagttctgtccttcacttcctttcccgctagttcg

SEQ ID NO: 161563 - DNA, 510 bp, Homo sapiens
  misc_feature: GYAE6OF01DS9WG.48.25.C03.1.454.CMB.1.raw
tcagagtatacatacacgaccggtgctcgatttagtagtgtagatttgggtttgggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctccaggctcctcatttatgatacatccaccagggccactggtgtcccagccaggttcacgtggcggtgggtctgggacagagttcactctcaccatcagcagcctgcagtctgaagtattttacattttatactgtcagcagtatacgtaagtgactcgacgtttggccgaagggaccaaggtggaagtacgaacgtactgtagctgcacatctgtcttcactccttcccgctatctgtactatgtactctgtagg

SEQ ID NO: 161564 - DNA, 586 bp, Homo sapiens
  misc_feature: GYAE6OF01AM4PE.48.25.C03.1.454.CMB.1.raw
  modified_base (202)..(202): a, c, t, g, unknown or other
  misc_feature (202)..(202): n is a, c, g, or t
  modified_base (294)..(294): a, c, t, g, unknown or other
  misc_feature (294)..(294): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaanagtcaccctctcctgcagggccagtgagagtcttgacagctccttagcctggtaccaacaaggcctggccagcctcccaggctcctcattangatacatcccaccagggccactggtcgtccccagcccaggttccacgtgggcggtggtctggggacagacgttcactctcaccatccagcagcctgcagtctgaagtacttttaacattttagtactgtcagtctagttactcggttaagtcggtacttccgggtacgtttgggaccctaaggggaccctaagggttacggaacgtaccgaaaacggtacttggtacgggcttcggacccaccgtacttccgtagttcccttacgtacttacccgttcccccggcttagtcc

SEQ ID NO: 161565 - DNA, 553 bp, Homo sapiens
  misc_feature: GYAE6OF01E3TSN.48.25.C03.1.454.CMB.1.raw
  modified_base (548)..(548): a, c, t, g, unknown or other
  misc_feature (548)..(548): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtcgtcccagccaggttcactgggcggtgggtctgggacaggagtttcactctcaccatcagcagcctgcagtctgaagtattttacattttatactgtcagcagtatcgtaagtggactccgtacgtttcggaccgtaagggaccaagggttggaacgtacgaaaaccgtacgtcgtagggcctggacacccgtatcccttaggttccttctacttcccttccccgcnttccg

SEQ ID NO: 161566 - DNA, 638 bp, Homo sapiens
  misc_feature: GYAE6OF01DTNE6.48.25.C03.1.454.CMB.1.raw
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaaccaacaaggcctggccagccctccaggctcctnatttangatacatccacaggccagtggtctcccagccaggttcacgtgggcggtggtctgggacagtagttcactctcacatcgagcagcctgcagtctagaagttattttacaatttttatacttgtacagtctaagttactacggtaagttcggtaccgttaccggttacggttttacgggaccgtaaggggtaaccctaaaggggttacgggtaaacgttaaccgaaaaaccggtacgttgggtacgggtaccgttacgggaccctaacccgtagtttacccgttacggtttaccctttaccgttaaccgtttccccgtttacccccggaccttacgttacccg

SEQ ID NO: 161567 - DNA, 525 bp, Homo sapiens
  misc_feature: GYAE6OF01CZ6D1.48.25.C03.1.454.CMB.1.raw
  modified_base (269)..(269): a, c, t, g, unknown or other
  misc_feature (269)..(269): n is a, c, g, or t
tcagagtatacatacacgaccggtgctcgatttagtagtgtagatttgggtttggggagacggaaccatggaagccccagccgcagcttctcttcctcctgctactctggctcccagattccactggacaaatagtgatgacgcagtccccagccaccctgtctgtgtctccgaggggaaagagtcaccctctcctgcagggccagtgagagtctgacagctccttagcctggtaccaacaaaggcctggccagcctcccaggctcctnatttatgatacatccaccagggccactggtcgtcccagccaggttcacgtgggcggtgggtctgggacaggacgttcactctcaccatcagcagcctgcagtctgaaatattttacattttatactgtcagctagtatcgtaagtggtactcgtacgtttgaccaagggactaagggtgaagtacaaacgtactgtacgctgacactatctgtcttcacttcttcccgctatctagtacttatagtactctgtcgg

SEQ ID NO: 161568 - DNA, 676 bp, Homo sapiens
  misc_feature: GYAE6OF01DUNWH.48.25.C03.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
tcagagtatacatacacgaccggtgctcgatttagtagtgtagatttggggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaangtccaccctctcctgcagggccagtgagagtcttgacagcctccttagcctaggtaaccaacgaaggcctggccagccctccaggcctcctcatttangatacactccaccgagggcctacgtggtcgtcccagtccgtaggttccacggtcgggccgggttgggtccgtaggggacaggtacgtttccacgttctaccgaacctattccgagccgacgtccctgacctaggttctaaggtaacgttaatttttaactaatttttacttacttgtactacgtactagttaacgtacgttaaggttcgtaccgtccggttacggtttacgggaccgtaacggggtaacccgtaagggttacggaaacgttaccgaaaacggtaccttaggtacggtcgtacggaccctaaccgtcgttaccgttagttacccgtttacgtaccctttcccttacccccggtactgtttaccg

SEQ ID NO: 161569 - DNA, 748 bp, Homo sapiens
  misc_feature: GYAE6OF01ETU0H.48.25.C03.1.454.CMB.1.raw
  modified_base (220)..(220): a, c, t, g, unknown or other
  misc_feature (220)..(220): n is a, c, g, or t
tcagagtatacatacacgaccggtgctcgatttagtagtgtagatttgggttgggggaggaactgctcagttaggacccagacggaaccatggaagcccccagcgcagcttctcttcctcctgctactctggctcccagattccactggacaaattgttgatgacgcagtcccagccctacctgttctgtcgtcgtaccgaggggaacacgtccaccctntcctggccagggccagtgagtagtctgactagtctccttagcctaggtaaccaaacaaggcctcggaccacgccctaccgagtcctcctactactttatgaatacactaccgaccgagggcccacgtcggtcgtccccagtccctaaggttccacggtcgggacggttgggtactggggacaggtacgtttcgaacttccgtactaacccgattccgaacggtacctaacggtcccgtagcccgtaaggttcctaaggtaaacgtttactttttaaccgaagtttttaacgttaccgttgttaacctaaggttacctaaggttacgttaccggttaagtcgggtaacctttacccgggtaaccggttttacgggaccccgtaaaggggttaccctaaggggttacgggtaaaccggttaccgaaaaacgggtaccggttgggtacgggaccgttacggacccaaacgttagttcccgttaggtacctttaccgaacgtttcccccgttacccgtacgtaccgtttcgg

SEQ ID NO: 161570 - DNA, 589 bp, Homo sapiens
  misc_feature: GYAE6OF01DV1W9.48.25.C03.1.454.CMB.1.raw
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtccaccctctcctgcagggccagtgagagtcttgacagctccttagcctggtaccaacaaggcctggccagccctcccaggcctcctcatttatgatacatcccaccgagggccacgtcggtctccccagccaggttcacgtggcggtggtctgggacagacgttcactctcaccatcagcagcctgctagtctagaagttattttactattttattactgtacagctagtatcgttaagtcggtactccggtacgtttcggaccgtaaacggggaccgtaagggtacggtaaacgtaccgaaaacggtacgttagggtaggaccgtcggacctacccgtagtccgttgttaccttctacgttcccttccccgcctagttaccg

SEQ ID NO: 161571 - DNA, 232 bp, Homo sapiens
  misc_feature: GYAE6OF01DZBHV.48.25.C03.1.454.CMB.1.raw
  modified_base (212)..(232): a, c, t, g, unknown or other
  misc_feature (212)..(232): n is a, c, g, or t
tcagagtatacatacacgaccggtgctcgatttagtagtgtagatttgggtttgggggagtcaggactcctcagttcaccttctcacaatgagctccctgctcagctcctgggctgctaatgctctgggtcccaggactgtggctgcacatctgtcttcatcttccgccatctgatatgtatactctgagcgggctggcaaggcgcgatagnnnnnnnnnnnnnnnnnnnnn

SEQ ID NO: 161572 - DNA, 550 bp, Homo sapiens
  misc_feature: GYAE6OF01AVHP7.48.25.C03.1.454.CMB.1.raw
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaangtccaccctctcctgcagggccagtgagagtctgacagctccttagcctggtaccaacaaggcctggccagcctcccaggctcctcatttangatacatcccaccagggccactggtctcccagccaggttcacgtggcggtggtctgggacagagttcactctcaccatcagcagcctgcagtctagaagtattttactattttattactgtcagtctagtatacgtaagtcggtacttccgtacgtttcggaccgtaagggaccgtaagggtaggaacgtacgaaacgtacgtggtacggcgtcgaccaccgtatcgtgttcttcacttcccttcccgcctgtcg

SEQ ID NO: 161573 - DNA, 594 bp, Homo sapiens
  misc_feature: GYAE6OF01CPTM3.48.25.C03.1.454.CMB.1.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaangtcaccctctcctgcagggccagtgagagtcttgacagctccttagcctggtaccaacaaaggcctggccagccctccaggctcctcatttangatacatccaccagggccactggtcgtcccagccaggttcacgtgggcggtggtctgggacagagttcacgtctcaccatcagcagcctgctagtctagaagtattttacgtattttactatgtactagcgtagtatacgtaaggtcgacgttccggtacgtttcggaccgtaaggggtaaccctaagggttcggaacgttaccgaaaacgtaaccgtgggtaggaccgtaggaccctaacctacgttccttacggttcctttccaacgtttcccgttccccggccttacgttaccg

SEQ ID NO: 161574 - DNA, 586 bp, Homo sapiens
  misc_feature: GYAE6OF01EC0QT.48.25.C03.1.454.CMB.1.raw
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaangtcaccctctcctgcagggccagtgagagtcttgacagctccttagcctggtaccaacaaaggcctggccagcctccaggctcctcatttangatacatccaccgagggccacgtggtcgtcccagcctaggttcacgtggcggtggtctggggacagagttcactctcaccatcagcagcctgcagtctagaagtattttactattttatacttgtacagtctagtatcgtaagtcggactccggtacgtttcggaccgtaagggaccgtaagggtcggaagtaccgaaaacgtacgtggtacggaccgttcggacctaaccgtacttccgttacggttacctttacctaacgtttccctttaccccggtcctaagttaccg

SEQ ID NO: 161575 - DNA, 525 bp, Homo sapiens
  misc_feature: GYAE6OF01DDBA4.48.25.C03.1.454.CMB.1.raw
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagcgccaccctctcctgtagggccagtcagaatgttaagagccactccttagcctggtaccagcaaaaacctggccagcctccaggctcctcatctatggtgccgtccaccagggccactggcatcccagacaggttcagtggcagtgggtctgggacagacttcactctcaccatcaccagactggatcctgatgattttgctagttgttttctgtcagcagtatggtattcacctcggactattcggccgaggggacctaagggtaggaaactacgaaacgtacgtgtaggctagccacatctgtcttcacttccttcccgacacttcttagattatgtataccg

SEQ ID NO: 161576 - DNA, 580 bp, Homo sapiens
  misc_feature: GYAE6OF01D2W6U.48.25.C03.1.454.CMB.1.raw
  modified_base (300)..(300): a, c, t, g, unknown or other
  misc_feature (300)..(300): n is a, c, g, or t
  modified_base (548)..(548): a, c, t, g, unknown or other
  misc_feature (548)..(548): n is a, c, g, or t
  modified_base (555)..(555): a, c, t, g, unknown or other
  misc_feature (555)..(555): n is a, c, g, or t
  modified_base (574)..(574): a, c, t, g, unknown or other
  misc_feature (574)..(574): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccaccctgtctgtgtctccgaggggaaagagtcaccctctcctgcagggccagtgagagtcttgacagctccttagcctggtaccaacaaaggcctggccagcctcccaggctcctctatttangatacatccaccgagggccactggtcgtcccagccaggttcacgtggcggtggtcgtgggacaggtagttcacgtctcaccatcagcagcctgcagtctagtaacgttattttactaatttttatacttgtacacgtctagttatcggttaagtggtaaccgtccggtacggtttcgggacccgtaaaggggtaccgaagggttacggaacgtacgaaaaccgtacgtggtacggctcggacaccgtntccgttntccttacacttcctcccgntattcg

SEQ ID NO: 161577 - DNA, 540 bp, Homo sapiens
  misc_feature: GYAE6OF01ECLXW.48.25.C03.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (419)..(419): a, c, t, g, unknown or other
  misc_feature (419)..(419): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaangtcaccctntcctgcagggccagtgagagtcttgacagctccttagcctggtaccaacaaggcctggccagcctcccaggctcctcatttatgatacatccaccagggccactggtctcccagccaggttcactggcggtggtctgggacagagttcactctcaccatcagcagcctgcagcctgaagatgtgactaactttattactgtacaacngtctttagtacgtaaccctccgtactacgttttcgggaccaggggtaccaaggtggagagtacgaaacgtaacgtggtacggctgcacctattcgtcgttcttacacttccttcccgtacc

SEQ ID NO: 161578 - DNA, 504 bp, Homo sapiens
  misc_feature: GYAE6OF01D4LGD.48.25.C03.1.454.CMB.1.raw
  modified_base (273)..(273): a, c, t, g, unknown or other
  misc_feature (273)..(273): n is a, c, g, or t
  modified_base (499)..(499): a, c, t, g, unknown or other
  misc_feature (499)..(499): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctccaggctcctcatttangatacatccaccaggccactggtgtcccagccaggttcacgtgggcggtgggtctgggacagagttcactctcaccatcagcagcctgcagtctagaagtattttacattttatactgtcagctagtatcgtaagtgactcgtacgtttcggacgaaggacaaggtgaagtacaaacgatgtgctgcacatctgtctcatccttcccgcatctagtatatatactntcgtg

SEQ ID NO: 161579 - DNA, 774 bp, Homo sapiens
  misc_feature: GYAE6OF01C1QYC.48.25.C03.1.454.CMB.1.raw
  modified_base (301)..(301): a, c, t, g, unknown or other
  misc_feature (301)..(301): n is a, c, g, or t
tcagagtatacatacacgaccggtgctcgatttagtagtgtagatttgggtttgggggagacgggaaccatgggaagccccagcgcaggcttctcttcctcctgctactctggctcccacgactttcccacctgggacaaatagtgtatgacgcagttccccagccaccctgtctgtcgtctccaggggaaagcgtccaccctctccgtgcacgggcagtgagagtccttgacacgccttccttagcctggtaaccaacaaacgggcctgggaccagccctccaggtcctcctcatttagngaatacactcccgaccgagggccctacgtggtcctcccagtcctaggttacaacgttgggcgggttcgggtactcggggaccagggtacggttccaccgttcgtaccgaaccctatttccgaacggtcctaacggtcccgttaggtcctaacgggtaccttaggtaaacgttaacttttttaccgaatttttttaacttaccgttacgttaccaacggtaccgtacgggttaacgttacggttaacggttcgggtaaccttcccgggttacggtttacgggacccgtaaaggggtaccctaaggggttacggtaaacggttacgaaaaccggttacgttagggtaccggtacgttacggtacctaaccggttacttcggtaacgtttccgttacctacgtttccccgtttaccccggtacccttacgttacctacggtaccttagtccgtttaaccgttccgttcggtaccgg

SEQ ID NO: 161580 - DNA, 636 bp, Homo sapiens
  misc_feature: GYAE6OF01C7TT4.48.25.C03.1.454.CMB.1.raw
  modified_base (274)..(274): a, c, t, g, unknown or other
  misc_feature (274)..(274): n is a, c, g, or t
  modified_base (627)..(627): a, c, t, g, unknown or other
  misc_feature (627)..(627): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaagagtcaccctctcctgcagggccagtgagagtcttgacagctccttagcctggtaccaacaaaggcctaggccagcctccaggctctcatttangatacatccacaggccacgtggtcgtcccagccaggttcacgtggcggtggtctgggacagcgttcactctcaccagtcagcagcctgactagtctagaacgttattttacgattttactactgttacagtactaagttacgtacgttaagcgtacttaccggtacgtttacggacctaaaggggacctaaagggtcggtaaacgtaacgaaaccgggtaacgttgggtaacggcttacggacctaacctagttccgtacgtttaccctacgtaacctttcccctttaaccccggtcccttaagttccccgtttaagtaaccgtttaacttaggtttaaactttaacccggtnttacggggg

SEQ ID NO: 161581 - DNA, 561 bp, Homo sapiens
  misc_feature: GYAE6OF01CTACN.48.25.C03.1.454.CMB.1.raw
  modified_base (500)..(500): a, c, t, g, unknown or other
  misc_feature (500)..(500): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagcctccaggcctcctcatttatgatacatccaccagggccactggtcgtcccagcctaggttcacgtggcggtgggtctgggacagagttcactctcaccatcagcagcctgctagtctagtaaagtatttttactaatttttacttactgttacagtactagtattacgtaagtggaccttccgtacgtttcggccaaagggacctaagggtgaaacgttacgaaacgtacgtggtggctggaccacnttcgtgttccttcgacttcccttcccgctagtcctagtattacgtgttaactcgtcgtagg

SEQ ID NO: 161582 - DNA, 536 bp, Homo sapiens
  misc_feature: GYAE6OF01EAD6K.48.25.C03.1.454.CMB.1.raw
  modified_base (368)..(368): a, c, t, g, unknown or other
  misc_feature (368)..(368): n is a, c, g, or t
  modified_base (506)..(506): a, c, t, g, unknown or other
  misc_feature (506)..(506): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtcgtcccagccaggttcactggcggtggtctgggacagagttcactcncaccatcagcagctgcagtctgaagtatttacattttatactgtcagtctagtatcgtaagtggtactccgtacgtttggaccgtaagggaccaaggtggaagtacaaaacggtactggtaggtcgtcggacaccgtntccgtgtccttcacttcctccccgctatcg

SEQ ID NO: 161583 - DNA, 610 bp, Homo sapiens
  misc_feature: GYAE6OF01EM667.48.25.C03.1.454.CMB.1.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (263)..(263): a, c, t, g, unknown or other
  misc_feature (263)..(263): n is a, c, g, or t
  modified_base (297)..(297): a, c, t, g, unknown or other
  misc_feature (297)..(297): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaaggggaaangtccaccctctcctgcagggccagtgagngtctgacngctccttagcctggtaccaanaaggcctggccagcctccaggcctcctcatttangatacatccaccgagggcccacgtggtcgtccccagcctaggttcacgtgggcggttgggtctggggaacaggtacttcactctcaccatcagcagccctgctagtcgtagtaagtattttacattttattactgtcagtctagtacttcgtaagtcggacttaccggtacgtttcgggaccgtaaggggtacctaaaggggtacggtaaacgttacgaaaacggtaacgtcgggtaggaccgtcggaccctaaccgtacttccgttcgttacctttacgtacctttacccgttacccccgtcgtacttaccg

SEQ ID NO: 161584 - DNA, 649 bp, Homo sapiens
  misc_feature: GYAE6OF01D89C7.48.25.C03.1.454.CMB.1.raw
  modified_base (273)..(273): a, c, t, g, unknown or other
  misc_feature (273)..(273): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagcctcccaggctcctcatttangatacatccaccagggccactggtcgtcccagcctaggttcacgtgggcggtgggtctgggacagagttcactctcacatcagcagcctgcagtctagaagtattttactattttattactgtcagtctagttatacggtaagtcgggtaccttccggtacgttttcgggaccgtaaggggaccgtaaagggtagggaaacgttaaccgaaaacggtaacgttggtacgggtaccttacgggacctaaccgtagttcccgttacggtttacccttttaccgtaaccgtttccccgtttaccccccggcccttaaaccgttccgttaacggtaactttacgtttaacggtttaactttaacccgttccgttaacggg

SEQ ID NO: 161585 - DNA, 859 bp, Homo sapiens
  misc_feature: GYAE6OF01CUHNG.48.25.C03.1.454.CMB.1.raw
  modified_base (204)..(204): a, c, t, g, unknown or other
  misc_feature (204)..(204): n is a, c, g, or t
tcagagtatacatacacgaccggtgctcgatttagtagtgtagatttgggtttgggggagggaacgtgctcagttaggacccagacggaaccatggaagcccagcgcagcttctcttcctcctgctactctggctccagattccactggacaaatagtgatgacgcagtccccagcccacctgtctgtgtctccgaaggggaanagtccaccctcgtccgtgcagggcctaggtcgaagtagtcttggactcgaccttaccttaagccgttaggtaaacctaaacgaaaacgggcccttagggacccaacggtccccttacccgaagggtcccttacccgttacgttaattttagtacgtaactttaaccgactaccccgaaccgaaccggggtcccaacggttcgggttcccggtaccccaaggtacccgtaacgggttttcccaaccggttggggtaccgggtttacggggttccgtaggggggtaaacctaacgggtacgttttacccgaaaccgttttcgtaacccgaaacctaaacgttcccgaaggtcccaacgggtccctaggtaacccgtaagttccgtaaggtaaacgtttaactttttaacgtaagtttttaacgtacgttacggtactaacgtacgttaaacgttagttaaccggttaaagttaccgggttaaccgtttaacccgttaagggtttacccggaacccggttaaaggggtaacccgttaagggtaccgggttaacgttaaccggaaaacggttacggtggacggttacgtacgtaccccgtactacgtttccgtagtaccgtttacccaacggtttacccccttccggaccttaggttcc

SEQ ID NO: 161586 - DNA, 216 bp, Homo sapiens
  misc_feature: GYAE6OF01EIBTQ.48.25.C03.1.454.CMB.1.raw
  modified_base (215)..(216): a, c, t, g, unknown or other
  misc_feature (215)..(216): n is a, c, g, or t
tcagagtatacatacacgaccggtgctcgatttagtagtgtagatttgggtttgggggatcaggactcctcagttcaccttctcacaatgaggctccctgctcagctcctggtgctgctaatgctctgtgtcccaggaactgtggctgcaccatctgtcttcatcttcccgccatctgatatgtatactctgagcgggctggcaaggcgcatagnn

SEQ ID NO: 161587 - DNA, 305 bp, Homo sapiens
  misc_feature: GYAE6OF01DKTBJ.48.25.C03.1.454.CMB.1.raw
  modified_base (240)..(305): a, c, t, g, unknown or other
  misc_feature (240)..(305): n is a, c, g, or t
tcagagtatacatacacgaccggtgctcgatttagtagtgtagatttgggtttgggggtagtcagggactccgtcagttccaccttctcgactaactgaggctccctgctcgagctccgtggggctgactaatgctctgggtcccaggaacgtgtgggctgcaccagttctgtcttcattacttcccgccatctgatatgtatctgtggaggcggggctggcgaacggcgcggactagannnnnnnnnnnnnnnnnnnnnnnnnnnnnnnnnnnnnnnnnnnnnnnnnnnnnnnnnnnnnnnnnn

SEQ ID NO: 161588 - DNA, 539 bp, Homo sapiens
  misc_feature: GYAE6OF01DQOX0.48.25.C03.1.454.CMB.1.raw
  modified_base (275)..(275): a, c, t, g, unknown or other
  misc_feature (275)..(275): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggcctcctcatttangatacatccacagggccactggtctcccagccaggttcacgtgggcggtgggtctgggacaggagttcactctcacatcagcagcctgcagtctagaagtattttactattttattactgtcagtctagtatacgtaagtcgtactccgtacgtttcgaccgtaagggacaagggtgaacgtacgaaacgtacgtggtgctagactacatcgtcgtcttctacttccttcccgctactctagtattatagttactctcgtacgg

SEQ ID NO: 161589 - DNA, 854 bp, Homo sapiens
  misc_feature: GYAE6OF01A2IYR.48.25.C03.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaangtcaccctctcccgngacggcgacgngtgagtcgttcgtacgacgcgtccttacgtacgtcgtaccgaaccaaacggaaccggtccgtaccgaccgaccgtcccctaccggacgtcccttcctactttaacttttagacgtaactaacctaccctaccccgaaccgggaccgggaccctaacgggttcggttaccccacccgaccgtaccggttacggttaccgtacgggtcggggtccggggttcggtacgggtacgggaacgaacggtttcgtaccgtaccgttcctaacccgaactacgtaccggacgtaccgaccgttccgcgtaccgtacggttcgtaaaggttaacgtttttaactttaacgttttaactttttaacttaccgttcgtaacgtacgtaacgttaagttaccgtttaaacgggttagggtacccgtttacccggttaacccgggttttaagggttcccggaaacggggttaaaccgggaacgggtttaaggggtaaaccgggtaaacgtaaaacccggtaaaaccggttcggttacggggtaccggttacgtaccgtaaccccgtaacttaccgttccgtttaaccggtttcccttaacgttcccttaccccccggttccccgtaattcgtttacg

SEQ ID NO: 161590 - DNA, 581 bp, Homo sapiens
  misc_feature: GYAE6OF01AHFT5.48.25.C03.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (297)..(297): a, c, t, g, unknown or other
  misc_feature (297)..(297): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacngctccttagcctggtaccaacaaggcctggccagcctcccaggcctcctcatttangatacatccaccgagggccagtggtcgtcccagcctaggttcacgtgggcggtggtctggggacaggtagttcacttctacacctatcagcagcctgctagtctagaagtacttttactattttatactgtacagctagtatcgtaagtcgtactcgtacgttcggaccgtaagggacctaagggtggaacgtaccgaaacggtacgttaggtacggacgttggaccctaccgtgttccgttagttacctttacaccgtttcccgttccccggtctagttaccg

SEQ ID NO: 161591 - DNA, 213 bp, Homo sapiens
  misc_feature: GYAE6OF01CCAOG.48.25.C03.1.454.CMB.1.raw
  modified_base (213)..(213): a, c, t, g, unknown or other
  misc_feature (213)..(213): n is a, c, g, or t
tcagagtatacatacacgaccggtgctcgatttagtagtgtagatttgggtttgggatcaggactcctcagttcaccttctcacaatgaggctccctgctcagctcctggggctgctaatgctctgggtcccaggaactgtggctgcaccatctgtcttcatcttcccgccatctgatatgtatactctgagcgggctggcaaggcgcatagn

SEQ ID NO: 161592 - DNA, 625 bp, Homo sapiens
  misc_feature: GYAE6OF01B4ES8.48.25.C03.1.454.CMB.1.raw
  modified_base (180)..(180): a, c, t, g, unknown or other
  misc_feature (180)..(180): n is a, c, g, or t
  modified_base (273)..(273): a, c, t, g, unknown or other
  misc_feature (273)..(273): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaaggcctggccagcctccaggctcctcatttangatacatccacacgggccacgtggtctcccagccaggttcacgtgggcggtgggtctgggacaggtagttcactctacacatcagcagcctgctagtctagaagtattttactattttattactgtactagtctaagttatacggttaaagtcggtaaccttccggtacgtttcggaccgtaagggtacctaaagggtcggaaacgttaccaaaacggtaacttgggtaggtaccttacggacctaaccgtaagttccgttacgttaccttaccgtaacgttccccgttaccccggccttaagttcccgttacgtaacttacgttacgttaacttaacccgttggtaacggg

SEQ ID NO: 161593 - DNA, 535 bp, Homo sapiens
  misc_feature: GYAE6OF01BGMDI.48.25.C03.1.454.CMB.1.raw
  modified_base (180)..(180): a, c, t, g, unknown or other
  misc_feature (180)..(180): n is a, c, g, or t
  modified_base (274)..(274): a, c, t, g, unknown or other
  misc_feature (274)..(274): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaangtcaccctctcctgcagggccagtgagagtcttgacagctccttagcctggtaccaacaaggcctggccagccctccaggcctcctctatttangatacatccacgaggccacgtggtcgtcccagccaggttcacgtgggcggtggtctgggacagagttcactctcacatcagcagcctgcagtctagaatatttactattttatactgtcagctagtatcgtaagtcgactcgtacgtttggacctaagggacaagggtaggaagtacaaacggtactggtcgctgacacctatctgtacctctacttccttcccgctaactcgtacgtacttactagtacttcgtgtacgg

SEQ ID NO: 161594 - DNA, 636 bp, Homo sapiens
  misc_feature: GYAE6OF01BCLBK.48.25.C03.1.454.CMB.1.raw
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaaccaacgaaacggcctaggccagccctcccgaggctcctctatttactgatacatccaccgagggccactggtcgtcccagcctaggttccacgtgggcgggtggtctggggacaggtacgttccacgtcctacaccatcagcacgcctgactagtctagtaagtatttttacatttttacttactgttcagtactagttactaggtaagtggtaccttccggtacggtttcgaccgaaaggggtacctaaagggtcggaaacgttaccgaaaacggtacgttagggtacggtcgttagacctaacccgatttaccgttcgttaccctttacgtacctttcccgttacccccggtctacgtttcttagtaacgttacttacgttacttaccgttcgtacggg

SEQ ID NO: 161595 - DNA, 525 bp, Homo sapiens
  misc_feature: GYAE6OF01DXERK.48.25.C03.1.454.CMB.1.raw
  modified_base (203)..(203): a, c, t, g, unknown or other
  misc_feature (203)..(203): n is a, c, g, or t
  modified_base (322)..(322): a, c, t, g, unknown or other
  misc_feature (322)..(322): n is a, c, g, or t
  modified_base (523)..(523): a, c, t, g, unknown or other
  misc_feature (523)..(523): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaaggcctggccagcctcccaggctcctcatttatgatacatccaccagggccactggtntcccagccaggttcactggcggtggtctgggacagagttcactctcacatcagcagcctgcagtctgaagtattttacattttatactgtcagtcagttatcgtaagtggactccgacgtttggacctaagggacctaagggttcggaagttccgaaaacgtactgtggctggacacatctgtcttcacttcttcccgctntc

SEQ ID NO: 161596 - DNA, 582 bp, Homo sapiens
  misc_feature: GYAE6OF01CJX02.48.25.C03.1.454.CMB.1.raw
  modified_base (180)..(180): a, c, t, g, unknown or other
  misc_feature (180)..(180): n is a, c, g, or t
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (561)..(561): a, c, t, g, unknown or other
  misc_feature (561)..(561): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccacctgtctgtgtctccgaggggaaanagtcaccctctcctgcagggccagtgagagtcttgacagctcttagcctggtaccaacaaggcctggccagccctccaggctcctcatttangatacntccacagggccatggtctcccagcccaggttcacgtgggcggtgggtctggggactaggtacgttcacgtctacaccatcagcacgctgctagtctagaattacttttactattttattacttgtacagtactaagttacgttacggtaagttcggtaaccgttccggtacgtttcgggaccgtaaacggggtacctaaagggtacggaaagtaaccgaaacggtaacgtggtaggtctcggacacctatctgtactcgtacttccttcccgctactcgttanacttagtattactctgtacgg

SEQ ID NO: 161597 - DNA, 506 bp, Homo sapiens
  misc_feature: GYAE6OF01COGQR.48.25.C03.1.454.CMB.1.raw
  modified_base (273)..(273): a, c, t, g, unknown or other
  misc_feature (273)..(273): n is a, c, g, or t
  modified_base (464)..(464): a, c, t, g, unknown or other
  misc_feature (464)..(464): n is a, c, g, or t
  modified_base (475)..(475): a, c, t, g, unknown or other
  misc_feature (475)..(475): n is a, c, g, or t
  modified_base (503)..(503): a, c, t, g, unknown or other
  misc_feature (503)..(503): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctccaggctcctcatttangatacatccaccagggccactggtgtcccagccaggttcacgtggcggtgggtctgggacagagttcactctcaccatcagcagcctgcagtctgaagtattttacattttattactgtcagctagtatcgtaagtgactcgacgtttggccaagggaccaagggtgaagtacaaacgactgtgctgcacntctgtcttacnttctcccgcatctagattatgtatcgtntgg

SEQ ID NO: 161598 - DNA, 526 bp, Homo sapiens
  misc_feature: GYAE6OF01C32ZW.48.25.C03.1.454.CMB.1.raw
  modified_base (273)..(273): a, c, t, g, unknown or other
  misc_feature (273)..(273): n is a, c, g, or t
  modified_base (460)..(460): a, c, t, g, unknown or other
  misc_feature (460)..(460): n is a, c, g, or t
  modified_base (520)..(520): a, c, t, g, unknown or other
  misc_feature (520)..(520): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagcctccaggcctcctcatttangatacatccacaggccactggtctcccagccaggttcacgtggcggtggtctgggacagtacgttcactctcaccatcagcagcctgcagtctagaagtattttacatttttactactgtcagctagtatcgtaagtggactcggtacgttggacaagggaccaagggtggaaatacaaacgatggngctgaccactatctgtccttcacttccttcccgctacttctagtacttatgtaactcgtntacggg

SEQ ID NO: 161599 - DNA, 563 bp, Homo sapiens
  misc_feature: GYAE6OF01BYP7F.48.25.C03.1.454.CMB.1.raw
  modified_base (262)..(262): a, c, t, g, unknown or other
  misc_feature (262)..(262): n is a, c, g, or t
  modified_base (297)..(297): a, c, t, g, unknown or other
  misc_feature (297)..(297): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtccaccctctcctgcagggccagtgagagtcttgacagctcttagcctggtaccaanaaaggcctggccagcctcccaggcctcctcattangatacatccaccagggccactggtcgtcccagcccaggttcactggcggtggtctgggacagagttcactctcaccatcgagcagcctgcagtctgaatatttacattttatactgtcagctagtatcgtaagtggactccgtacgtttcggccgtaaagggaccaagggtaggaacgttacgaaaacggtaacgtggtacggtcgtcggaccacctagttccttaggttccttactacttacccgtttcccccgtccgacttacg

SEQ ID NO: 161600 - DNA, 529 bp, Homo sapiens
  misc_feature: GYAE6OF01B8ZS4.48.25.C03.1.454.CMB.1.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
  modified_base (504)..(504): a, c, t, g, unknown or other
  misc_feature (504)..(504): n is a, c, g, or t
  modified_base (526)..(526): a, c, t, g, unknown or other
  misc_feature (526)..(526): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagngtcaccctctcctgcagggccagtgagagtcttgacagctccttagcctggtaccaacaaaggcctggccagcctcccaggctcctcatttangatacatcccacaggccactggtcgtcccagccaggttcacgtggcggtggtctgggacagagttcactctcaccatcagcagcctgcagtctagaagtattttacattttatactgtcagctagtatcgtaagtcgactccgtacgtttcgaaccgtaagggacctaagggtcggaagtacgaaacgtacgtgtggcgtcgacacntctgtcttcactcttcccgctntcg

SEQ ID NO: 161601 - DNA, 220 bp, Homo sapiens
  misc_feature: GYAE6OF01BR44F.48.25.C03.1.454.CMB.1.raw
  modified_base (214)..(220): a, c, t, g, unknown or other
  misc_feature (214)..(220): n is a, c, g, or t
tcagagtatacatacacgaccggtgctcgatttagtagtgtagatttgggtttgggggatcaggactcctcagttcaccttctcacaatgaggctccctgctcagctcctggggctgctaatgctctgggtcccaggaactgtggctgcaccatctgtcttcatcttcccgcatctgatatgtatactctgagcgggctggcaaggcgcatagnnnnnnn

SEQ ID NO: 161602 - DNA, 650 bp, Homo sapiens
  misc_feature: GYAE6OF01C9RU4.48.25.C03.1.454.CMB.1.raw
  modified_base (205)..(205): a, c, t, g, unknown or other
  misc_feature (205)..(205): n is a, c, g, or t
  modified_base (308)..(308): a, c, t, g, unknown or other
  misc_feature (308)..(308): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaagngtccaccctctcctgcagggccagtgagagtcttgacacgtcttccttagcctaggtaaccaaacaaggcctggccacgccctcccaggcctcctctatttangaatacactcccacgaggccacgtggtcgtcccagccgtaggttccacgtcgggcgggttggtcgtaggggacaggtacgttcaccgtctacaccatcacgcacgcctgcagttctagtaacttattttaactattttatactgtacagtactagttacgtacgttaagtcggaccttaccggttacggtttacgggaccgtaaaggggtacctaaggggtacgtaacgtaccgtaaaaccggtagttcgggttacgaccgttacggacccttaaccgtagtttcccgttacgttaccctttacgtaacccgtttccccgttaccccgtaccttcgttaacg

SEQ ID NO: 161603 - DNA, 519 bp, Homo sapiens
  misc_feature: GYAE6OF01BBJ4Z.48.25.C03.1.454.CMB.1.raw
  modified_base (274)..(274): a, c, t, g, unknown or other
  misc_feature (274)..(274): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttangatacatccaccagggccactggtcgtcccagccaggttcacgtggcggtgggtctgggacagagttcactctcacatcagcagcctgcagtctgaagtatttactattttattactgtcagctagtatacgtaagtggtactccgtacgtttcggacctaagggaccaagggtggaacgtacgaaacgtagtggtgctgcacatctgtcttcgacttctcccgcatctagtatatatatctgtg

SEQ ID NO: 161604 - DNA, 713 bp, Homo sapiens
  misc_feature: GYAE6OF01CFUO9.48.25.C03.1.454.CMB.1.raw
  modified_base (185)..(185): a, c, t, g, unknown or other
  misc_feature (185)..(185): n is a, c, g, or t
  modified_base (281)..(281): a, c, t, g, unknown or other
  misc_feature (281)..(281): n is a, c, g, or t
tcagagtatacatacacgaccggtgctcgatttagtagtgtagatttgggtttgggggagacggaaccatggaagccccagcgcgagcttctcttcctcctgctactctggctcccagattcccactggacaaatagtgatggacgcacgtccccagccaccctgtctgtgtctcgaggggaaangtcaccctctcctgcagggccagtgagagtcttgacagctccttagcctggtaaccaacgaaggcctggaccagcctccaggctcctactatttanagaatacactacccgaaccgaacgggtccaacgttggtacgttcccaggtcctaggtttccaacggtgggtccgggttcgggttcgtaggggtaccaaggtacgttacctacgttctaccgaacctagtacgacggtccgaacggtcctacgcctacggttccgtaaggtaaacgtttaacttttttaacgtagttttttaacttaacgttgtacgtaagtacgtaagttaagttacggtaaggtcgtacgttaccggtacgtttacggaccggtaaggtaaccgtaagggttaggaaacgtaacgaaacggtacgttggtacggctacgtacgaaccgttacgtcgttacgtcctttacgaaccgtttcccgttaccccggtaccttagttcccgtagtacgttattacgttaactaccgttcgtaacggg

SEQ ID NO: 161605 - DNA, 634 bp, Homo sapiens
  misc_feature: GYAE6OF01CIV0W.48.25.C03.1.454.CMB.1.raw
  modified_base (273)..(273): a, c, t, g, unknown or other
  misc_feature (273)..(273): n is a, c, g, or t
tcagagtatacatacacgaccggtgctcgatttagtagtgtagatttgggtttggggagacggaaccatggaagcccagcgcagcttctcttcctcctgctactctggctcccagattccactggacaaatagtgatgacgcagtccccagccacctgtctgtgtctccaggggaaagagtcaccctctcctgcagggccagtgagagtcttgacagctcttagcctggtaaccaacaaacggcctggccagcctccgaggctcctcatttangatacatccaccagggcctacgtggtctcccagccaggttcacgtgggcggtgggtctgggacagtagttcacgtctcaccatcagcacgtcctgacctagtactagtaaagtactttttacaatttttattacgtgtactaagtctaagttagtacgtaagtggtaccttccggtacggttttacgaccgtaaaggggtactaaagggtcgggtaaacgtaacgaaaccggtaaacgttggacggtacttacggaccctaacgtaacgttccgtacggttaccttaccgtaccttcccgttaccccggcctaacgttccgttaagtacttaagttactttaactaccgtttcgtacgggg

SEQ ID NO: 161606 - DNA, 238 bp, Homo sapiens
  misc_feature: GYAE6OF01C2SAW.48.25.C03.1.454.CMB.1.raw
  modified_base (217)..(238): a, c, t, g, unknown or other
  misc_feature (217)..(238): n is a, c, g, or t
tcagagtatacatacacgaccggtgctcgatttagtagtgtagatttgggtttgggggatcaaggactcctcagttcaccttctcacaatgaggctccctgctcagctcctggggctgctaatgctctgggtcccaggaactgtggctgcaccatctgtcttcatcttcccgcatctgatatgtatactctggagcgggctggacaaggcgcatagnnnnnnnnnnnnnnnnnnnnnn

SEQ ID NO: 161607 - DNA, 570 bp, Homo sapiens
  misc_feature: GYAE6OF01DHCQL.48.25.C03.1.454.CMB.1.raw
  modified_base (204)..(204): a, c, t, g, unknown or other
  misc_feature (204)..(204): n is a, c, g, or t
  modified_base (392)..(392): a, c, t, g, unknown or other
  misc_feature (392)..(392): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagngtcaccctctcctgcagggccagtgagagtcttgacagctccttagcctggtaccaacaaggcctggccagcctcccaggctcctcatttatgatacatccaccagggccactggtcgtcccagccaggttcactgggcggtggtctggggacagagtttcactctcaccatcagcagcctgcagtcngaagtattttacattttattactgtcagtcagttattacgtaagtggtacttccggtacgtttcggaccgtaagggaccaagggttacggaagtaccgaaaacggtaactggtacggcgtagaccaccgtaattcgttgttacctttcaactttcccgtttccccggccttagttccg

SEQ ID NO: 161608 - DNA, 546 bp, Homo sapiens
  misc_feature: GYAE6OF01DVNBC.48.25.C03.1.454.CMB.1.raw
  modified_base (203)..(203): a, c, t, g, unknown or other
  misc_feature (203)..(203): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaaggcctggccagccctcccaggctcctcatttatgatacatcccaccagggccacgtggtcgtcccagccaggttcacgtggcggtggtctgggacaggagttcactctcaccatcagcagcctgcagtctgaatattttacattttatactgtcagcagttatcgtaagtgactcgtacgttggacctaagggaccaagggtggtaagtacaaaacggtactgtacggacgtcgacacctattccgtgttaccttctaacttcctttccccgctgttaccg

SEQ ID NO: 161609 - DNA, 525 bp, Homo sapiens
  misc_feature: GYAE6OF01E5AHA.48.25.C03.1.454.CMB.1.raw
  modified_base (204)..(204): a, c, t, g, unknown or other
  misc_feature (204)..(204): n is a, c, g, or t
  modified_base (298)..(298): a, c, t, g, unknown or other
  misc_feature (298)..(298): n is a, c, g, or t
  modified_base (488)..(488): a, c, t, g, unknown or other
  misc_feature (488)..(488): n is a, c, g, or t
  modified_base (498)..(498): a, c, t, g, unknown or other
  misc_feature (498)..(498): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccagggggaaanagtcaccctctcctgcagggccagtgagagtcttgacagctccttagcctggtaccaacaaaggcctggccagcctcccaggctcctcatttangatacatccaccagggccactggtctccccagccaggttcactgggcggtgggtctgggacagagttcactctcaccatcagcagcctgcagtctgaagttattttacattttattactgtcagcagtatcgtaagtggactccgtaggtttcgacgtaagggacctaaggtggaagtcaaacgactggngcgtgcactntctgttctcacttccttcccgctgtcg

SEQ ID NO: 161610 - DNA, 613 bp, Homo sapiens
  misc_feature: GYAE6OF01CBU7I.48.25.C03.1.454.CMB.1.raw
  modified_base (275)..(275): a, c, t, g, unknown or other
  misc_feature (275)..(275): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaaccaacaaaggcctggccagcctccaggctcctctatttangatacactccaccgaggccacgtggtctcccagccaggttcacgtggcggtgggtctgggacaggacgttcactctacacctatcagcagcctgcagtctagaagtattttactattttatactgtacagtctaagttactacggttaagtcgggaccttaccggtacggttttcggacccgtaaaggggtacctaaagggggttacggaaacgttaccgaaaacggtaacgttggttacggcttacggaccaacctagttccgtcgttaccttcgtaacgtttcccttaccccggcctaagttctaaggtacttagttagttaactcgtcgtacggg

SEQ ID NO: 161611 - DNA, 616 bp, Homo sapiens
  misc_feature: GYAE6OF01AW8SF.48.25.C03.1.454.CMB.1.raw
  modified_base (274)..(274): a, c, t, g, unknown or other
  misc_feature (274)..(274): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctccaggcctcctcatttangatacatccaccgagggccacgtggtcgtcccagccaggttcacgtgggcggtgggtctgggacagagttcactctcaccatcagcagcctgcagtctagatattttacattttatactgtcagtctaagtatacgtaagtcggtacctccggtacgtttggaccgtaagggacccgtaaagggtacggaaacgtaccgaaacggtaacgttcgggtacgggtaccgtacggaccgtaacccgtagttccgttacggttacctttaccgaacgtttcccgttccccggtccctacgttcccgttacggtaactttacgttagtttaacttcgttccgtaggg

SEQ ID NO: 161612 - DNA, 531 bp, Homo sapiens
  misc_feature: GYAE6OF01D8K1F.48.25.C03.1.454.CMB.1.raw
  modified_base (272)..(272): a, c, t, g, unknown or other
  misc_feature (272)..(272): n is a, c, g, or t
  modified_base (398)..(398): a, c, t, g, unknown or other
  misc_feature (398)..(398): n is a, c, g, or t
  modified_base (481)..(481): a, c, t, g, unknown or other
  misc_feature (481)..(481): n is a, c, g, or t
  modified_base (524)..(524): a, c, t, g, unknown or other
  misc_feature (524)..(524): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagcctccaggctcctcatttangatacatccacagggcctactggtgtcccagccaggttcacgtggcggtgggtctgggacagcgttcacgtctcacatcagcagcctgcagtctagaaatattttactaattttattactgtcagntagtatcgtaagtggtactccggtagtttcggaccgtaagggaccaagggtagaacgtacaaacgtaacgtgtggctgcaacntctgtcttcgacttcttacccgcatctagtattatgttaactntcgtagg

SEQ ID NO: 161613 - DNA, 754 bp, Homo sapiens
  misc_feature: GYAE6OF01CRA95.48.25.C03.1.454.CMB.1.raw
  modified_base (203)..(203): a, c, t, g, unknown or other
  misc_feature (203)..(203): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccacctgtctgtgtctccgaggggaaancgtccaccctctcctgcgagggccagtgagagtctagacagctccttagcctaggtaaccaacgaaacggcctggccaacgccctcccgaagggtccttacctctaattttagtacgaactaacctacttccccaaccgacggggtaccctaacggttcgggtacgtacccccgaaggaccccgtaggggtttcccaacggttcggggtacggggttcggggtccgttagggggaaacctacggttaacggtttcccaaccgttcctaaccctaacccgacgttaccgaacgtccgaacggtcccttaggaccgtaaggttccgttaaggtaaacgtttaacttttttaacttaattttttaacgttacgttacgttaccgtaagtaccgtaagttaacgttaccggttaaaggttaccggaaccgtttaccggtaacggtttacggaaccgtaaacgggaaccgtaagggtacggaacgtaaccgaaacgtacgtgtacggctaggacctactctacgttcgtaccttcacttccgtacccgtctatacg

SEQ ID NO: 161614 - DNA, 529 bp, Homo sapiens
  misc_feature: GYAE6OF01EZVW1.48.25.C03.1.454.CMB.1.raw
  modified_base (202)..(202): a, c, t, g, unknown or other
  misc_feature (202)..(202): n is a, c, g, or t
  modified_base (506)..(506): a, c, t, g, unknown or other
  misc_feature (506)..(506): n is a, c, g, or t
  modified_base (526)..(526): a, c, t, g, unknown or other
  misc_feature (526)..(526): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaangtcaccctctcctgcagggccagtgagagtcttgacagctccttagcctggtaccaacaaggcctggccagccctcccaggctcctcatttatagatacatccaacagggcccagtggtcgtcccagccaggttccacgtggcggtggtctggggacaggtacgttcacgtctacacccatcgagcagccctgctagtctgaagtattttactattttatactgtcagctagtatcgtagtgactcgtacgttcgaccgtaaggaccaggtagaacgtacgaaacgactgtaggctgacacgtntctgtctcacttcctcctcntcg

SEQ ID NO: 161615 - DNA, 659 bp, Homo sapiens
  misc_feature: GYAE6OF01DLSXQ.48.25.C03.1.454.CMB.1.raw
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacgaaacggcctggccagcctccgacggcctcctcatttatgatacatccacgacgggccacgtcggtcgtcccagccgtaggtttacgtgggtcggtcgggtcgtggggacaggtagttccactctcaccatcacgcacgcctagctagttacagtaacgttattttactatttttattacttagtacagtctaagttacgttacggttaaggtcgtaccgttccggttacggtttacggaacccggtaaggggtaacccgtaaaggggtacgtaaacgtaaccgtaaacgtaacggttaggtcggtaccgttaggaccctaccaagttccgttagttccgttacctacgtttcccttaccccgtaccttacttccgtagttaacttacgttacgttaacttccgttcgtgggtaccgggg

SEQ ID NO: 161616 - DNA, 582 bp, Homo sapiens
  misc_feature: GYAE6OF01BWJ5M.48.25.C03.1.454.CMB.1.raw
  modified_base (180)..(180): a, c, t, g, unknown or other
  misc_feature (180)..(180): n is a, c, g, or t
  modified_base (276)..(276): a, c, t, g, unknown or other
  misc_feature (276)..(276): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaggcctggccagccctccgaggcctcctctatttangatacatccaccgagggccacgtggtcgtcccagcctaggttcacgtgggcggtggtctgggacagtgttcactctcactatcagcacgctgacagtcagtaagtattttacattttactactgtacagctaagtagtacgtaagtcggtacttccggtacgtttcggaccgtaaggggtaacctaaggggtacgaaacgtacgaaaacgtcgttaggtcgtctagactaccctagtcctagtcccttacgactttcccgtcccgtcctatccgtacgtattacttagtaacttcccgtgtccggg

SEQ ID NO: 161617 - DNA, 552 bp, Homo sapiens
  misc_feature: GYAE6OF01CTJX6.48.25.C03.1.454.CMB.1.raw
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaaccaacaaaggcctggccagcctccaggctcctcatttatgtatacatccaccagggccactggtcgtccagccaggttcacgtggcggtggtctgggacagagttcactctcaccatcagcagcctgcagtcgtagtaagtattttactaattttattactgtacagtctagtatagtagtgaccttcgtacgttcgacgaaggacgaagggtgaaagtacgaaacgtacgtgtcggactcgacacctagtcgttagtccgttactacttcccttcccgtccattctacgtattacgttgttaactgttcgtacggg

SEQ ID NO: 161618 - DNA, 601 bp, Homo sapiens
  misc_feature: GYAE6OF01B7FQL.48.25.C03.1.454.CMB.1.raw
  modified_base (281)..(281): a, c, t, g, unknown or other
  misc_feature (281)..(281): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaagagtcaccctctcctgcagggccagtgagagtcttgacagctccttagcctggtaaccaacgaaaggcctggccagccctcccgaggcctcctctatttangactacactcccacgagggccctacgtggtcgtcccagccgtaggttccacggttgggcgggttgggtcgtaggggacaggtacgttcacttcacacatcagccagcctgctagtctagaattattttacattttatactgtacagtctagttacttacgtaagtcggtaccttcggtacgtttggaccgaagggtaccaagggtgaacgtacgaaacgtagtggtcgctgacctacgtagttctcgttccttacgtaccgtttcccgttacccgtccttaagtcctagttaacttagttacgttactaccgttgtaggg

SEQ ID NO: 161619 - DNA, 661 bp, Homo sapiens
  misc_feature: GYAE6OF01B56RN.48.25.C03.1.454.CMB.1.raw
  modified_base (184)..(184): a, c, t, g, unknown or other
  misc_feature (184)..(184): n is a, c, g, or t
  modified_base (280)..(280): a, c, t, g, unknown or other
  misc_feature (280)..(280): n is a, c, g, or t
  modified_base (655)..(655): a, c, t, g, unknown or other
  misc_feature (655)..(655): n is a, c, g, or t
tcagagtatacatacacgaccggtgctcgatttagtagtgtagatttgggtttgggggagacggaaccatggaagccccagcgcagcttctcttcctcctgctactctggcctcccagattccactggacaaatagtgatgacgcagtccccagccaccctgtctgtgtcctccgaggggaaanagtcaccctctcctgcagggccagtcgagagtcttgacagctcctagcctggtaaccaaacaacggcctggccagccctccagcctcctcatttangactacactccaccgaggtccacgtggtcgtcccagccacggttcacgtgggcggtcggtctgggacagtacgttcacgtcgtaccacgatcgagtccaggtcctgactagtcgtaggtaaacttagtttttactaattttacgttacttgtactaaggtacttaagttagttacggtaaacggtcgtaaccgttccggttaacggtttcgaccggtaaagggtaccctaaggggtacggtaaacgtaccgaaacggtaccgtaggttacggacttggtaccaaccgttattaccgttagttaccttaccgtaccgttcccgttaccccgtacttacgttccgttacgtaaacttcgttaagttacctaccgttntacggg

SEQ ID NO: 161620 - DNA, 596 bp, Homo sapiens
  misc_feature: GYAE6OF01C7O6T.48.25.C03.1.454.CMB.1.raw
  modified_base (275)..(275): a, c, t, g, unknown or other
  misc_feature (275)..(275): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccagggggaaagagtcaccctctcctgcagggccagtgagagtcttgacagctccttagcctggtaccaacaaggcctggccagccctccaggcctcctcatttangatacatcccaacgagggcctacgtgggtccgtacccgagcccgtagggtttccacggttgggcgggttcgggtcgtggggactaggtagttcacgtctacaccatcagcacggcctgctagtctagaagttatttttacgtatttttatacttgtcagtctaggttatacgtaggtcgactccggtacgttggaccgaagggacgtagggtaggaaacgtacgaaacgtacgtgtcggctacgcacctatcgtcgttcctcgtaccttccgttacccgcttacttcgtagttaacttagtagttaacctcgtggtacggg

SEQ ID NO: 161621 - DNA, 542 bp, Homo sapiens
  misc_feature: GYAE6OF01EJ47Z.48.25.C03.1.454.CMB.1.raw
  modified_base (180)..(180): a, c, t, g, unknown or other
  misc_feature (180)..(180): n is a, c, g, or t
  modified_base (507)..(507): a, c, t, g, unknown or other
  misc_feature (507)..(507): n is a, c, g, or t
  modified_base (514)..(514): a, c, t, g, unknown or other
  misc_feature (514)..(514): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaggcctggccagcctccaggcctcctcatttatgatacactccaccgagggccactggtcgtcccagccaggttcacgtgggcggtgggtctggggacaggtagttcactcgtcaacatcagcagcctgctagtctagtaagttatttttaactatttttatactgtcagctagtatacgtagtgtacctcgtacgtttgaccgaggacaggtagaagtacaaacgtacgtgtgctcgacactgtctgtcttacacttccgttcccnctacttntacgtattacttgtaattcctgtacggg

SEQ ID NO: 161622 - DNA, 667 bp, Homo sapiens
  misc_feature: GYAE6OF01DL5KQ.48.25.C03.1.454.CMB.1.raw
  modified_base (292)..(292): a, c, t, g, unknown or other
  misc_feature (292)..(292): n is a, c, g, or t
  modified_base (587)..(587): a, c, t, g, unknown or other
  misc_feature (587)..(587): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagccttccttagccttaggtaacccaacgaaacggcctaggaccacggccctcccgaggcctcctacgtatttangtatactactccaccgacgggccacgtcggtactcccaggcctaggttccacggtgggcgggttgggtcgtaggggactaaggtcgttcacgttctacacctatcacgacacgcctgctacgtcgtagtaaagttacttttacttaatttttacttacgttcgtacgagtacttaaggttacttacgggtaagttgggtacccttaccgggtacgtttacgggaccggtaaacgggaaccgtaaggggtacgtaaacgtaccgaaacgtacggttgtacgggtactgaccacctnttacgtcgttaccttaccgtagttcccttacccgtctacgttcttacggtaattactacgttacttacgtggtacccggg

SEQ ID NO: 161623 - DNA, 571 bp, Homo sapiens
  misc_feature: GYAE6OF01APFJ4.48.25.C03.1.454.CMB.1.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
  modified_base (536)..(536): a, c, t, g, unknown or other
  misc_feature (536)..(536): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccagggggaaangtcacccctctcctgcagggccaggtgagagtcttgacagctcttagcctggtaccaacaaggcctggccagcctcccaggctcctcatttangatacatccaccagggcccacgtcggtctccccaggccaggttcacgtgggcggtgggtctgggacagtgttccacgtctccaccatcgagcacgcctgcagtctagaattattttactattttattactgtacagtactagttatacggttaagtcggtactccggtaagtttcggaccgtaaggggaaccaagggtaggaacgtaccgaaaggacgtgtacggcgtcgacaaccgtntactcgttcttcacttccctcccgtcctgttaccg

SEQ ID NO: 161624 - DNA, 598 bp, Homo sapiens
  misc_feature: GYAE6OF01DUOQM.48.25.C03.1.454.CMB.1.raw
  modified_base (272)..(272): a, c, t, g, unknown or other
  misc_feature (272)..(272): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagcctccaggctcctcatttangatacatccaccagggccactggtcgtcccagccaggttcacgtgggcggtgggtctgggacaggagttcactctcaccatcagcagcctgcagtctagaagtattttactatttttattactgtcagtctagtatacgtaagtcggtacttccggtacgtttcggaccgtaaagggacccgtaaagggttacggaaagttaccgaaaacggtaacgtggtacgggaccttaggacctaaccgtacttcgttacgttacctttaccgtacgttccgttccccgtcctacttcttagtacttattagttaactaccgttcgtacggg

SEQ ID NO: 161625 - DNA, 523 bp, Homo sapiens
  misc_feature: GYAE6OF01CKMFV.48.25.C03.1.454.CMB.1.raw
  modified_base (180)..(180): a, c, t, g, unknown or other
  misc_feature (180)..(180): n is a, c, g, or t
  modified_base (273)..(273): a, c, t, g, unknown or other
  misc_feature (273)..(273): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaaggcctggccagcctccaggctcctcatttangatacatccaccagggccactggtcgtcccagccaggttcacgtggcggtgggtctgggacaggagttcactctcaaccatcagcagcctgcagtctgaagtattttacattttatactgtcagctagtatcgtaagtgactccgtacgtttggacctaagggaccaagggtggaagtacgaaacgacttggtgctgacacatctcgtcttcgacttcctcccgcatctagtacttatgtactctcgtag

SEQ ID NO: 161626 - DNA, 618 bp, Homo sapiens
  misc_feature: GYAE6OF01EVQQJ.48.25.C03.1.454.CMB.1.raw
  modified_base (304)..(304): a, c, t, g, unknown or other
  misc_feature (304)..(304): n is a, c, g, or t
  modified_base (361)..(361): a, c, t, g, unknown or other
  misc_feature (361)..(361): n is a, c, g, or t
  modified_base (435)..(435): a, c, t, g, unknown or other
  misc_feature (435)..(435): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaagagtccaccctctcctgcgagggccagtgagagtcttgacagcctccttagccctggtaaccaacaaaggcctggccagccctcccaggctcctcatttangatacatccaccgagggcccagtggtctcccagcctaggttcacgtggcggtggtcngggacaggtattcgactctacaccatcagcacgcctgctagtctagtaagttattttactattttacttacgtntctagctagttacgtacgtaagtcggtacttcccggtaacgtttcgggacccgtaaagggtaacccgaaggggtacggtaacgtaccgtaaaacggtacgttagggtacggtacgtacgtaccgaacctagttaccttcggttaccttaccgtacgtttacccgttccccgtactcgttaccg

SEQ ID NO: 161627 - DNA, 214 bp, Homo sapiens
  misc_feature: GYAE6OF01AZF4L.48.25.C03.1.454.CMB.1.raw
tcagagtatacatacacgaccggtgctcgatttagtagtgtagatttgggtttgggggatcaggactcctcagttcaccttctcacaatgaggctccctgctcagctcctggggctgctaatgctctgggtcccaggaactgtggctgcaccatctgtcttcatcttcccgccatctgatatgtatactctgagcgggctggcaaggcgcatag

SEQ ID NO: 161628 - DNA, 621 bp, Homo sapiens
  misc_feature: GYAE6OF01DXQ0B.48.25.C03.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaangtcaccctctcctgcagggccagtgagagtcttgacagctccttagcctggtaaccaacaaacggcctggccagcctcccgaggcctcctctatttangatacactcccgaccgagggcccacgtggtcgtccccagccgtaggttccacgtgggtcgggtgggtcgtaggggactaggtacgtttcacgttcctacaccatcgagcacgccgtagcgtagttcgtaggtaaagttactttttaacgttaatttttattacttgtacagtctagttactacggttaaggtcgtacctccggttaacgttcggaaccgtaacgggtaccgtaagggttaggaacgtaccgaaaacggtacgtggtcggactcgaccactgttccgtgttccttactacttcccttccccgctgttacg

SEQ ID NO: 161629 - DNA, 661 bp, Homo sapiens
  misc_feature: GYAE6OF01DCTDB.48.25.C03.1.454.CMB.1.raw
tcagagtatacatacacgaccggtgctcgatttagtagtgtagatttgggtttggggagacggaaccatggaagccccagcgcagcttctcttcctcctgctactctggctcccagattccactggacaaatagttatgacgcagtcccagccaccctgtctgtgtctccgaggggaaagagtcaccctctcctgcagggccagtgagagtcttgacagctcttagctggtaccaacaagcctggccagcctaccaggcctctctatttatgatacactccacgacgggccacgtggtcgtcccagccaggttccacgtggcggtagggtcgtgggacaggtagttccacttcacaccatcagcacgcctgctagtctaggaattattttactattttatactagtcagtcgtaagttagtacgtaaggtacgacttccggtacgtttcggaccgtaacgggaccgtaagggtacggaagttaccgaaaacggtacgtagggtcggtacttacggaccgtaacctacgttaccgttacgttaccctttaaccgtaaccggtttaccctttacccccggacccttaacgtttcccggttaacgttacgtttaaacttaacgggtttaaactttaccgttaccggttacgggtaacccggggg

SEQ ID NO: 161630 - DNA, 562 bp, Homo sapiens
  misc_feature: GYAE6OF01C9AKR.48.25.C03.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (307)..(307): a, c, t, g, unknown or other
  misc_feature (307)..(307): n is a, c, g, or t
  modified_base (365)..(365): a, c, t, g, unknown or other
  misc_feature (365)..(365): n is a, c, g, or t
  modified_base (498)..(498): a, c, t, g, unknown or other
  misc_feature (498)..(498): n is a, c, g, or t
  modified_base (517)..(517): a, c, t, g, unknown or other
  misc_feature (517)..(517): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaangtccaccctctcctgcagggccagtgagagtctgacngctctagctgacaanagctggcagcctccagctcctnattngatacatccacgaggccagtggtcncccagcctagttccagtggcggtggtcagggacagcgtttcactctaccactatcgancacgtcctgactagtctagtagttactttactagttttactacttgtcagtctagtattcggtaagtcggtactccggttacggtttcgacgtaacgggtaccaagggtacgaacgtacgaaacggtcgtagnggtacgtcggactaccgtnttaccgttcgttacttacgtaccttcccgttacccgcttgttacg

SEQ ID NO: 161631 - DNA, 677 bp, Homo sapiens
  misc_feature: GYAE6OF01E0HL8.48.25.C03.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (297)..(297): a, c, t, g, unknown or other
  misc_feature (297)..(297): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaangtcaccctctcctgcagggccagtgagagtcttgacngctccttagcctaggtaccaacaaggcctggccagcctccaggcctcctcattttangatacatcccaccgagggcccactggtcgtcccaggccctaggttccacgtgggcgggttgggtcctggggacaggacgtttcaccttctcaccatcagcacgtcctgacctagtctagaagttattttaactatttttatacgttgttacagtctagttactacggttaagtcggtaccttccggtaacggtttacggacccgtaaaggggtacccgtaaaggggttacggaaaggttacccgaaaaacgggtaaccgttacgggttacgggtacccgttacggacccgtaacccgttacgttacccgtttacggtttacccgtttacccgtacctttacccccgggttttcccccgtaacccgttaccgtttacccgg

SEQ ID NO: 161632 - DNA, 752 bp, Homo sapiens
  misc_feature: GYAE6OF01AD936.48.25.C03.1.454.CMB.1.raw
  modified_base (284)..(284): a, c, t, g, unknown or other
  misc_feature (284)..(284): n is a, c, g, or t
tcagagtatacatacacgaccggtgctcgatttagtagtgtagatttgggtttggggacgacggaaccatggaagccccagcgcagcttctccttcctcctgctactctggctccagattccactggacaaatagtgatgacgcagtccccagccaccctgtctcgtcgtctccgaggggaaagagtccaccctctcctgcgagggccaggtgagagtctgacgagctcgtagcctgtaccaacgaacggcctggccagcctccgaggtcctccgtctatttangactacgacgtccaccgtacgggccctacgtgggtaccgtccccgaggtccgtagggtttccgaacggttcggggccgggttcggggttacctacggggtaaacctagggttaccggtttccaccgttccctaaccgaaccctacgttccgaacggtccctaacggtcccgttggaccgtaacggttcgtaagtaaacgtttactttttaaccgtagttttttaacgtaccgttcgtaccgtaggtaccgtaagtacgtacggttaacgtccggtaacccttaccgggtacggtttacgggaacccgtaaggggtaccgtaagggtacggtaactaaccggtaaacgtacgttcgggtacgtaccgtacggaccctaccgttagttccgttacgttcctacgtacgttcccgttacccgacttacgttccgtaggttaacgttagttacgttacttcgtggttacggg

SEQ ID NO: 161633 - DNA, 687 bp, Homo sapiens
  misc_feature: GYAE6OF01C3TI9.48.25.C03.1.454.CMB.1.raw
  modified_base (181)..(181): a, c, t, g, unknown or other
  misc_feature (181)..(181): n is a, c, g, or t
  modified_base (288)..(288): a, c, t, g, unknown or other
  misc_feature (288)..(288): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaangtccaccctctcctgcagggccagtgagagtctgacagcctccttagcctaggtaaccaaacgaacggcctggaccacgcccctccgaggtccttacctctatttangatacataccaccgacgggccacgtcggtacctacccagtcctaggttcacgtgggcgggtggtcgtagggcaaggtagttccaacgttcctacgaaccctagtaccacgccgaacgtcccttaggctacgttcgtaaggttaattactttttacttaatttttactaacgttcggttactaagtacgtaagttacgttacggtaaggtcgtaccgttaccggttaccggtttacgggaccgtaagggaccgtaagggtacgggtaaataccgtaaacggtagttcggaggtcttacggacctacgtacgttacgtccgttacgttaccgtaacgttccccgttacccgtacgtacctttagtacggttaacttagtacgttaactaccttcgtacggg

SEQ ID NO: 161634 - DNA, 570 bp, Homo sapiens
  misc_feature: GYAE6OF01DR6OM.48.25.C03.1.454.CMB.1.raw
  modified_base (205)..(205): a, c, t, g, unknown or other
  misc_feature (205)..(205): n is a, c, g, or t
  modified_base (382)..(382): a, c, t, g, unknown or other
  misc_feature (382)..(382): n is a, c, g, or t
  modified_base (395)..(395): a, c, t, g, unknown or other
  misc_feature (395)..(395): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaagngtccaccctctcctgcagggccagtgagagtcttgacagctcctagcctggtaccaacaaaggcctggccagcctcccaggcctcctcatttatgatacactccaccgaggccagtggtctcccagccgtaggtcacgtgggcggtgggtctgggacaggtattcgactctcacctntcagcagcctgcngtctagaagttatttactattttactatgtacagctaagtatcgttaagtcggacttccggtacgtttcggaccgtaaagggacctaagggtacggaacgtacgaaacgtacgtgtacgggtactggaccacgtattccgttgttaccgtttcacttccttaccccgctagttcg

SEQ ID NO: 161635 - DNA, 695 bp, Homo sapiens
  misc_feature: GYAE6OF01B3DP1.48.25.C03.1.454.CMB.1.raw
  modified_base (331)..(331): a, c, t, g, unknown or other
  misc_feature (331)..(331): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccaccctgtctgtgtctccgaaggggaaagagtccaccctctcctgcagggccaggtgagagtcttgacagccttccttagccgtacggtaaccaaacgtaaacgggccctgggacccacggccctacccgacggtccttcccttctattttagngactaccactccccaaccgacgggtaccctaccgtcggtccgtccccacggcccgtacggttccacggtcgggtcgggttcggtcgtggggactaggtactttccgaccgtcctacacctacgtcgagaccgacgtcctacgcgtacgtcgtagtaaagtttacttttaattattttaacttactgtcagtcgtagttacgtagtaggtcgtacgtccggtacggtttacggacgtaacgggactaagggtacggtaacgtacgtaaacgtacgtgggtacggtaccgtagtacccgaccgttaacgttcgtttaccgttaccctttactaccgtttaccccgttcccctccgttacttaccgg

SEQ ID NO: 161636 - DNA, 672 bp, Homo sapiens
  misc_feature: GYAE6OF01BXG32.48.25.C03.1.454.CMB.1.raw
  modified_base (305)..(305): a, c, t, g, unknown or other
  misc_feature (305)..(305): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccaccctgtctgtgtctccgaggggaagacgtcaccctctcctgcagggccagtgagagtcttgacagtctcctagcctaggtaccaacgaaggcctggccacgccctcccaggtcctcctctatttangtaatacactccaccgacgggccctagtcggtcgtcccaggtccctaggtttccacggtgggtccgggtgggttccgtaggggacaggtagttacctaacgtccgtaccactatcgaacggccacgtcccttaggcctacgttactaggtaaagttttaacttttaacttaatttttaacttagtcgttacaagtcgtaagttacgtacgtaacggtacgtacgttccggttacggttacggaccgtaagggtaaccggtaagggttacggaacgtaaccgtaaacggtaacgttcggtaggtcctacgacccgaccttgttcccttgttaccctttcacccgtttccctcccgtaccctgttaccg

SEQ ID NO: 161637 - DNA, 641 bp, Homo sapiens
  misc_feature: GYAE6OF01AXZ9S.48.25.C03.1.454.CMB.1.raw
  modified_base (180)..(180): a, c, t, g, unknown or other
  misc_feature (180)..(180): n is a, c, g, or t
  modified_base (271)..(271): a, c, t, g, unknown or other
  misc_feature (271)..(271): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaagcctggccagcctccaggctcctcatttangatacatccaccgaggccacgtggtcgtaccccagcccgtaggttccacgtgggcgggttcgggtcgtagggaaccaggtagtttccacttccgcacccatccagcagtccctgcagtcctagaagtacttttacattttaattactgtacagtctaagtacttacggtaattggaaccttccgtacgtttggaacccgaaggggtacccgaaagggtagggtaactaccgtaaaacggtaagttcgggttagccgtaggaccctaaccgaatttccgtaggttacccttaacgtaccgttccctacccccggacttacctttacgtacgtaactttaaggttacgtttaacttaacccgttggtaacgg

SEQ ID NO: 161638 - DNA, 590 bp, Homo sapiens
  misc_feature: GYAE6OF01A5E4D.48.25.C03.1.454.CMB.1.raw
  modified_base (281)..(281): a, c, t, g, unknown or other
  misc_feature (281)..(281): n is a, c, g, or t
  modified_base (295)..(295): a, c, t, g, unknown or other
  misc_feature (295)..(295): n is a, c, g, or t
  modified_base (554)..(554): a, c, t, g, unknown or other
  misc_feature (554)..(554): n is a, c, g, or t
tcagagtatacatacacgaccggtgctcgatttagtagtgtagatttgggtttggggagacgggaaccatggaagccccagcgcagcttctcttcctcctgctactctggctcccagattccactggacaaatagtgatgacgcagtccccagccaccctgtctgtgtctccgaggggaaagagtcaccctctcctgcgagggcctagtgagagtcttgacagctccttagcctggtaaccaacaaggcctggccagccctccgaggcctcctctatttangatacactccacgngggccacgtggtcgtcccagccgtaggttcacgttgggcggtgggtctggggacaggtcgttcacgtctccacatcagcagtcctgctagtctagtaagttattttactattttactactgtacagtactagtatacgtaagtcgtacctccggtacgttcggaccgtaagggacctaagggtcgaaacgttaccaaacggtacgtggttacgtcgtcgacccactgttccgttgtacccttacgtcttccctcccggntacgttcctagtacttagtacgtattcgtcgtaggg

SEQ ID NO: 161639 - DNA, 534 bp, Homo sapiens
  misc_feature: GYAE6OF01E466Q.48.25.C03.1.454.CMB.1.raw
  modified_base (494)..(494): a, c, t, g, unknown or other
  misc_feature (494)..(494): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtcgtcccagccaggttcacgtggcggtgggtctgggacaggagttcactctcaccatcagcagcctgcagtctgtaagtattttacattttatactgtcagctagtatgtaagtggactccggtacgtttggaccaagggaccaagggtaggaacgtacgaaacgtacgtgtggactgaccacgatcgtgtcttacncttccttcccggctatctagtattatatacttactcgtgg

SEQ ID NO: 161640 - DNA, 568 bp, Homo sapiens
  misc_feature: GYAE6OF01EMZGI.48.25.C03.1.454.CMB.1.raw
  modified_base (300)..(300): a, c, t, g, unknown or other
  misc_feature (300)..(300): n is a, c, g, or t
  modified_base (389)..(389): a, c, t, g, unknown or other
  misc_feature (389)..(389): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtccaccctctcctgcagggccagtgagagtcttgacagctccttagcctggtaccaacaaaggcctggccagcctcccaggcctcctcattttangatacactcccaccgacgggtcccactggtctccccagccctaggctacgtgggcggtgggtctgggacagagttcactctcaccatcngcagcctgcagtcagtaagttatttaactattttattacgtgtcagactgtatacgtagtgtactccgtacgtttcggaccgtaaacgggaccgtaagggtggaagtacgaaacgtacgtgtacggactcgacaccgtatcgttagttcctacgtacttccgttcccccgtctacttcg

SEQ ID NO: 161641 - DNA, 615 bp, Homo sapiens
  misc_feature: GYAE6OF01AY5B9.48.25.C03.1.454.CMB.1.raw
  modified_base (180)..(180): a, c, t, g, unknown or other
  misc_feature (180)..(180): n is a, c, g, or t
  modified_base (274)..(274): a, c, t, g, unknown or other
  misc_feature (274)..(274): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctcctagcctggtaccaacaaggcctggccagccctccaggcctcctcatttacngtactacactccaccgagggccacgtggtcgtcccagcctaggttcacgtcgggcggtagggtctaggggactaggtagttccactcgtcaaccattcagcacgtcctggctagtctaggaaagtttcttttaacgtatttttactacttgtactagtacctaagttacgtacgttaaggtcgtacgtcggtacggtttcggaccgaacgggtactaagggtagtaaacggtaccgaaacggtacgttaggtacggtactgaccgtaacagttctacgttctacgtcgtcccttcccgtactacttccgtactagttacttagttaactcgttcgtacggg

SEQ ID NO: 161642 - DNA, 727 bp, Homo sapiens
  misc_feature: GYAE6OF01EFD9E.48.25.C03.1.454.CMB.1.raw
  modified_base (182)..(182): a, c, t, g, unknown or other
  misc_feature (182)..(182): n is a, c, g, or t
  modified_base (306)..(306): a, c, t, g, unknown or other
  misc_feature (306)..(306): n is a, c, g, or t
tcagagtatacatacacgaccggtgctcgatttagtagtgtagatttgggtttggggagacggaaccatggaagccccagcgcagcttctcttcctcctgctactctggctcccagacttccactggacaaatagtgatgacgcagtccccagccaccctgtctgtgtctaccgaggggaanagtccaccctctcctgcgagggccagtgagagtcttgacagtccttcttagccgtaggtaacccaaacgaacggccgtggacccacgtcccgtacccgacggtcctacccttactattttacgngtaacttaccactcccccgaaccggacgggtccctacggttcggtccgtaccccgaggtcccgtaaggtttccgacggtcgggtcgggttcgggttacgtagggaacctaggtacgttcctaccgttctccgaacgtacgtcgaacgccgtaacggtccctgaccgtacgtcgttaaggtaaactttatttttaacttaagtttttacgttaccgtgtacagttctaagttacgttacggtaagtccgtaacccgttacggttacggtttacggaccgtaagggtaacgtaagggtggaaacgttaacggaaactgtcgggtcgtaccgacgtacctacgtacttcggttacgttacctcgtaaccttccccggttaaccgcttactcgtagtactttatacgttacttacgtcgggtagg

SEQ ID NO: 161643 - DNA, 604 bp, Homo sapiens
  misc_feature: GYAE6OF01D8J03.48.25.C03.1.454.CMB.1.raw
  modified_base (182)..(182): a, c, t, g, unknown or other
  misc_feature (182)..(182): n is a, c, g, or t
  modified_base (286)..(286): a, c, t, g, unknown or other
  misc_feature (286)..(286): n is a, c, g, or t
tcagagtatacatacacgaccggtgctcgatttagtagtgtagatttgggtttgggggagacggaaccatggaagccccagcgcagcttctcttcctcctgctactctggctcccagattccactggacaaatagtgatgacgcagtccccagccaccctgtctgtgtctccgaggggaaanagtcaccctctcctgcacgggccaggtgagagtcttgacagccttccttagcctaggtaaccaaacgaacggcctggccagccctccgaggctcctctatttangaactacactccaccgagggcctacgtggtcgtcccaggcctaggttcacgtgggcggtgggtctgggacagtcgttcactctcacatcagcacgcctgctagtctagtaagttacttttactattttacttactgtacagtactagtattacggtaagtcgtacttccggtacggtttacggacgtaacgggtaccgtaaggtaggtaacgtaacgaaacgtacgttggtcggactacgacgtacctagttcgtcgttcttacgtccttcccgttcccgtcctattctatacttagtagttacttacgtcgtacggg

SEQ ID NO: 161644 - DNA, 663 bp, Homo sapiens
  misc_feature: GYAE6OF01BI21S.48.25.C03.1.454.CMB.1.raw
  modified_base (204)..(204): a, c, t, g, unknown or other
  misc_feature (204)..(204): n is a, c, g, or t
  modified_base (380)..(380): a, c, t, g, unknown or other
  misc_feature (380)..(380): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgctccgagggggaaangtcaccctctcctgcagggccagtgagagtcttgacagctcttagcctaggtaccaacaaggcctggccacgccctacccgaggccttcctctatttagcgactacactcccgaccgagggccacgtcggtcgtacccaggcctacggttcacgtcgggcggtggtcgtggggacnggtacgtcactctcaccatcagcacgcctgcagtctaggtaattattttactaagttttacttacttcgtacgtacgtactagttacgtacggttaacggttcggtaaccgttaccgggttaccggtttacgggaccggtaaacggggtaaccgtaaggggtacggtaacgtaaccgtaaaacggtaacgttcgggtaggtaccgtacggtaccctaacggtactttaccgttagtttacccttacgtaccgtttccccgttacccgggtacctcgttacccg

SEQ ID NO: 161645 - DNA, 722 bp, Homo sapiens
  misc_feature: GYAE6OF01BOL2U.48.25.C03.1.454.CMB.1.raw
  modified_base (226)..(226): a, c, t, g, unknown or other
  misc_feature (226)..(226): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggcctcccagattccactggacaaatagtgatgacgcacgtccccagcccaccctgtctgtcgtcgtccgaaggggaaatcgtccaccctctccgnggcgacggccagtggagtacgttctgaccgacgtctacgttacgccgtacggaacccaaacggaaccggtcccgtacggaccctaccggcccttacccggacggtcctccttacttagtttacacggtaactacctacctacccgaaccggtacggtaccctacggttcggtacccgtcccgtaaacggtcctaacgggtcctacggggtgggtacggtcggtcgtacgggactagtcgtacctcgtcgtacgacctacgtcctacacgtcgtacgactcggtaactaggtaacttattttaacgttactttaagtttacgtcgtaaccgttacgtaacgtagttacgtaacggtacggttacggtaccgtacggttacgtaccggtaacggaacggttaacgaggtacgaacgtaaggtaacgtcgtagtaccggactcggacttacacgtcttcgttaccgtacgtacccttcggtacctactccgttgtaacg

SEQ ID NO: 161646 - DNA, 638 bp, Homo sapiens
  misc_feature: GYAE6OF01E4FWE.48.25.C03.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
  modified_base (385)..(385): a, c, t, g, unknown or other
  misc_feature (385)..(385): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaanagtcaccctctcctgcagggccagttgagagtcttgacngctcctagcctggtaccaacaaacggcctggccagccctcccaggcctcctcatttangatacatccacngggccacgtggtctccccagccgaggttcacgtgggcggttcgggtcgtggggacaggtacgtttcacttcncaccatcgagcacgcctgcctagtctagaagttattttaactattttattactgtcagtctagttatacggttaagtcggacgttccggtaacggtttcggaccgtaaacgggtaacccgtaaggggtacggtaaacgtaccgaaaaacggtacgttagggtacgggtccgtacggtacccaaacccgtgttacccgttcggttaccctttaccaccgttttccccgttacccccggtccttaacgtttcccg

SEQ ID NO: 161647 - DNA, 774 bp, Homo sapiens
  misc_feature: GYAE6OF01CWX66.48.25.C03.1.454.CMB.1.raw
  modified_base (180)..(180): a, c, t, g, unknown or other
  misc_feature (180)..(180): n is a, c, g, or t
tcagagtatacatacacgaccggtgctcgatttagtagtgtagatttgggtttggggagacggaaccatggaagcccagcgcagcttctcttcctcctgctactctggctcccagacttccactggacaaatagtgatgacgcacgtcccagccacctgtctgtgtctccgaggggaaancgtcaccctctcctgcgacgggccaggtcgagacgtcttgacacgtccttccgttacgccgtacggtaaccaaacgaaacggtcctgggaccacgccctccgagggtcccttaccgttacaatttttacgacgtaacttaaccacttacccgaaccggacggggaccctaaccggtttcggggttccgttacccgaacggtcccgttaaacgggtttcccggtaaggtttcggggccggggttttcggggtacgttaacgggggaacctaagggttaccgttttccgaaaccgtttccgtaaccaaccgtttaacgtaccgaacggtccaaccggtccgttacgggactacgggttacttaaggttaaaactttacttttaacgtttaacgtttttacttacgttacgttacgtactacgtagtacgttacgtaaggtcgtaccgtcgtacgttcgacgaacggtacagggtacgaacgtacgaacgtagttgacgtgacgtacactcgttcgcgtttactaccgtccgttacccttaccgtacttagtaccttaggttaacttacgttagtttaacctgttaccggtaacggg

SEQ ID NO: 161648 - DNA, 647 bp, Homo sapiens
  misc_feature: GYAE6OF01B1MT2.48.25.C03.1.454.CMB.1.raw
  modified_base (309)..(309): a, c, t, g, unknown or other
  misc_feature (309)..(309): n is a, c, g, or t
tcagagtatacatacacgaccggtgctcgatttagtagtgtagatttggggtttgggggaggaactgctcagttaggacccagacggaaccatggaagccccagcgcagcttctcttcctcctgctactctggctcccagattccactggacaaatagtgatgacgcagtccccagcccaccctgtctgtgtcctccgaaggggaaagcgtccacccctctcctgcgagggccaggtgagagtctgacagcctcgtagcctggaccaacaacggcctggccacgccctcccaggtcctcctctatttancgatacactcccaccgacggggcccacgtcgggtcgtccccgaggccccgtagggttccaccggtgggccgggttgggtcgtagggggactaggtacgttccaccgtctaccacctatcgacgtcacgtcctgcgtacgttctagtaacgttaacttttactaacttttattaccttgtccagtactagttacttacggtagtcggtacctccggttacgttcggaccgtaagggaccgtagggtacgaaggtaccaaacggtacgtacggtcggcgtcgtaccaaccgttcttccgttgtaccttacgtaccttccctaccccggtcctaagttccg

SEQ ID NO: 161649 - DNA, 811 bp, Homo sapiens
  misc_feature: GYAE6OF01CK62N.48.25.C03.1.454.CMB.1.raw
  modified_base (280)..(280): a, c, t, g, unknown or other
  misc_feature (280)..(280): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaagagtcaccctctcctgcgagggccagtgagagtctgacagctccttagcctggtaaccaacgaaggcctgggccacgcctccgaggcctctctattttangaatacataccaccgagggaccacgtgggtcgtacccaggaccgtaggttcacgtggggtcgggtgggttactaggggactaaggtacgtttccaacgtttccgtacctaaccgtagtaccgaacgggtactacgggtcccttacggaccgttaaggttccgttaaggtaaacggtttaaacttttttttaaccgtaattttttttaaccgttaccgttagggttacctaaaagtacccgtttaaaggtttaaccgttaacggggtttaaacgttaccggggttaaccctttacccgggggttaacgttttacggggaaccccgttaaaaggggggaaccctaaagggggttaacggtaaaacggttaccctaaaaaccgggtaacgggtttggtacggggtaccttaggacccgttaactacgtttaccgtccgtttaccgttccgtaaacccgtttcccgttcccccggacttaactttacgtaaggttaaactttagtttaccggtaactttacccgtggtaacgggg

SEQ ID NO: 161650 - DNA, 680 bp, Homo sapiens
  misc_feature: GYAE6OF01CTFB7.48.25.C03.1.454.CMB.1.raw
  modified_base (205)..(205): a, c, t, g, unknown or other
  misc_feature (205)..(205): n is a, c, g, or t
  modified_base (407)..(407): a, c, t, g, unknown or other
  misc_feature (407)..(407): n is a, c, g, or t
  modified_base (671)..(671): a, c, t, g, unknown or other
  misc_feature (671)..(671): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcacgtccccagccaccctgtctgtgtctccgaaggggaanagtccaccctctcctgcagggccagtcgagtagtcttagacgagtcctccgttagccgttacggtaaccaaacgaaacggtcccgtaggcccaacgccctacccgaggtccctcctactatttactgtaactacactcccacgacggccacgtcggtcgtacccagccgtaggttcacgtgggcggtggtcgtcggggaacnggtacttcgactctaccacctactacgacgccacgtcctgacgtagtacgtagtaaagttactttttaacgtatttttacgtactgtactacggtactagttacgttacgggtaagtacggtacttaccggtacggtttacggaacccggaagggtaccgtaagggttaacggtaacgtaacggaaacgtacgtggtacgggacgtacggaccctaacgtcgttaccgtggttaccttacccgtaactttccccggtaccccgnttacgttcg

SEQ ID NO: 161651 - DNA, 768 bp, Homo sapiens
  misc_feature: GYAE6OF01DWYQ1.48.25.C03.1.454.CMB.1.raw
  modified_base (181)..(181): a, c, t, g, unknown or other
  misc_feature (181)..(181): n is a, c, g, or t
  modified_base (212)..(212): a, c, t, g, unknown or other
  misc_feature (212)..(212): n is a, c, g, or t
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaanagtccaccctctcctgcagggccagtggagntctgacncgctctacncgtacgtaaccaacgaacgtcgtcgccacgccctaccgacggtccttcctactaatttagtagtaactaactacctccccaaccggacggcctacggtcggactacctcccgagacgtacggttacgaggtggacgtaggttcgggtacgtcgggaactaggtaccttacaccgttcctacccaacctactaacccgaaccgaaggtaccgtagggaccgtcccgttaggtagttacgttttaagttttcgaacgtttaggtttttaccgtttttcgtacggttaccgtaagtaccgttaaggtttacgtaacggggtttaacgttccccgtaaccggttacggtaaccgtttaccgggttacccgggaccgggtaacggggtaaccgtaaggggtaacgtaaaccgttaacgaaaaccggtgttacgggtcgtacgtacgacctaaccgttacgtccgtttccgtttacttaccgtaccctttaccccgtaccccgtaccttaccgttacgtagtttaacttcgttaacgtttaaaccg

SEQ ID NO: 161652 - DNA, 613 bp, Homo sapiens
  misc_feature: GYAE6OF01A1HJ0.48.25.C03.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaaggcctggccagccctcccaggcctcctctatttangatacatcccaccgagggccacgtggtctcccagccaggttcacgtggcggtggtctgggacaggtagttcactctacaccatcagcagcctgcagtctagaagttattttactattttactactgtactagctagttactcggtaagtcggtaccgtccggtaacggtttcggaccgtaacggggaacctaaggggtacgtaacgtaacgaaacggtacgtggtacggacgttacggacctaacccgttgttacccgtttggtttaccctttacctactttaccccgtttcccccggtacctagtttacccg

SEQ ID NO: 161653 - DNA, 672 bp, Homo sapiens
  misc_feature: GYAE6OF01DBVOH.48.25.C03.1.454.CMB.1.raw
  modified_base (206)..(206): a, c, t, g, unknown or other
  misc_feature (206)..(206): n is a, c, g, or t
  modified_base (246)..(246): a, c, t, g, unknown or other
  misc_feature (246)..(246): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccaccctgtctgtgtctccgaaggggaaangtccaccctctccgtgtacgggccagtgagagtcttgacngctccttagcctaggtaaccaagaaggcctggccacgccctaccgaggcctcctntatttangactacatcccacgacggccacgtggtcgcccagccgtaggttcacggtgggtcgggtggtcgtcggggactagggtactttccgacttccactaacctatcgacgctacgtcctgactacgtctagtaattattttaacttattttatactgtacagactagtacgttacgtaaggtacggtaccgttcggttaccggttagggaacccggttaaaggggaaccgttaaagggggtaggtaaaccgtaacgtaaaccgggtaacgttggggtacggtacctacggtacctaacccgttattcccggtttacgttacctttaccgtaccgtttacccgtaccccggacttaagttcccggtaag

SEQ ID NO: 161654 - DNA, 713 bp, Homo sapiens
  misc_feature: GYAE6OF01C4GY4.48.25.C03.1.454.CMB.1.raw
tcagagtatacatacacgaccggtgctcgatttagtagtgtagatttgggtttgggggaggaacgtgctcagttaggacccagacggaaccatggaagccccagcgcagcttctcttcctcctgctactctggctccagattccactggacaaatagtgatgacgcagtccccagccaccctgtctgtgtctccgaggggaagagtcaccctctcctgcgagggccaggtgagtagtcttgacagtctcttacgcctcggtaaccaacgaacggtcctggaccacgccctcccgaggcctcctactattactgataccatcccgacgacggcctacgtggtcgtcccgagtccgtacgttcgacgtgggtaccggggttcggtcgtaggggacacggtacgttcaccgtcctacacctatacgagtccacgccgtacgccgtacggttaccgtaggtaaacgtttacttttaacgttaatttttaacgttacttggttaacctacgtacgtaaggttaacgtttcgggtaaggttccggtaaccggtttaccggtaccgggttttacgggaccggtaaacggggtacgtaaggggtacggtaacgtaaccggtaaaccggtaagtgggtccgtacgtccggaccctacgttaccgttccgtttcgtttccgttaccgttaaccgtttccctacccccggtacttcgttaccgg

SEQ ID NO: 161655 - DNA, 646 bp, Homo sapiens
  misc_feature: GYAE6OF01A799M.48.25.C03.1.454.CMB.1.raw
  modified_base (205)..(205): a, c, t, g, unknown or other
  misc_feature (205)..(205): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaagngtcaccctctcctgcaggccagtgagagtcttgacagcctcttagcctaggtaaccaacgaacggcctacggcccacgccctcccgaggccctacctctatttacgtgactacactcccaccgacgggcctacgtcgggtcgtacccaggcccgtaggttccgacgtgggcggttggtcgtgggacaggtcgttcactctacacatcgacgtcacgtcctcgcgtacgtcgtagtaaagtttacttttaacttaattttaacttacgtcgttacgtagtactagttacttacggtaggtcggtacgttaccggtacggtttcggaaccgtaacgggtaccgaagggttacggaacgtacgaaagtacgtcgggtaggtctcggacctacgtacgttcgttacgttcgttacctacgttcccgtacccgtccgttaacgtcg

SEQ ID NO: 161656 - DNA, 622 bp, Homo sapiens
  misc_feature: GYAE6OF01D6ZEP.48.25.C03.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (613)..(613): a, c, t, g, unknown or other
  misc_feature (613)..(613): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaangtccaccctctcctgcagggccagtgagagtcttgacagctccttagcctggaccaanaaggcctggccagccctccgagcctcctctatttatgatacactccaccgagggccagtggtctcccagcctaggttcacgtcgggcggtgggtctagggacaggtacgtttcacgttctacaacctagtccagtcacgtcctgctagtctagtaaagttattttactattttatactgtactagactaagttactacggttaagtcggtaccttaccggtacgtttcggaaccgtaagggtaccgtaaggggttacgaacgttaaccgaaaacggtaccgttggtacggtaccgtacggtacaacccttagttaccttcgttacctttcctaaccttcccgtttaccccgnttcgttacg

SEQ ID NO: 161657 - DNA, 648 bp, Homo sapiens
  misc_feature: GYAE6OF01D2340.48.25.C03.1.454.CMB.1.raw
  modified_base (180)..(180): a, c, t, g, unknown or other
  misc_feature (180)..(180): n is a, c, g, or t
  modified_base (279)..(279): a, c, t, g, unknown or other
  misc_feature (279)..(279): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaaccaacgaaggcctggccagccctcccgaggcctcctctatttangaatacatcccaccgagggcccacgtggtctcccagccgtaggttccacgtgggcggtgggtcgtggggactaggtagttccaccgttcctaccgaacctatccgaaggccaacgccgtgacctaggtctaggtaaagtttactttttactatttttaacttacttgttacagtactagtaagttacggtaaggtcggtaaccgttccggtaacggttttcgggaaccgtaaacggggtaaccgtaaagggtacggtaaacgtaaccgaaacggtaacgttaggtacggtacgtcgaccaccgtattcgtcgttacttactacttcccgttcccgtctacgtctagtattattagtaacttctcgtagg

SEQ ID NO: 161658 - DNA, 794 bp, Homo sapiens
  misc_feature: GYAE6OF01CB2C0.48.25.C03.1.454.CMB.1.raw
  modified_base (181)..(181): a, c, t, g, unknown or other
  misc_feature (181)..(181): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaanagtcaccctctcctgcagggccagtgagagtcttgacagctccttagcctggtaaccaacaacggcctcggccagccctcccaggtcctccctctactttatgactacactcccgaaccacggggtcccaacgttcggtcgtaccccacgccgtaaggttccacggtgggcgggttcggggtcgtacggggactaggtacgttccaccttccgtaccaacctagtaccaaggtccgaacgccctaggccctaaaggttcctaaggttaaacgtttaatttttaacttaacttttttaactttaccgttagttaccgtaaggttaccttaaaggttaacgtttaaccgggtaaacgggtttacgggtaacccgtttaaccccgggttacgggttttacccgggaacccggttaaacgggggtaaccgaaacgggggttaacggtaaaccggttaaccggaaaacccggtaacggttacgggtacgggtaccttacgggaccctaaaccgtaacgttccgttacgttccgtttaccaccggtttacccttacccccggttactacgttacgtaaccgtacttaacttacggttaaccttaccggtgttaccgggg

SEQ ID NO: 161659 - DNA, 724 bp, Homo sapiens
  misc_feature: GYAE6OF01EDKPS.48.25.C03.1.454.CMB.1.raw
  modified_base (203)..(203): a, c, t, g, unknown or other
  misc_feature (203)..(203): n is a, c, g, or t
tcagagtatacatacacgaccggtgctcgatttagtagtgtagatttgggtttgggggaggaactgctcagttaggaccagacggaaccatggaagccccagcgcagcttctcttcctcctgctactctggctcccagattccactggacaaatagtgatgacgcagtccccagccaccctgtctgtgtctccgagggaaagngtcaccctctcctgcgagggccagtgagagtcttgacagctccttagcctaggtaaccaaacgaacggcctggccacgccctcccgaggcctcctctatttatgataccatcccgaaccgacgggacctacgtcgggtcgtacccagtccgtaggttcacgtcgggcgggttggtcgtggggaacaggtacgttcaacctccgtacgaacccagttaccgaacggcctaacggtccctggtccgtaagttccgtaaggttaaacgtttaacttttttaacttaatttttaacgtttaccgttgtaccgtagtactaaggtttacttacggttaacggttcggtaaccgttaccggttaacgggtttacgggaacccggtaaacgggggtaaccgtaaaggggttaggaaaccgttaccgaaaaacggtcgtttcgggtacgggtccgtacggtaccctaacccttagttcccgtttacgttaccgtttctaccgtttccccgttaccccgcttagttaccg

SEQ ID NO: 161660 - DNA, 900 bp, Homo sapiens
  misc_feature: GYAE6OF01D3IUI.48.25.C03.1.454.CMB.1.raw
  modified_base (187)..(187): a, c, t, g, unknown or other
  misc_feature (187)..(187): n is a, c, g, or t
tcagagtatacatacacgaccggtgctcgatttagtagtgtagatttgggtttggggagacggaaccatggaagccccagcgcagcttctcttcctcctgctactctggcctcccagacttccactggacaaatagtgatgacgcacgtccccagcccacctgtctgtcgtctaccgaaggggaaanacgtccaccctctcctgacgacgggccaggtcgagtacgttcttacgactacgtccttaccgttaacgcccgttaacgggtaaaccccaaaacggtaaaccgggtcccgtacgggacccgtaaccggtccccgttaccccggaagggttcccctttacccttaacgtttaaacgtttttaacgtacggttaaaacccttaaccgttaaccgttaaccccccggaaaaccccggttaccgggggtaaccccctaaaccgggttttcggggttaaccccgtaccccggtaacgggtaccccgttaacgggtttcccgaaccgggttcggggggtaccggttttcggggtaaccgtagggggtaaaccctaagggttacgttaccctaaccggttaccgtaaccctaacccgtagtacccggtaacgacccgtaacggtccttacggaacgttcgtaacgttaacgtaaagtttacttttaatttacgttttacttacgtcgtacgtaacgttacgtaacgttacgtacggtaacgtcggtaccgttaccggttacgttcggaaccgtaacggtacgtaagggtacgtaaggtaaccgtaacgtacgtaggtacgtcgttaacgacttaccgacgttcgtacgttaccttacgtaccttcccgttaccctactacgttcgtagtacttacgtacttacgttacgtcggtaaccggg

SEQ ID NO: 161661 - DNA, 637 bp, Homo sapiens
  misc_feature: GYAE6OF01EFEYN.48.25.C03.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
tcagagtatacatacacgaccggtgctcgatttagtagtgtagatttgggtttgggggaggaactgctcagttaggacccagacgtaaccatggaagccccagcgcagcttctcttcctcctgctactctggctcccagattccactggacaaatagtgatgacgcagtccccagccaccctgtctgtgtctccgaggggaaangtccaccctctcctgcagggccagtgagngtctgacagctcttagcctaggtaccaacaaggcctggccagccctccaggtcctcctctattttatgatacactcccgaccgagggccctacgtcggtcgtcccagccaggttcacgtggcggtggtcgtgggacagtacgtcacgtctcgacatcacgctacgcctcgctacggtctagaagtttacttttacgtaatttttacttacgtcggttactacggtacgtaagtttacgtcggttaaggtcggtaccttccggttaaggtttcggaccggtaaagggtaaccctaaggggtcggtaaacgtacgaaaaccggtaacgttggtacggtacgtacgtaccgaacctacgttcgttacgttcctttactaacgttcccttccccggctactttaccgg

SEQ ID NO: 161662 - DNA, 654 bp, Homo sapiens
  misc_feature: GYAE6OF01DZ1L8.48.25.C03.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (302)..(302): a, c, t, g, unknown or other
  misc_feature (302)..(302): n is a, c, g, or t
  modified_base (329)..(329): a, c, t, g, unknown or other
  misc_feature (329)..(329): n is a, c, g, or t
  modified_base (386)..(386): a, c, t, g, unknown or other
  misc_feature (386)..(386): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccaccctgtctgtgtctccgaggggaaangtcaccctntcctgcagggccagtgagagtcttgacagctccttagcctaggaccaacaaaggcctggccagccctcccgaggcctcctctatttangataccatcccacagggccacgtggtntcccagccaggttacacgtggcggtggtcgtggggacaggtgttcacgtctcgaccntcacgcacgcctgcctagtctagtaagttatttttaacgtatttttactacgtgtacagtctaagttacttaggtaagttcgggtaactccgggttacggtttacggacccgtaagggggtaaccctaaggggtaggttaaccgtaccgtaaaaaccggtagttcgggtacgggacgtttacggaacctacccgtaagttaccccggtttacggttacccttttccgtaaccttttccccgttttaacccccgcttaacggtttaccc

SEQ ID NO: 161663 - DNA, 632 bp, Homo sapiens
  misc_feature: GYAE6OF01D094Y.48.25.C03.1.454.CMB.1.raw
  modified_base (285)..(285): a, c, t, g, unknown or other
  misc_feature (285)..(285): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaagagtcaccctctcctgcgagggccagtgagagtcttgacagctccttagcctacggtaaccaacgaaacggcctggccacgccctaccgaggcctcctctatttangatacactccaacgagggccctagtcggtcgtcccagccgaggttcacgtgggcgggttgggtcgtagggactaggtacgttcacttccgtcaaccctatacgacgcgacgtcctggactagtctaggtaaagtttatttttactaatttttacttaccgtagtcaagtcctaagttagtacggtaagtcggtacttccggtaggtttcggaccgaagggactagggtcgaaagtacaaggtactgggtacgcgtacgacctaaccgtattcgttacgtttccttacgtacgtttccccctaccgcttatccgtagtactttaagttacggtacttacgtgtacggg

SEQ ID NO: 161664 - DNA, 462 bp, Homo sapiens
  misc_feature: GYAE6OF01A422M.48.25.C03.1.454.CMB.1.raw
  modified_base (220)..(220): a, c, t, g, unknown or other
  misc_feature (220)..(220): n is a, c, g, or t
  modified_base (223)..(223): a, c, t, g, unknown or other
  misc_feature (223)..(223): n is a, c, g, or t
  modified_base (226)..(226): a, c, t, g, unknown or other
  misc_feature (226)..(226): n is a, c, g, or t
  modified_base (228)..(228): a, c, t, g, unknown or other
  misc_feature (228)..(228): n is a, c, g, or t
  modified_base (231)..(231): a, c, t, g, unknown or other
  misc_feature (231)..(231): n is a, c, g, or t
  modified_base (235)..(235): a, c, t, g, unknown or other
  misc_feature (235)..(235): n is a, c, g, or t
  modified_base (239)..(240): a, c, t, g, unknown or other
  misc_feature (239)..(240): n is a, c, g, or t
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (274)..(274): a, c, t, g, unknown or other
  misc_feature (274)..(274): n is a, c, g, or t
  modified_base (276)..(276): a, c, t, g, unknown or other
  misc_feature (276)..(276): n is a, c, g, or t
  modified_base (278)..(278): a, c, t, g, unknown or other
  misc_feature (278)..(278): n is a, c, g, or t
  modified_base (280)..(280): a, c, t, g, unknown or other
  misc_feature (280)..(280): n is a, c, g, or t
  modified_base (282)..(283): a, c, t, g, unknown or other
  misc_feature (282)..(283): n is a, c, g, or t
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (386)..(387): a, c, t, g, unknown or other
  misc_feature (386)..(387): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (429)..(429): a, c, t, g, unknown or other
  misc_feature (429)..(429): n is a, c, g, or t
tcagagtatacatacacgaccggtgctcgattttagtagtgtagatttgggtttgggggatcaggacctcctcagttcaccttctcacaatgaggctcctgctcagctcctgggctgctaatgctcgtggtcccaggactgtgctgcaccatctgtacttcgactcttccgcatctgatatgtatactctgagcgggctggcaaggccgctagtacgctnctncancntgnacgncgtnntnctancgtgcgancgagccngtacancgtaggngngngngnnctgtatcgtacgtgacgacganatntacacacncncgcgngcgcncncncncacncacgacacacacgacgacgtacgacgactacgacgtacncgcngtagnngacgcgacgcgacgtacgtcgtcgtgtngntacgacgacganacgcgcgacgcgtactacacactacgtcgtacg

SEQ ID NO: 161665 - DNA, 781 bp, Homo sapiens
  misc_feature: GYAE6OF01C16P3.48.25.C03.1.454.CMB.1.raw
  modified_base (285)..(285): a, c, t, g, unknown or other
  misc_feature (285)..(285): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaagagtccacctctcctgcgagggccagtgagagtcttgacagctccttagcctaggtaccaacgaacggcctggccacgccctccgaggccttcctactattttaancgtaataccactaccgaaccgacggggcccctacggtcgggtccgtaccccacggtacccgtaacggttccgtaacggtcggggtccgggttcggggttccgtacggggactaggtacgtttacaccttctaccaacctagtccacggacacggtccctacggaccgtaacggttaccggtaagtttaacgtttttaactttaacgtttttaactttaacgttacgttaccgttacgtacgttacggtaacgttaccggttaaagggttaccggtaccgttaccgggttaccggtttacgggtaccggtaaaccgggtaacggtaacggggtaacggtaacggtaaaccgtaacgggtaaacgttcgtacgggtacgtccgtacctaccgtattcccgttagttaccgttaccgtaccgtttccgttaccccgtacccgttcgttaccgttgtaacgtttactttacggttaacttaccgttcgtgggtacccggg

SEQ ID NO: 161666 - DNA, 844 bp, Homo sapiens
  misc_feature: GYAE6OF01CDSHV.48.25.C03.1.454.CMB.1.raw
tcagagtatacatacacgaccggtgctcgatttagtagtgtagatttgggtttggggagacggaaccatggaagccccagcgcagcttctcttcctcctgctactctggcctccagattccactggacaaatagtgatgacgcacgtcccagccaccctgcctgtgtcctacgaaggggaaagacgtccaccctctcctggcgagggccaggtgagagtctagacagtctcgttacgccgtaggaaccaaagaaacggccgtacgggaccacgcccctaccgacggtcctaccttactattttaagagtaactaaccacgtacccgaaccggacgggtacccctaacggttcgggtaccgtacccgaacggtaccgtaacgggtttaccaacggtcggggccggggttacgggttaccgaagggggtaacctaaggttaccgttacctaccgttaccgtaccaacctaagtaccgaagtaccgaacggtccttaggactacggttacgtaaagtaacgtttaactttttaacttaattttactaaccggttcggtaacaaggttaccgttaaaggttaacgttaaccgggtttaaggtcccggtaacgttcccggggtttaaacgttaccggggaaacccggtaaacgggggtaacgtaaaacgggggtttacgggaaaaccgttaaaccggtaaaacgggacggttttaggggacccggtacgttaaccgaacccttaacgtacggttcgttaaccggtttttaccaacccggttacctttccccgttacccgaactttaagttcctaaaggtatttaacgtagttaccgttctcggacgggg

SEQ ID NO: 161667 - DNA, 731 bp, Homo sapiens
  misc_feature: GYAE6OF01C5V5D.48.25.C03.1.454.CMB.1.raw
  modified_base (181)..(181): a, c, t, g, unknown or other
  misc_feature (181)..(181): n is a, c, g, or t
  modified_base (214)..(214): a, c, t, g, unknown or other
  misc_feature (214)..(214): n is a, c, g, or t
tcagagtatacatacacgaccggtgctcgatttagtagtgtagatttgggtttggggagacggaaccatggaagccccagcgcagcttctcttcctcctgctactctggcctcccagattccactggacaaatagtgatgacgcacgtcccagccacctgtctgtcgtcacgaggggaaanctccaccctctcctgaccgaggccaagtgaagntctgacagtctccgttagcctaggtaaccaacgaaacggtcctcggaccacgtcccgtaccgaggtcctactactatttagacgtaactacctactaccgaaccggacgggacctaggtcggttaccacccgtaaacgtccgtaacggtttaccgacggttcggggtaccggtttaggggtacctaggggaaactacgggtttaatacccgactttacccgactaacccggatacccgtaaggccctaacgccgttaacggacgtttacgtacgtaagttaaagtttacgttttaactaacttttacgtagtaccgtagacgtataagtataacggtagtacgtaccgtacggtacgttacgaacccgtaaggacgtaagggtacgaaagtaaccgaacggtacgtgaccggtataacgcccaaggttctgttaccgtcttacccacggtttacccaccggttactacggttctaacggtaagtttaacctattttaacccgtacgtcggttacggg

SEQ ID NO: 161668 - DNA, 977 bp, Homo sapiens
  misc_feature: GYAE6OF01EMRB5.48.25.C03.1.454.CMB.1.raw
  modified_base (207)..(207): a, c, t, g, unknown or other
  misc_feature (207)..(207): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagacttccactggaacaaatagtgatgacgcacgtccccagccacctgtctgtcgtctccgaaggggaanacgtccaccctctctgacgaggaccagtgagtagttcttaggaacctagtcctacgtttacgccgttaacggtaaacccaaaccgtaaaacggtcccgtacggacccgacgtccccgtacccgaggtcccttaccttaacttacttttactacggtaactaacctacgtaccccgaaccggtacggggtacccctaccggtttcgggtacccgtcccgtaaccggtacccggttaacggtttacccggtaaccgggttcgggggttacccgggggtttacggggttacggtaaaccgggggtaacccgttaacgggttaacggtttacccctaaccgttaaccgttaacccaaacccgtaacgtttaccccggaacggttaccccgtaaccggttacccggtagtaaccccggttaaagggtttaccgttaaagttaaaaccggttttaacttttttaaacccgttaagtttttaaaccgttacccgtttacgggttaaccggttaacgtaacccgttaagggttttaaccggttaccggtttaaagggtttccgggtaaacccgtttcccggggttaaaccgggtttaccggggaaacccgtaaaacgggggtaaacccggttaaggggtaaaccggttaaacgaaaacccgttaaacgggtacggttaggtaccgggttacgttaccgaacccgtttaaccgtaccgtttacgtacgggttttcccttaaccgtactttaccccccgtcgtaaaccgttacgttacgg

SEQ ID NO: 161669 - DNA, 782 bp, Homo sapiens
  misc_feature: GYAE6OF01DD1VE.48.25.C03.1.454.CMB.1.raw
  modified_base (164)..(164): a, c, t, g, unknown or other
  misc_feature (164)..(164): n is a, c, g, or t
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctccagattccactggacaaatagtgatgacncacgtcccagccacctgtctgtgtctcgagggaaangtccaccctntcgtgcgaggccagtgagngtctgacngtctccgtagcctacggtaaccaacgaagccgtggccacgccgtcccgacggcctccgtatacttttagtacgtactacctactacccgaccgacggccctacgtggtccgtaccccgacgcccgtaaggttccgacggttcggggtcggttcgggtgtacggggactacggtacgtttaccacgtctacacccgtagtacgacggaccgtacgtccgtgtaccgtaggttccgttaagttaacgtttaactttttaacgtttaatttttaacgttacgtacggttactaacggtacgttaacggtttaacgttaacggttaaggtttaccgggtaaccgttttccccggggttaacggtttaccgggaacccgggtaaaacgggtacccggttaaagggttaacggtaaacggtaaacggtaaaccggtacggttacgggtaacggtacccgtacgtaccccgtaaccgtttcgttacccgttccggttttaccgtacccctttacgttacccccggtttccccctaacgttcgtttaacccgg

SEQ ID NO: 161670 - DNA, 732 bp, Homo sapiens
  misc_feature: GYAE6OF01C5Z0Z.48.25.C03.1.454.CMB.1.raw
  modified_base (707)..(707): a, c, t, g, unknown or other
  misc_feature (707)..(707): n is a, c, g, or t
tcagagtatacatacacgaccggtgctcgatttagtagtgtagatttgggtttggggagacggaaccatggaagccccagcgcagcttctcttcctcctgctactctggctcccagacaccaccggagaaattgtgttgacgcagtctccaggcaccctgtctttgtctccgaggggaagcgccaccctctcctgtagggccagtcagaatgttaagacgccacttccttacgccgtaggtaaccagaaccaaaaaccgtcggaccacgcctcccgaggtcctcctacatcctagtgggtcgccggtaccaccgacgggccctacgtcggccaacgtcccaaggaccgtacggtcgaggtcggacgtagggttgggtacgtgggaacacgtacgttcactacctacacctacgtaccgaccgagtacgtacggacgtccgtagtacgttgttaacgttttgtacgttagtttcgtttttcgacgtacgtagtacgtaggttacgtaagggtaacctttccgaccgttggtaacgttaccgtaccgggacggtaaacgggaaccgtaagggttaacggtaaactaaaccggtaacgtaacgttcggtacgtcgttaaccgactaaccgtacttaccggttacttaccggtaccttaccgttcccttaccccgtcgttaaacgtttcccgttaagtacgttaaacgttnttaaaccgttgtcgggttaaccggg

SEQ ID NO: 161671 - DNA, 530 bp, Homo sapiens
  misc_feature: GYAE6OF01BFVA4.48.25.C03.1.454.CMB.1.raw
  modified_base (205)..(205): a, c, t, g, unknown or other
  misc_feature (205)..(205): n is a, c, g, or t
  modified_base (299)..(299): a, c, t, g, unknown or other
  misc_feature (299)..(299): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (507)..(507): a, c, t, g, unknown or other
  misc_feature (507)..(507): n is a, c, g, or t
  modified_base (511)..(511): a, c, t, g, unknown or other
  misc_feature (511)..(511): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgagggggaaangtccaccctctcctgcagggccagtgagagtctgacagctccttagcctggtaccaacaaaggcctggccagccctcccaggctcctcatttangatacatccaccagggccacgtggtctcccagccaggttcacgtgggcggtggtctggggacagngttcactcncaccatcagcagcctgctagtctagaagttattttactattttatactgtacagtctagtatcggtaagtcgactcgtagttcggaccgtaagggaccaagggtgaacgtacaaacgtacgtggcgctgcactntctntcttcatccttccntntcg

SEQ ID NO: 161672 - DNA, 604 bp, Homo sapiens
  misc_feature: GYAE6OF01DIRNU.48.25.C03.1.454.CMB.1.raw
  modified_base (206)..(206): a, c, t, g, unknown or other
  misc_feature (206)..(206): n is a, c, g, or t
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaagggggaaangtccaccctctcctgcagggccagtgagngtctgacngctctagcctggacaanaagcctggccagcctccagctcctnatttangatacatcccacgaggccagtggtcgtacccagccgtaggtccacgtgggcggtggtcgtggggacaggtcgttcactctacaccgtatcgagcagtccctgccagttcgtagtaacgttatttttaactatttttaactacgttcgtactacgtactagttacgtacggtaaggttcggtaccgttaccggttacggtttaccgggacgtaacgggtaccgaagggttacggaacgtacgaaaaccgtagtcggtaggcgtacggactacgtacgttcgttgttccttactacgttcccttacccgctatcg

SEQ ID NO: 161673 - DNA, 762 bp, Homo sapiens
  misc_feature: GYAE6OF01EZHEC.48.25.C03.1.454.CMB.1.raw
  modified_base (208)..(208): a, c, t, g, unknown or other
  misc_feature (208)..(208): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccacgtggacaaatgtgatgacgcacgtccccagccaccctgtctgtcgtctacgaaggggaaacncgtccaccctctcctgcgacgggcctaggtgagtacgttcttagactagtccttaccgttagccgttaaggaacccaaacgaaacggtcctacggcccaacgccctacccgaggtcccttaccgtactatttacgtacgtaactacctacgtacccgaaccgtacgggccctaaccgttcgggtcctaccccgacgtaccgtacggttaccgacggttcggggcgggttcgggtccggtaggggaaccgtacggtacgttacccgtaaccttccgtaacaaccctagttaccgaagccgtacgtccgtacgtcgtacgtacgtacgtaagttaacttttaactttaacgtttaactttacgttacgtacgtacgtacgtacgttacgttacggttaacggtacgtacgttaccgttacgttacggaccggtaacggacgtaacggtaacgtaacgtaacgtaacgacgtacggtacgtacgtacgtacaccgttttttttcaccgttacgttaccgttacgttaccgttacccgttacccgtaccgtcgttacg

SEQ ID NO: 161674 - DNA, 587 bp, Homo sapiens
  misc_feature: GYAE6OF01D3DUR.48.25.C03.1.454.CMB.1.raw
  modified_base (204)..(204): a, c, t, g, unknown or other
  misc_feature (204)..(204): n is a, c, g, or t
  modified_base (555)..(555): a, c, t, g, unknown or other
  misc_feature (555)..(555): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccagggggaaangtcaccctctcctgcagggccagtgagagtcttgacagcttccttagcctggtaaccaacaaacggcctggccacgtccctcccgaggcctcctctattttatgaataccatcccaccgacgggccacgtcggtcgtacccagccgtacggtcacgtgggcggtggtcgtggggacaggtacgttcacttctccaaccatacgagtcacgcctgactagtctagaaagttattttactattttaatcgtgtactagactagtagtcgtaagtggacttccgtacgttcggaccgtaagggaccgtaagggtacggaacgtacgaaacgtacgttggtagcgtgaccaactntcctgttacctctacttcccttcccgctgtcg

SEQ ID NO: 161675 - DNA, 608 bp, Homo sapiens
  misc_feature: GYAE6OF01AEDMA.48.25.C03.1.454.CMB.1.raw
  modified_base (308)..(308): a, c, t, g, unknown or other
  misc_feature (308)..(308): n is a, c, g, or t
  modified_base (549)..(549): a, c, t, g, unknown or other
  misc_feature (549)..(549): n is a, c, g, or t
  modified_base (565)..(565): a, c, t, g, unknown or other
  misc_feature (565)..(565): n is a, c, g, or t
  modified_base (604)..(604): a, c, t, g, unknown or other
  misc_feature (604)..(604): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccaccctgtctgtgtctccgaggggaaagagtcacccctctcctgcgagggccagtgagagtctgacagcctccttagcctggtaaccaacaaacggcctggcccagccctcccgaggcctcctctatttangactacactcccaccgagggcccacgtggtccgtccccagccgtaggttccaccgtcggggtcgggtggggtcctaggggacaggtagttccactctccaccatcgagcacgcctgacagtctagaatttattttaactattttactacttgtactagctagtacgttacgtaaggtcggtacttccggtacggtttcggaccgtaagggaccctagggtacgaagtaccaaagcttaggngcgttcggccaccgtnttcgtcgttccttaccacgtttcccccttcccgccgttntccg

SEQ ID NO: 161676 - DNA, 583 bp, Homo sapiens
  misc_feature: GYAE6OF01EH4Z8.48.25.C03.1.454.CMB.1.raw
  modified_base (245)..(245): a, c, t, g, unknown or other
  misc_feature (245)..(245): n is a, c, g, or t
  modified_base (465)..(465): a, c, t, g, unknown or other
  misc_feature (465)..(465): n is a, c, g, or t
  modified_base (559)..(559): a, c, t, g, unknown or other
  misc_feature (559)..(559): n is a, c, g, or t
  modified_base (575)..(575): a, c, t, g, unknown or other
  misc_feature (575)..(575): n is a, c, g, or t
  modified_base (579)..(579): a, c, t, g, unknown or other
  misc_feature (579)..(579): n is a, c, g, or t
tcagagtatacatacacgaccggtgctcgatttagtagtgtagatttgggtttgggggaggaactgctcagttaggacccagacggaaccatggaagcccccagcgcagcttctcttcctcctgctactctggctcccagattccactggacaaatagtgatgacgcagtccccagccaccctgtctgtgtctccgaaggggaaagagtccaccctctcctgcagggccagtgagagtcttgacngctccttagcctggtaccaacaaggcctggccagccctcccgaggtcctcctctatttatgaatacactcccaaccgacgggccctacgtcggtcgtccccagtccgtaggttccacgtcgggcgggtggtcgtgggacaggtcgttcactcgtacaccatcagcagccgtgctagtctagtaagtttattttacgtaattttattacttgtactacgtntagtacttacggtaagtcgtaccgttcggtagttcggacgtaagggtacgaaggtgaacgtaacaacgtatcggagtcgtcgacactgtcgttntcttcacttccgtccncgtntacg

SEQ ID NO: 161677 - DNA, 689 bp, Homo sapiens
  misc_feature: GYAE6OF01A5894.48.25.C03.1.454.CMB.1.raw
  modified_base (181)..(181): a, c, t, g, unknown or other
  misc_feature (181)..(181): n is a, c, g, or t
  modified_base (191)..(191): a, c, t, g, unknown or other
  misc_feature (191)..(191): n is a, c, g, or t
  modified_base (282)..(282): a, c, t, g, unknown or other
  misc_feature (282)..(282): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaanagtcaccctntcctgcagggccagtgagagtcttgacagcttccttagcctggtaaccaaacaaggcctggcccagccctcccaggcctcctactatttangaatacatccaccgaggccacgtggtcgccagccaggttccacgtggcggtggtctgggacaggagttcactcgtcaccatcagcagcctgctagtctagaatacttttactatttactacttgtctagtactagtacgtacgttaaggtcgtaaccgttccggtaacggtttcgggaaccgtaaacggggtaacccgtaaagggttaggggtaaacgttaaccgaaaaaccggttacgttacgggttaccggaccgttacggacccttaaacccgtacgttaccgtttacgttacccgtttaaccgaaccgttttcccccgtttaccccccgggtacccttaacgttacccgttacggttaacgtttacgttaaacggtttaacctttaccggttacccgtagggg

SEQ ID NO: 161678 - DNA, 668 bp, Homo sapiens
  misc_feature: GYAE6OF01CRPIN.48.25.C03.1.454.CMB.1.raw
  modified_base (204)..(204): a, c, t, g, unknown or other
  misc_feature (204)..(204): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaaggggaanagtccaccctctcctgcagggccagtgagtagtcttgacagcttcctagcctggtaaccaacaaggcctggcccacggtccctccccgaggtcctacccgtctaatttatcgaacttacactcccaaccggacgggtacccacgttcggtccgtcccaggccctaggtccacggtgggcggttgggtctaggggactagtacgttcactcctaccactatcagcacgcctagctagtctagtaagttacttttattattttactacgttgtaccgtagtctaagtcgttaacggtagttacgggtaccttacccgggtacggtttacgggaaccggtaacgggaaccgttaacggggtacggtaacggtaaccgtaaaaccggtacgtacgggtaggacgtcgacctaacgtacttcgttacgttccgtttactacccgttcccttaccccgcttaacgttacg

SEQ ID NO: 161679 - DNA, 858 bp, Homo sapiens
  misc_feature: GYAE6OF01BPG9C.48.25.C03.1.454.CMB.1.raw
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcacgtccccagcccaccctgtctgtcgtctaccgaggggaaatcgtccaccctctcctgcaggccagtgagagtctgacagtcctccgttagcctaggtaaccaacgaacggcctacggaccacgccctcccgacggtccttacctacttactttagacgtactacacttacccgaccgacgggcctaacgtcggtaccgtcccgacgccgttacggttccacgggtcgggtcggggttacgggtccggtaggggtaacgacggttacggttacctaccgtaccgttacccgaacctacgtacccggagtacccggtaacggtcccgttacggacccgttaggttaccgttaaaggtttaaacgttttaacgtttttaaacccttttaagttttttaaccgtttaaccgttacggttaaccgttaacgtacgtttaacggtttaacggttaaccgggtttaacggttaacccgggtttaacccgttttaaccccgggttaaccgggtttttaacccggggaaacccgggttaaacggggttaaccgggttaaacggggttaacgggtaaacccggttaacgtaaaaaccgggtaccgtttggggtaaccggtccgttaccgacccgtaacgttccggttacgttccgttaacccttactacccgttttccccgtacccgtattccgttaaccg

SEQ ID NO: 161680 - DNA, 665 bp, Homo sapiens
  misc_feature: GYAE6OF01DRDBZ.48.25.C03.1.454.CMB.1.raw
  modified_base (347)..(347): a, c, t, g, unknown or other
  misc_feature (347)..(347): n is a, c, g, or t
tcagagtatacatacacgaccggtgctcgatttagtagtgtagatttgggtttggggagacggaaccatggaagccccagcgcagcttctcttcctcctgctactctggctcccagattccactggacaatagtgatgacgcagtccccagccaccctgtctgtgtctccaggggaaagagtcaccctctcctgtagggccagtcagaatgttaagagccactccttagcctggtaccagcaaaacctggccagcctccagctcctcatctatggtgcgtccaccgaggccacgtggcactcccgagacgaggttcaggtggctaggtcggtcgtggacagacttcnctctcacactcaccagactggactccgtagattgtaattttcgacttagtttcgtttttacgtcgttacgtagtcgtaagtttaagtacgggtaaacgtttccgaacccggttacggtaacgtacggttttcccgggacccggtaacgggggtaaccgtaaaacggggttacggtaaaaacgttaccgtaaaaccggttaaccggttacgggttacgggaccttacggacccgtaccgtacgttccgttacggttcctttaccgacgtttcccctaccgtccctaacgttcgttacgagtttactcgttagttaaccg

SEQ ID NO: 161681 - DNA, 791 bp, Homo sapiens
  misc_feature: GYAE6OF01AQ0JJ.48.25.C03.1.454.CMB.1.raw
  modified_base (181)..(181): a, c, t, g, unknown or other
  misc_feature (181)..(181): n is a, c, g, or t
  modified_base (763)..(763): a, c, t, g, unknown or other
  misc_feature (763)..(763): n is a, c, g, or t
  modified_base (777)..(777): a, c, t, g, unknown or other
  misc_feature (777)..(777): n is a, c, g, or t
tcagagtatacatacacgaccggtgctcgatttagtagtgtagatttgggtttgggggagacggaaccatggaagccccagcgcagcttctcttcctcctgctactctggctcccagattccactggacaaatagtgatgacgcagtccccagccaccctgtctgtgtctcgaggggaaanagtccaccctctcgtgcgagggccagtgagagtcttagacagtctccttagccgtaggtaaccaacgaacggcctggacccacgcccgttacccgaggtccttcctacgttaacttttaagtacgtaacttaacctacttaccccgaaacccggtacgggggtaccccctaacggttcgggggtttaccgacccccgtaacggcccgttaacgggtttaccaaccgggttcgggggttaccggggtttacggggtaccgttaaggggtaaccgtaacgggttaccgtttacccaaccgtttcccgtaaccaaaccggtaactcccggaacgacccgtaacgtcccttacgggacgttacggttacgtaaggttaaacgtttaacttttttaacgttaatttttaacgttacgttcgtacgtaagttacgtaagtttacggtacggttaagttcgggtaccttaccggtacggttacggacgtaacgggtaaccgaagggttacgaacgtaacgtaacggtagtcggtacgtctacggacgtacttagtacttcgttactacgttacctcccgttcacttacncttagactttagtnttaactgtggtcgg

SEQ ID NO: 161682 - DNA, 709 bp, Homo sapiens
  misc_feature: GYAE6OF01C2P2F.48.25.C03.1.454.CMB.1.raw
  modified_base (184)..(184): a, c, t, g, unknown or other
  misc_feature (184)..(184): n is a, c, g, or t
  modified_base (445)..(445): a, c, t, g, unknown or other
  misc_feature (445)..(445): n is a, c, g, or t
  modified_base (516)..(516): a, c, t, g, unknown or other
  misc_feature (516)..(516): n is a, c, g, or t
tcagagtatacatacacgaccggtgctcgatttagtagtgtagatttgggtttggggagacggaaccatggaagccccagcgcagcttctcttcctcctgctactctggcctcccagattccactggacaaatagtgatgacgcacgtcccagcccaccctgtctgtgtctccgaaggggaaanacgtccaccctctcctgcgagggccaggtgagagtctgacagcttcttagccgtacggtaaccaaacgaacggtcctcggaccgaacgccctacccgacggtccttaccctacttatttactagaactactaccgtaccacccggacgggtcctaacggttcggtaccgtacccgacggtccgtaacggttccgaacggttcggggtcgggttcgggttacgacggggaactaggtacgttacctacgttccacctaaccncgtacacgtccacgtccgtacgactacgtacgtagtaactttaattttaacttaattttacttactacgtntaagtacgtaagttacgtacggtaaggtcgtaccgttacggtacggttacgacggaacggtacgagggtacgaacgtaacgaacgtagtgtacgtactcgacctacgagttccttacgttactaccgtccgttaccctcccggtacttaccgttacgttagtacgttattacctaacgttccgtaggtacggg

SEQ ID NO: 161683 - DNA, 620 bp, Homo sapiens
  misc_feature: GYAE6OF01BCQ8T.48.25.C03.1.454.CMB.1.raw
  modified_base (184)..(184): a, c, t, g, unknown or other
  misc_feature (184)..(184): n is a, c, g, or t
  modified_base (222)..(222): a, c, t, g, unknown or other
  misc_feature (222)..(222): n is a, c, g, or t
  modified_base (284)..(284): a, c, t, g, unknown or other
  misc_feature (284)..(284): n is a, c, g, or t
tcagagtatacatacacgaccggtgctcgatttagtagtgtagatttgggtttgggggaggacgggaaccatggaagccccagcgcagcttctcttcctcctgctactctggctcccagattccactggacaaatagtgatgacgcagtccccagccaccctgtctgtgtctccgaaggggaanagtccaccctctcctgcagggccagtgagagtctgacngctcctagcctaggtaccaacaaggcctaggaccagccctccgaggtcctacctatatttangaactacactcccacgagggcctagtggtctacccagcctaggttcacgtggcgtggtcagggacagtagtcactctcacatcagcagcctagcagtctagaacttattttactattttactactgtacagtactaagtacgtacggtaagtcggtaccttaccggtagtttcggaccgtaaacgggtaccgtaagggtaggtaaacgtacgaaaacggtacgtagggtacggtactacggacctaaccgtagtccgttcgttaccttacgacctttcccgttaccccgacttacttccgtacgtaacttagttacgttaactccgttcggtacgg

SEQ ID NO: 161684 - DNA, 782 bp, Homo sapiens
  misc_feature: GYAE6OF01DXF3D.48.25.C03.1.454.CMB.1.raw
  modified_base (184)..(184): a, c, t, g, unknown or other
  misc_feature (184)..(184): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcacgtccccagccaccctgtctgtcgtctccgaaggggaaangtccaccctctcctgcagggccaggtgagtagtcgttgacagtccttaccttagccgttacggtaaccgaaacaaacgggtcccgtcgggaccaacggtccctaccccgaggtcccttccctacttaattttaagtacgtaacttaaccacttaccccgaaccggacgggacccttacgtcggtcgtaccccaggccctaggttccacggttcgggacgggttcgggtacgtacggggaactaggtacgttacctacctctaccaaccgtacgtccgaacgtaccggaccgtaccttaggaccgtagttccgttaaggtaaacgttttaactttttacgtttaattttacgttacgtcgtaacaggttaccgtagttacgttacgtaaacgtcgggtacctttaccggtacgtttacggaaccggaacggtaccgggaaggtaacggtaattaaccgaaacgtacggtcgtacggtcctacggacctaaccgttgtccgttacgttaaccctttcgtaccctttcccggtaccccggtcttaaacgtttcggtaactacgtttaacggttaagtttacccttcgtcgggttaacgggg

SEQ ID NO: 161685 - DNA, 736 bp, Homo sapiens
  misc_feature: GYAE6OF01A0R6T.48.25.C03.1.454.CMB.1.raw
  modified_base (190)..(190): a, c, t, g, unknown or other
  misc_feature (190)..(190): n is a, c, g, or t
  modified_base (229)..(229): a, c, t, g, unknown or other
  misc_feature (229)..(229): n is a, c, g, or t
  modified_base (294)..(294): a, c, t, g, unknown or other
  misc_feature (294)..(294): n is a, c, g, or t
tcagagtatacatacacgaccggtgctcgatttagtagtgtagatttgggtttgggagtacggaaccattggaagccccagcgcagcttctcttcctcctgctactcgtggctcccagattccagtggaccaaatagtgatgacgcagtccccagtcccacccgtgtcctgtgtctccgaggggtaaagngtccaccctctccgtgcagggcccagtgagagtctgacnggctcctagcctaggtaccaagaagcctggaccaagacctcccgaggtcctccgtatactttagnggaactaccactccccaaccgagggtcccctacgtgggtacctacccaacggacccaagggttccacgtagggtcgggttacgggtcgtacgggaactaagtacgttacacctccgtacaaccgtagtcgaacggcacggtctgtactacgttcgtagtacggttaacttttaacttattttaccgttacgtcgtacgtacgtaaccgtagttaacggttacggttaaagggttccggtaccgttaccgggttacggttaccggaacccggtaacgggtaacgtaacgggttacggaaacgtacccgtaaaccggtacgttccggacggtaccccgtaagccctaacctacggttcccgtcgttccgttcccgtaccgttaccctcccggtacctagttcccctaggtaccttacggttacaacttcccggtaggtaccggg

SEQ ID NO: 161686 - DNA, 662 bp, Homo sapiens
  misc_feature: GYAE6OF01DRGIJ.48.25.C03.1.454.CMB.1.raw
  modified_base (179)..(179): a, c, t, g, unknown or other
  misc_feature (179)..(179): n is a, c, g, or t
  modified_base (282)..(282): a, c, t, g, unknown or other
  misc_feature (282)..(282): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctcaggggaaanagtcaccctctcctgcagggccagtgagagtcttgacagctccttagcctaggtaccaaacaaggcctggcccagccctccgaggtcctcctactaattttanagaatacatccccaacgacgggccctacgttaggtccgtacccagccgtaggtttcacggtgggcgggttgggtcctaggggactaggtacgttcgaaccttctaccaaccgtatccgacgctacggcctgacgtagtcgtagaaacgtttattttacttaattttattacgttgttacgtagtactagttacgttaggtaaggttcggtaccgtccggtacgtttcggaccggtaacgggacgtaagggtaggtaaacgtacgtaaaacggtagttagtaggtacacgtacctaccgttagtctacgttaccttacgtaccttcccgttacccgtacctagttccgttagtaacttacgttgttaacttcgtgtacggg

SEQ ID NO: 161687 - DNA, 804 bp, Homo sapiens
  misc_feature: GYAE6OF01DU628.48.25.C03.1.454.CMB.1.raw
  modified_base (181)..(181): a, c, t, g, unknown or other
  misc_feature (181)..(181): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcacgtccccagccacctgtctgtgtctccgaaggggaancgtccaccctctctgcgaggcagtgagtgtcttgacagtccttcgttacgccgtacggtaaccaaacgaacggtcctcggccacgtccctccgacggtcccttccgtactattttacagtaactaccactaccccgaaccggtacgggccctacggttcgggtccgtacccgacggtcccgttaggttccacgggttggggtaccggggttcgggttacggtacggggtaactaacgggttacctttccgaccttccgtaaccaaccgtaactaccgacgtaccgtacggtccgtaggtacctaacggttcgtaaggttaaacgttttactttttaactttaactttttacgtacgtttacgtaccgtacgttacgttaacggttaacgttacggttaaacggtccgggttaacccgttaccgggttaacggtttaccgggaaccggtaaacgggtaaccggtaagggtacggtaaacgtaaccgtaaacggtacgttacgggtacgtaccgtacgtacctaacgttcgtttccgtacgtttaccttacccgtaccgtttccccgtacccgtacttacgttacgttagttaacttacgtacgtttacctcgttcggtaacggg

SEQ ID NO: 161688 - DNA, 698 bp, Homo sapiens
  misc_feature: GYAE6OF01D59WJ.48.25.C03.1.454.CMB.1.raw
  modified_base (313)..(313): a, c, t, g, unknown or other
  misc_feature (313)..(313): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccaccctgtctgtgtctccgaaggggaaagagtccacccttctcctgcgagggccaggtgagtgtcttgacagcctccttagcctaggtaccaacgaaggcctcggccacgccctcccgaggtcctcctctatttangactacactcccgaaccgacgggacctacgtggtcctaccccgagcccgtaggttcacggttgggacgggttgggtcgtagggacacgtacgttcaccttcacacctagtcgacgcgacgtcctgactagttacgtagtaagtttaacttttaacttaatttttacgttacgtcgttacgtaggtcgttacgttagttacgggttaaggttaccgggtaccgtttacccgggttacggtttaccgggaaccgtaaacggggtaacgtaaggggttacggtaacgttaaccgaaacggtacgttcgggtacggtaccgtacggacctaaccgtagtttacccgttgttacccgttactaccgttccccttacccgcttacgttacg

SEQ ID NO: 161689 - DNA, 632 bp, Homo sapiens
  misc_feature: GYAE6OF01A0L1S.48.25.C03.1.454.CMB.1.raw
  modified_base (279)..(279): a, c, t, g, unknown or other
  misc_feature (279)..(279): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaagagtcaccctctcctgcagggccagtgagagtcttgacagctccttagcctggtaaccaacaaacggcctggccacgccctcccaggctccctctatttangatacactccaccagggccatcggtcgtcccagccgtaggttccacgtggcgggtgggtcgtgggacaggtagttcactctcaccatcacgcgacgcctgcacgtctagaacgttatttttaactatttttacttacgtgtacagtctaagttagtacggttaagtcggtaccgtccgttaacggtttgggaccctaaggggacctaaggggtagaacgtaacgaaacggtacgtggtacggtcctgaccaaccgtattcgttcggttacctttacctacgtttcccccttacccgggtcctacgttccgttacggtaacttacgttttacgaactttccggttcgtacgggg

SEQ ID NO: 161690 - DNA, 800 bp, Homo sapiens
  misc_feature: GYAE6OF01DSA29.48.25.C03.1.454.CMB.1.raw
  modified_base (204)..(204): a, c, t, g, unknown or other
  misc_feature (204)..(204): n is a, c, g, or t
  modified_base (786)..(786): a, c, t, g, unknown or other
  misc_feature (786)..(786): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaangtccaccctctcctgcagggccaggtgagagtcttgacagctccttagcctggtaaccaacaaggcctggccacgcctcccaggcctcctcatttatgattacatcccaaccgacgggccctacgtcgggtacgtccccaggtccctaagggtttccaaccggttgggccggggttggggttccgtagggggtaaccaggttacgtttaccgaaccttccttaccaaccctataccgacggacctaacggtcccgttggaccctacggttaccgttaaggtaaaacggttttaacttttttaaccttaagttttttaactttaccgttaggttaccgtaacggtaacctaagggtttaactttaccgggtttaaacgggtttccgggtaacccgttttaccccggggttaaccgggtttttaccggggaacccgggttaaaacggggggtaaccccgttaaaggggggttaacggaaacggttaaccgaaaaaccgggttacgtacgggttacggtaccgtacggtaacctacctacgttccgttacgtttacccttacgttaccttccccggtttaccccnccgtagtttaccgg

SEQ ID NO: 161691 - DNA, 694 bp, Homo sapiens
  misc_feature: GYAE6OF01CJTNF.48.25.C03.1.454.CMB.1.raw
  modified_base (205)..(205): a, c, t, g, unknown or other
  misc_feature (205)..(205): n is a, c, g, or t
  modified_base (319)..(319): a, c, t, g, unknown or other
  misc_feature (319)..(319): n is a, c, g, or t
tcagagtatacatacacgaccggtgctcgatttagtagtgtagatttggggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaangtccaccctctcctgcagggccaggtgagagttcttgacagtcctccgttagcctaggtaaccaaacgaacggcctggcccacggccctcccgaggtcctcctactattttacngactacactccaaccgacgggccacgtcgggtctacccgagtcctagggttcacgtgggtcggttggtacgtacgggactagtcgtttacactctaccaccatcacgcacgtcctagcgtagtctagtaagtttacttttacgtaatttttacttacgttgtacgtagtactagttaacgttacggtaacggttcggtaaccttccgggttaacggtttacgggaacccgtaacggggtaaccgtaaggggtacgggtaaacgtaaccggtaaaccggttaagtcgggtacggtaccgtcgaaccgtaccgttaacgttccgttacggtttacccttacgttaacccttcccgttcccccgaacgttcgttaacg

SEQ ID NO: 161692 - DNA, 645 bp, Homo sapiens
  misc_feature: GYAE6OF01A4TJH.48.25.C03.1.454.CMB.1.raw
  modified_base (205)..(205): a, c, t, g, unknown or other
  misc_feature (205)..(205): n is a, c, g, or t
  modified_base (322)..(322): a, c, t, g, unknown or other
  misc_feature (322)..(322): n is a, c, g, or t
  modified_base (428)..(428): a, c, t, g, unknown or other
  misc_feature (428)..(428): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcacgtccccagccaccctgtctgtgtcctcgaggggaaancgtccaccctctcctgccgagggccaggtgagtagttcttgaccagccttccgtacgcctaggtaaccaaacaaacggcctggcccacgccctcccgaggcccttcctctatttacngattaccactcccaccgacgggcccagttggtcctccccagtccccgtaaggttccacgtcgggcggtgggtccgtaggggacagtagtttccacgttcaccaccntcacgcacgcctgctacgttcgtagtaattacttttactattttacttacgtgtcctagtctaaggttacttacggttaagtccggtaccttccggttacgttaccggaaccggtaagggaccgttaagggtacggtaaacgtacgaaaacgtgtggtcggtactcgacctactacgtcgttagttcttaccactttccctcccgtacctgttaacg

SEQ ID NO: 161693 - DNA, 749 bp, Homo sapiens
  misc_feature: GYAE6OF01CUAB0.48.25.C03.1.454.CMB.1.raw
  modified_base (182)..(182): a, c, t, g, unknown or other
  misc_feature (182)..(182): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaagngtcaccctctcctgcgagggccagtgagagtcttgacagcctccttagcctggtaaccaacgaaaggccctggccagccctcccgaggcctcctactattttactgtaatacctactacccgaaccgacgggacccctacggttcgggtcctccccgagtccgtacggttcacggttgggtccgggttggggtccgtagggggacaggtaggttccaccgttctaccgaacctatccgaacggtccacgtccgttggccgtacggttacgttaggtaaacgtttaacttttttaactaacgttttttacgtttacgtttcgttaacgtacgttacgttaaggtttacgtacggttaacggttccgggtaccgttacccgggttacggttttacggacccggtaaacgggtaccggtaagggtacggtaaacggtaaccgaaaccggtacgttacggtacggcttacggacgtaccgtacttccgttacgttccttaccgtacctttccccgttacccgtccttacgtccgttacgtacttacttagttacgttccgttcggtacggg

SEQ ID NO: 161694 - DNA, 656 bp, Homo sapiens
  misc_feature: GYAE6OF01DUPRD.48.25.C03.1.454.CMB.1.raw
  modified_base (202)..(202): a, c, t, g, unknown or other
  misc_feature (202)..(202): n is a, c, g, or t
  modified_base (466)..(466): a, c, t, g, unknown or other
  misc_feature (466)..(466): n is a, c, g, or t
  modified_base (640)..(640): a, c, t, g, unknown or other
  misc_feature (640)..(640): n is a, c, g, or t
  modified_base (647)..(647): a, c, t, g, unknown or other
  misc_feature (647)..(647): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccacctgtctgtgtctccgaggggaancgtccaccctctcctgcgacgggccagtgagtagtcttgactagctccgttagcctaggtaccaacgaacggcctcggaccacgccctccgaggtcctcctactatttgtgaactacactccgacgcggacctacgtggtactacccgagtccgaggttcacggtggacggtggtctgggactagtcgttcacctcgtacaccagtaccagccacgtctacggactacggttactagtaagtttaacttttactaacgtttttntacgtgtactagcgtaagttcgtaacggttacgcgtaccgttaccgtacggtttacgggaaccgtaacggggaccgtaaagggtaggtaaacgtaacgaaaaccggtcttgggttacgccgtaacgaccctacggttacttccggtttagttcccttacgtaccgtttaccccncccgttntactaccgg

SEQ ID NO: 161695 - DNA, 759 bp, Homo sapiens
  misc_feature: GYAE6OF01CJ0MU.48.25.C03.1.454.CMB.1.raw
  modified_base (205)..(205): a, c, t, g, unknown or other
  misc_feature (205)..(205): n is a, c, g, or t
  modified_base (416)..(416): a, c, t, g, unknown or other
  misc_feature (416)..(416): n is a, c, g, or t
tcagagtatacatacacgaccggtgctcgatttagtagtgtagatttgggtttggggggaggaactgctcagttaggacccagacggaaccatggaagccccagcgcagcttctcttcctcctgctactctggctcccagattccactggacaaatagtgatgacgcagtccccagccaccctgtctgtgtctccgaaggggaancgtccacctctcctgcagggccagtgagtgtcttgacagctccgtagcctggtaaccaacgaaaggcctggccagccctcccgaggcctcctctattatgactacactccaaccgagggccctacggtggtcgtccccacggtaccgagggttcacgtgggtccgggttcgggtcgtaggggcaagggtcttaccgactcctaccgaaccngttacgacggcctacggcccgtggactaacggttccgttaaggtaaacgtttacgtttttaaacgtttacttttttaacgtaccgtttaggttaccgtaacggtacttaacggtttacgtaccgggtttaaagggtccgggttaacccggtttaccgggttaaccggtttcgggtaaaccccggtaacgggggtaaccggttaaggggttaaaccgggtaagtaacccggtaaaaggtacccgggttaggtaaccgggtccgtaaccggcgtaaccttcggttaccgtttacttcccgtttaaccacccggttttaaccctccccgtacttcggtttacccgg

SEQ ID NO: 161696 - DNA, 605 bp, Homo sapiens
  misc_feature: GYAE6OF01ESKHB.48.25.C03.1.454.CMB.1.raw
  modified_base (181)..(181): a, c, t, g, unknown or other
  misc_feature (181)..(181): n is a, c, g, or t
  modified_base (379)..(379): a, c, t, g, unknown or other
  misc_feature (379)..(379): n is a, c, g, or t
  modified_base (421)..(421): a, c, t, g, unknown or other
  misc_feature (421)..(421): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaangtcaccctctcctgcagggccagtgagagtcttgacagctccttagcctggtaccaacaaggcctggccagcctccaggcctcctctatttatgatacatccaccagggccacgtggtcgtcccagcctaggtttcacgtcgggcgggttggtcgtagggactaggagttccacttctaccaccatcagtcacgtccngcagtctagtaagttacttttacattttacttactgtcagtntagttatcgtaagtcgtacctccgtagtttcggaccgaagggtaccctaaggggtacggaagtaccgaaacggtacgttaggtacgggtactggacctaccgagttccttacggttccttacgtacttcccgttacccggccttagttcgtacgttattacgttagttacttacgtcgtacggg

SEQ ID NO: 161697 - DNA, 627 bp, Homo sapiens
  misc_feature: GYAE6OF01CM7KL.48.25.C03.1.454.CMB.1.raw
  modified_base (180)..(180): a, c, t, g, unknown or other
  misc_feature (180)..(180): n is a, c, g, or t
  modified_base (282)..(282): a, c, t, g, unknown or other
  misc_feature (282)..(282): n is a, c, g, or t
  modified_base (428)..(428): a, c, t, g, unknown or other
  misc_feature (428)..(428): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaangtcaccctctcctgcagggccagtgagagtcttgacagctccttagcctggtaaccaacaaacggtcctgggccaggccctccaggccttcgtctattttangactaccatccaccagggccacgtggtctcccgaggcctaggttccacgttggcggtaggtcgtagggacaggtagttcactcgtacaccgtatcagcacgcctggccagtctagaactattttagtacttttatactcgtactanacgtagtatacgtagtcgacgttccgtagtttcggaccgtaagggaccgtaagggtacggaacgtaacgaaacggtacgtggtacggtctacggtactaccgtagtaccgttggttccttacgtaccgtttcccttaccccgtccgaactttaccgtacgttaacgttactttacggtttaacttcgttccgtaacggg

SEQ ID NO: 161698 - DNA, 281 bp, Homo sapiens
  misc_feature: GYAE6OF01B4JD3.48.25.C03.1.454.CMB.1.raw
  modified_base (156)..(156): a, c, t, g, unknown or other
  misc_feature (156)..(156): n is a, c, g, or t
  modified_base (250)..(281): a, c, t, g, unknown or other
  misc_feature (250)..(281): n is a, c, g, or t
tcagagtatacatacacgaccggtgctcgatttagtagtgtagatttgggtttggggggatcaggactcctcagttcaccttctcacaatgaggctccctgctcagctcctggggctgctaatgctctgggtcccaggaacctgtggctgccactntctcgttctacacttcccgttcccgctatctagtattagttagttacttacctcgtaggacgggcgggtcgtcggacgaacggccgataagtgnnnnnnnnnnnnnnnnnnnnnnnnnnnnnnnn

SEQ ID NO: 161699 - DNA, 915 bp, Homo sapiens
  misc_feature: GYAE6OF01CEERB.48.25.C03.1.454.CMB.1.raw
  modified_base (180)..(180): a, c, t, g, unknown or other
  misc_feature (180)..(180): n is a, c, g, or t
tcagagtatacatacacgaccggtgctcgatttagtagtgtagatttggggttggggagacggaaccatggaagccccagcgcagcttctcttcctcctgctactctggctcccagattccactggacaaatagtgatgacgcagtcccagccacctgtctgtgtctccgaaggggaaanagtccaccctctcctggcgacgggccaggtgagtagtcttaggacagtctccgttaacgccgttagggtaaacccaaacgtaaacgggtccctacgggcccaacggtccccgttaccccggaaagggtcccttacccccgtttataaattttttaacgtacggtaaactttaaccacttaccccgaacccgggaacggggtcccctaaccggtttggggtaccgtaccccgaggtaccccggtaacggttttaccgaaccgggttcgggggaccggggtttacgggggttaccgttacgggggaaccctagggttaaccgggtttacctaaacccggtttctaaccccgaaccgtaaacgttcccgaacggaccccgttacgacccggtaggtacccctaagggtttacccgtaaggttaaaagttttaacctttttttaactttaacgtttttttaacgttacggtttacgttaacgtaacgttacggtaacggtttaaacggtttaacgttaaacgggttaccggtttaaccggttacccgggttacggttttaaccggaacccgggttaacgggtaaccggtaagggttaacggtaaacggtaacccgaaacgggttaacgttacggttacggacgttacgaccgtaaccgtacttcgtaccgttacttacgtaccttcccgttacccgtacgtacttcgtacgtacttagttactacttcgtcgttacggg

SEQ ID NO: 161700 - DNA, 713 bp, Homo sapiens
  misc_feature: GYAE6OF01EVARR.48.25.C03.1.454.CMB.1.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctccagattccactggacaaatgtgatgacgcacgtccccagcccaccctgtctgtcgtctcgaggggaaagngtccaccctctcctgcgagggcagtgagngtctgacngtcctcttagcctggaaccaacaaggcctggccacgccctccgagtctcctctatttangactacnctacccgaccgaggccacgtcggtactccccagtccgtacggttcgacgtcgggtcgggtggtcggtagggactaggtacgtttcccacgttcctaccgacctacgttcgacgtccacggtcccgtagtaccccgttaggttacgttaaggttaaacttttacgttttttaaactttaacgttttttacgtttaccgttacggtacctaagggttacttaacggtttaggttacgtttaacgggttcggtaacccgtttccggttaacggggtttacgaaccgggtaaacggggtaccgtaaaggggttacgaaacggttacaaaacggtcgtttggacggtacgctaccgaccttagttccgttactttcccgtacttaccgttaccctcccgtacgtcttacg

SEQ ID NO: 161701 - DNA, 958 bp, Homo sapiens
  misc_feature: GYAE6OF01APH8R.48.25.C03.1.454.CMB.1.raw
  modified_base (208)..(208): a, c, t, g, unknown or other
  misc_feature (208)..(208): n is a, c, g, or t
  modified_base (946)..(946): a, c, t, g, unknown or other
  misc_feature (946)..(946): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcacgtccccagccaccctgtctgtcgtctaccgaaggggaaancgtccaccctctcctgcgagggccaggtgagtagttctgaccgagtccttccgttagccgttaacgggtaaccaaacgaaacgggtcctcggacctacgccccgttacccgacggtcccttaccgttaccttaagtttttaacgtacggtaaacttaaccgtaaccttaccccggaaacccggtaaccgggggtaccccttaaccgggtttacgggggttaccccgttaccccccggaacgggtaccccggttaacggggttttacccgtaacggggtttccggggttccggggggtttacgggggtttaccgggtaacgggggtaacccgtaaggggttacccgttttacccgtacccgttacccgtaacccgtaacctaaccggtttaccgaacgtacccgtaccgtcccgtacgtacccggtaacgtttacgttaacgggttaaacgttttaaccttttttaaacgtttaacgttttttaaactttacccggttacggtttaacccggtaacggtaccgttaaaggtttaacggtttaacgggttaacggttacccgggttacccgttttaaccggggtaccggttttaccggggaacccggtaaaacggggtccgttaaaaggggttcccggtaaaacgtaccggtaaacggtacgttcgggtacggaccgtacgacccgttaactccgttacgttccgttacccgtttactacccggtttcccttacccggtnttaaccggttcg

SEQ ID NO: 161702 - DNA, 719 bp, Homo sapiens
  misc_feature: GYAE6OF01EZVTM.48.25.C03.1.454.CMB.1.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
  modified_base (243)..(243): a, c, t, g, unknown or other
  misc_feature (243)..(243): n is a, c, g, or t
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (709)..(709): a, c, t, g, unknown or other
  misc_feature (709)..(709): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccaccctgtctgtgtctccgaggggaagngtccaccctctcctgcgagggcagtgagngtcttgacngtctccttagcctggtaaccaagaacggtcctggcccacgccctccgaggtcctcctctatttangtactaccatccaccgngggccctactgggtctcccaggcctaggttccacgtcgggcggtgggtctaggggactaggtacgtttccaccttcgtacacccgtagtccgagccgtaacgcccgttaggcctacggtctaggtaaacgttacttttttaacctagttttttactaacgttgttaacgaggttacttaacggttaacggtttaccggttaaacggttacggttaacccgttcccggggtttaacggttttccgggaacccggtaaaagggggtaacccttaaaggggtacgggtaaacggtaccgaaaaacgggtcggttaggtacgggtaccgttggaccctaacgtacgttcgtacgtttaccctacgttaacccttccctttacccccgngtaacgttcg

SEQ ID NO: 161703 - DNA, 752 bp, Homo sapiens
  misc_feature: GYAE6OF01CGQRE.48.25.C03.1.454.CMB.1.raw
tcagagtatacatacacgaccggtgctcgatttagtagtgtagatttgggtttggggagacggaaccatggaagccccagcgcagcttctcttcctcctgctactctggctcccagattccactggacaaatagtgatgacgcacgtcccagccaccctgtctgtgtctcgagggaaagagtcaccctctcctgcgaggccagtgagagtcgttgacagctccgttagcctacggtaaccaaacgaaacggtcctcggacccacggccctacccgacggtccttccctacgttaattttaacgtagtaacttaacctacttaccccgaaccggacggggacccctacgttcgggttaccgtacccccgacggtaccggtaacggtttccgaacggttcgggggtccgggttcggggttccggtacggggaaacgtacggtacgtttacctaccttcgtaccaaccctagtaccgacgcgtacgcgtcggacctaggttcgtagttaaagtttactttttaacgtttaatttttacgttacgttgtacctacgtacttaacgttacgttacggttaagtccgggttaccgttaccgggttccggtttacggaacggtaaacgggtaaccgtaagggtaacggttaacgtaaccgaaacggtacgttggacgttcgtacgactaccgtatcgttacttccgtatccgttccctccgtactgttactagtacttactagtcttacggtgtacggg

SEQ ID NO: 161704 - DNA, 858 bp, Homo sapiens
  misc_feature: GYAE6OF01AM15R.48.25.C03.1.454.CMB.1.raw
  modified_base (182)..(182): a, c, t, g, unknown or other
  misc_feature (182)..(182): n is a, c, g, or t
  modified_base (223)..(223): a, c, t, g, unknown or other
  misc_feature (223)..(223): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcacgtccccagccaccctgtctgtgtctccgaggggaaangtcaccctctccgtgcgagggccagtgagtacgtcttgacngtcttccttagcctacggtaaccaacgaacgccgtaggcccagtccctaccgaggtccttcctactactttatgaactacgactcccgaccgacgggcctaacgttcggtccgtccctacggaccgtacgggtttccaccggttcggggtaccggggttcgggttacccggtagggacctacgggttacgttaccgtaccgttcctaccaaccctacgtaccgaacgtcccgacgtcccgttcggaccgttacggttctaggttaaacgtttacttttttaaccgttaatttttaacgtaccgtttgtaaccgtacgtaacgtaacggtttaacgttaacgggttaacgggtaccgggtttaccggttacccggtttaaccggtttacgggaacccggtaaacgggggtaacgtaacggggttaacgggtaaaccgttaacccggaaacgggttaccggtacggttaccgggtaacttccggaccccgttaaaccgttcgttacccggtttaccggtttacccgttttacccgttaaccgttccccccggttttaacccgacccgtttaccgttacgtttaaacgtaactttacggtttaaccgtttaacggttacccgtttggtaacccggggg

SEQ ID NO: 161705 - DNA, 624 bp, Homo sapiens
  misc_feature: GYAE6OF01CV0O4.48.25.C03.1.454.CMB.1.raw
  modified_base (180)..(180): a, c, t, g, unknown or other
  misc_feature (180)..(180): n is a, c, g, or t
  modified_base (217)..(217): a, c, t, g, unknown or other
  misc_feature (217)..(217): n is a, c, g, or t
  modified_base (394)..(394): a, c, t, g, unknown or other
  misc_feature (394)..(394): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaangtcaccctctcctgcagggccagtgagagtcttgacngctccttagcctggtaccaaacgaaggcctggccagcctacccaggcctctactatttatgactacatacccaccgtagggacccagtggtcgtcccagcctaggttccacgttgggcggtagggtctagggacagtacgttcaactcgtacacctatcgagctacgctgctacgtntacggtaaattacttttactattttacttactagtaccaagtctagttagtacggtaagttcgggaccttacgtacggtttacggaccgtaaagggacctaagggtacggtaaagtaacgaaacgtaacgtgtacggcgtacgcaacctacttcgtagttcttccgtacgttaccttccccggacttacgtccgttagtaactttagtaattacgttacgttcgtacggg

SEQ ID NO: 161706 - DNA, 761 bp, Homo sapiens
  misc_feature: GYAE6OF01EP7G8.48.25.C03.1.454.CMB.1.raw
  modified_base (180)..(180): a, c, t, g, unknown or other
  misc_feature (180)..(180): n is a, c, g, or t
  modified_base (655)..(655): a, c, t, g, unknown or other
  misc_feature (655)..(655): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcacgtcccagccaccctgtctgtgtctccgaggggaanacgtccaccctctccgtgcgagggccaggtgagacgttcgttacggactacgtccttaccgtttacggacccttaacggtaacccaaaaccgaacggtcccgtacggacccaccggtcccctacccggaggtcccttcctacttattagtagactaccacctacccgaacccgagggtaccctacggttggtaccgtcccgacgtccgtacgttacgacggtcggggtacgttgggtacgttagggacctaggtacgttacccacttaccgaccacccgtataccgtaggccctacgtcccgtggtaccgtaggtcctagttaaacgttttactttacgttaattttacgtatcgtagacgtatacgtttagcgtaacgtcgtacgttaccgtacgttacggaaccgtacgggtaacgtaagggtacgaaacggtaccgaaacgtacggtaggtacggctaccgaccggttaacncgttcgttaccgttacttacccgtaccgtttaccccggtacccttacgtacgtttcgtaaccgtttaattccggttaaagttaccttttaccgtggggtaacccgg

SEQ ID NO: 161707 - DNA, 966 bp, Homo sapiens
  misc_feature: GYAE6OF01CKF6E.48.25.C03.1.454.CMB.1.raw
  modified_base (209)..(209): a, c, t, g, unknown or other
  misc_feature (209)..(209): n is a, c, g, or t
  modified_base (354)..(354): a, c, t, g, unknown or other
  misc_feature (354)..(354): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagacttccactggacaaatagtgatgacgcacgtccccagcccaccctgtctgtgtcctccgaaggggaaancgtccaccctctcctgcgacgggccaggtgagtagttcttgacacgtcctccgttacgccgttacggtaaccaacgaaaacggcccttgggacccacggccccttccccgaacgggtccctaccccttacgtaactttttaacgnggtaacttaaccgaacttccccgaaaccgtacggggtacccctaacgttcgggtaccgttacccccgaaggtccccggtaacgggtttcccgaaccggttcggggtccgggggtttcgggggttccgtttaacggggggggtaaccctaacggggttaaccgttttacccgaaccgtttcccggtttacccaacccgtaaacttcccggaaccggttcccgaaacccggtcccgttaacgggtcccgttaaaccgggtttaccgttaaacgggttaaaaccgttttaacgttttttaaccgtttaaagtttttttttaaaccgtttacccgtttaacggtttaaccggtaaccggttacccggttaaaggtttaaccggtttaacgggtttaaacgggtttacccgggtaacccgtttaacccgggttaacgggttttaccgggaaccccgggttaaacgggtacccggttaaaggggttaacgggtaacggtaacccgtaaaacggtaccgttacggggtaccggtaccgttcggaaccctaaccgttcgtttcccgtagtttaccccttagttacccgtttcccgttacccccgtgtaccgtttacccgg

SEQ ID NO: 161708 - DNA, 313 bp, Homo sapiens
  misc_feature: GYAE6OF01DU9C9.48.25.C03.1.454.CMB.1.raw
  modified_base (186)..(186): a, c, t, g, unknown or other
  misc_feature (186)..(186): n is a, c, g, or t
  modified_base (229)..(229): a, c, t, g, unknown or other
  misc_feature (229)..(229): n is a, c, g, or t
  modified_base (284)..(284): a, c, t, g, unknown or other
  misc_feature (284)..(284): n is a, c, g, or t
  modified_base (295)..(313): a, c, t, g, unknown or other
  misc_feature (295)..(313): n is a, c, g, or t
tcagagtatacatacacgaccggtgctcgatttagtagtgtagatttgggtttggggagacggaaccatggaagccccagcgcagcttctcttcctcctgctactctggctccagattccactggaacaaatgtgatggacgcacgtcccagcccacctgtctgtcgtctaccggaaggggtaaanacgtccaccctctccgtgcgacggtccagtgagtatctagacngtcttctacgtcgtacggtaaaccaacggaacggcctacggaccacgctacccgnggtcctacctnnnnnnnnnnnnnnnnnnn

SEQ ID NO: 161709 - DNA, 739 bp, Homo sapiens
  misc_feature: GYAE6OF01BU4B5.48.25.C03.1.454.CMB.1.raw
  modified_base (181)..(181): a, c, t, g, unknown or other
  misc_feature (181)..(181): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaangtccaccctctcctgcagggccagtgagagttcttgactagccttccttagccgtacggtaacccaaacgtaaacggcctcggaccacggcccctacccgaggtccctccgttactaattttacgtagaacttaccactacccgaaccgacgggtcctacggttggtaccgtacccgaggtccgtaggtttccacggttcgggcgggttgggtccgtagggacctaggtcgtcctacgtcaccactatccgaggcacgtcctagacctagtcgtagtaacgtttattttaacgttattttatacgtgttacgacgtactagttaacgtacggtaacggtcggttaccgttccggttaacggttttccgggaaccggtaacggggtaaccggtaaagggtacggtaaacggttaaccgaaacggtaacggttacggtacggtaccgtacggtacctaaccgtagttccgttacgttccttaccgttaccgttccccgttaccccgtacttaccgttacgtacgttacttacgtttataacctttacggttcgtaacggg

SEQ ID NO: 161710 - DNA, 848 bp, Homo sapiens
  misc_feature: GYAE6OF01DAHDN.48.25.C03.1.454.CMB.1.raw
  modified_base (238)..(238): a, c, t, g, unknown or other
  misc_feature (238)..(238): n is a, c, g, or t
  modified_base (375)..(375): a, c, t, g, unknown or other
  misc_feature (375)..(375): n is a, c, g, or t
  modified_base (780)..(780): a, c, t, g, unknown or other
  misc_feature (780)..(780): n is a, c, g, or t
tcagagtatacatacacgaccggtgctcgatttagtagtgtagatttgggtttgggggaggaactgctcagttaggacccagacggaaccatggaacgccccagcgcagcttctcttcctcctgctacctctcggcctcccagacttccacgtgaacaaatagtgatgacgcacgtccccagcccacccgtgtctgtcgtcctaccgaaggggaaacgtcgttccaccccttctcccnggccgaagggccaggtggacgtacgttcttgacctagtcctttccgttagccgttacggtaaacccaaacgtaaacgggcccttacgggacccaacggtccccttcccgaagggtcccttaccttacgtattttacncggtaaacctaccaccgtacccaaccggacgggtaccctaggttcgggtaccctaccccgagtcccgtacggttaccgacggttggggtccgggttacggggttacggtcggggtaaactcggttacgtttaccaacccgttctaaccaccctaagtccgaagtacctacggtcctacggtctacggtttactagttaacgtttacgtttttactaaactttttacgtaacgttcgttacgaagtacgtacgttaacgttacggtaacggtccggtaacgttaccggtttaccgggttaacgggaacccgggtaaacgggtaacggtaacgggttaacgggtaaaccttaacccggaaacggttaaccggtgggttaccggtacgtaccgtaacccgtaacgttntttaacccggttcgtttaaccgttaccttaccggttacccccgtttacccgcggttttactaaccggg

SEQ ID NO: 161711 - DNA, 588 bp, Homo sapiens
  misc_feature: GYAE6OF01A95MY.48.25.C03.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
  modified_base (316)..(316): a, c, t, g, unknown or other
  misc_feature (316)..(316): n is a, c, g, or t
  modified_base (356)..(356): a, c, t, g, unknown or other
  misc_feature (356)..(356): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaangtccaccctctcctgcagggccagtgagtgtcttgacngcttcctagcctaggtaaccaacaacggcctggaccagccctccgaggcctcctctatttangatacntcccacnggccactgctcccagccagtcagcggcggtggctgggacngagtcactcgtcactatcgagacagcctagacgtacccgaagttactttggacgtttactagtgtcagcgtacgtctcgacctacgtcgtaccgtctcgaccggttacgggacgggtacgggtaccgaagggttcggaacgtacgtaaccgaaacggtcgtacgggtcggtaccgtgacccgtaccgtagtaccgtttgtcctttactaccttcccgttaccccgtactacg

SEQ ID NO: 161712 - DNA, 814 bp, Homo sapiens
  misc_feature: GYAE6OF01EQYXP.48.25.C03.1.454.CMB.1.raw
  modified_base (167)..(167): a, c, t, g, unknown or other
  misc_feature (167)..(167): n is a, c, g, or t
  modified_base (180)..(180): a, c, t, g, unknown or other
  misc_feature (180)..(180): n is a, c, g, or t
  modified_base (193)..(193): a, c, t, g, unknown or other
  misc_feature (193)..(193): n is a, c, g, or t
  modified_base (208)..(208): a, c, t, g, unknown or other
  misc_feature (208)..(208): n is a, c, g, or t
  modified_base (216)..(216): a, c, t, g, unknown or other
  misc_feature (216)..(216): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcacgtccccagccaccctgtctgtntctcgaggggaanagtcaccctctcngcgaggccagtgagngtctgacngtctctagcctagtaaccaacaacggccgtggccacgccctaccgacggtcctacctactatttacgtgtaactaccactcccgaaccggacgggccctaggttcggccgtacccgagtaccgtacggttccacggtcggggcgggttcggtccggtagggaactacgggttacgttaccacgttccctacgaaccctagtaccgaacggtaccctaccgtaccgtacggtaacgtaacggtttctaaacgggtttaaaaattttaccggttttttaacctttaacgtttttttacgttaaacccgttaggttaccgtaaacgggttaccttaacggttaacggttaccgggttaaaacggttcgggttaacccgtttaaccgggttaccgggtttaccggaacccgggtaaacgggtaacggaagggttaagggaaaccgttaaacggaaaccggtagttacgggacccgtacgtaccgacccttaaccgtgtttacccgttcgttaaccgttaaccgtaaccgtttcccggtaccctaacccgttatacccggttaagttaacgttacgtttaacgtacttacgtcggtaacgggg

SEQ ID NO: 161713 - DNA, 726 bp, Homo sapiens
  misc_feature: GYAE6OF01DH6Z4.48.25.C03.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaangtcaccctctcctgcagggccaggtgagtagtcttgacagtcctccgttagcctaggtaccaacgaaacggcctggccacgccctcccgaggtcctcctcatttangtactacactcccacgacgggccacgtcggtctccagcctaggttcacgtggcggtggtcgtgggactagtacgttcactcgtcacatcgagcacgtccagctagtctagtaacgttattttaacgtattttactacgtgtaccagtactaaggttacttaggtaacggttggtacccgttaccgggttacggtttaccgggaaccgtaaacgggtacccgtaaaggggttacggtaaacgtaaccgtaaaaaccgggtaaccggtttcgggtaacggtacccgttaccgggtaaccccgtaaacccgttacgggtttttaccccgttaacggggtttttaccccttaaaccccggttttaccccgtttaaccccccggtttccccccggtaaaccttttacggtttaaaccccggg

SEQ ID NO: 161714 - DNA, 627 bp, Homo sapiens
  misc_feature: GYAE6OF01BHTA8.48.25.C03.1.454.CMB.1.raw
  modified_base (274)..(274): a, c, t, g, unknown or other
  misc_feature (274)..(274): n is a, c, g, or t
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctttcctgcagggccagtgagagtcttgacagctccttagcctggtaccaacaaggcctggccagcctcccaggctcctctatttangatacactccaccgagggccacgtggtctcccagcctaggttcacgtggcggtgggtctgggacagtacgttcactctacaccntcagcagcctgctagtntagaattactttactattttatactgtcagtacgtagttagtacgtaaggtcggtaccttccggtaacggtttacggacccgtaaacggggtaaccgtaaggggttacgggaaacggttaaccgaaacggtacgttcgggtaggtcctacggaccgtaacccgtagttccgtacgttccgttactaccgttcccttaccccggcctagttccttagtaacgttcgttagtacgtttactcgtggtaccgggg

SEQ ID NO: 161715 - DNA, 682 bp, Homo sapiens
  misc_feature: GYAE6OF01CVX5O.48.25.C03.1.454.CMB.1.raw
  modified_base (182)..(182): a, c, t, g, unknown or other
  misc_feature (182)..(182): n is a, c, g, or t
  modified_base (280)..(280): a, c, t, g, unknown or other
  misc_feature (280)..(280): n is a, c, g, or t
  modified_base (299)..(299): a, c, t, g, unknown or other
  misc_feature (299)..(299): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaagngtcaccctctcctgcagggccagtgagagtcttgacagctcttagcctggtaaccaacgaaggcctggccagccctccgaggcctcctactattttangactaacactcccaaccgngggccacgttggtcgtcccagcctaggttccacgtgggcgggtggtcgtgggaccaggtagttccacgttcctaccacctatcgacgctacgcctgactagtaccgtagtaaacgtttacttttaactatttttatacttagtcgagtacctaagttacgttaacgttacggtacggtaccttacgggttaccggtttacgggaacccgtaaacggggtaccgtaagggttacggtaaacggtaaccgtaaacggtaacgttggtacgggtctttacggacctaaccgtattacccgttcgttaccgtttactacccgttcccgtttaccccgccttacgttcgttacgtacttacgttagttaacttccgtacgttacgggg

SEQ ID NO: 161716 - DNA, 602 bp, Homo sapiens
  misc_feature: GYAE6OF01B0018.48.25.C03.1.454.CMB.1.raw
  modified_base (287)..(287): a, c, t, g, unknown or other
  misc_feature (287)..(287): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaaggggaaagagtccaccctctcctgcagggccagtgagagtcttgacagctccttagcctaggtaaccaacaacggcctggcccagccctacccgaggtcctcctactatttangaatacatcccacgagggccacgtggtcgtcccagtccaggttcacgtgggcggtgggtctgggacagtagttcactctacactagtcagcagcctgactagttctagtaagttacttttacttattttacttacttgtactagtactagttaacgtacgtaagtcgtaaccgttccggtacgtttacggaccgtaaacgggacgtaagggtacgaacgtaacgaaacgtacgtaggtcgactcgacacgcttcgtcgttcttctacttccctacccgcagttcctaagtactagttactaacttcgtgtacggg

SEQ ID NO: 161717 - DNA, 672 bp, Homo sapiens
  misc_feature: GYAE6OF01CJ7JV.48.25.C03.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (244)..(245): a, c, t, g, unknown or other
  misc_feature (244)..(245): n is a, c, g, or t
  modified_base (274)..(274): a, c, t, g, unknown or other
  misc_feature (274)..(274): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
  modified_base (355)..(355): a, c, t, g, unknown or other
  misc_feature (355)..(355): n is a, c, g, or t
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaaggggaaancgtcaccctntccgtgcagggccagtgagtagtctgacnnctccttagctggtaacaacaagctggcancctccagctcgcattngtgctcacnggccacgtgcactccgaagcgaggttcagtcgggacaggtgggtctacggggaacngtacttcactctacactacgtacacgaanccgtagggacnctagtattagtactttggcttacggtttcgttttcgtaggtctacgtacgtaggtttaagtacggttaaacgttcccgaacggttaccggaacgtttaacccgggtttcgggaacccgggtaacgggggtaaccctaaaagggggtaccgtaaaaacgtaaccgggaaaaccggttacgtacgggtcgggttaaccaccgtaacccggtaacgtaagttttcccggtcgtttaaaccccgtttctaaacccgtttccccggtttccccggtaaaccc

SEQ ID NO: 161718 - DNA, 840 bp, Homo sapiens
  misc_feature: GYAE6OF01BM2O8.48.25.C03.1.454.CMB.1.raw
tcagagtatacatacacgaccggtgctcgatttagtagtgtagatttgggtttggggagacggaaccatggaagccccagcgcagccttctcttccgtcctagctactctggctcccagtattccactggacaaatagtgatgaccgcagtccccagccaccctgtctgtcgtctccaaggggaaagacgtcaccctctcctgcgagggccaggtcgagtagttccttgacagtctccttagcctggtaccaacaacggtcctggccacgcctcccgaggtccttcccgtcaacttttacgaggtaactacctactcccgaacgacggggtaccctacgttggtaccgtccccgacggtacccgtaagggtttccaaccgttgggcccgggtttacgggtccgtacggggaactacggtcgttttaccacctttcgaccgtaccgtactccgaaggtcctaacgtccgtcgtactacggttacttacggtaaacgtttatttttaaccgttaactttttaacgtttaccgttcgttaccgtaacgtaccggttaacgtttacgttacggtttaaacgggttcgggtaacccgtttaccgggttaaccggttttacccgggaacccggttaaaacggggttaccgtaaaaggggttacggtaaaccggtttaacccgggaaaaccggtaccgtttacgggttacggtaccgtttaacgggacccctaaaccgttcgtttaccggttcccgttaaccgtttaccgtacccgtttacccgttaccccggtcctttaccgtcctaacggttacttacgttagtaacttaccgtttcggaacggg

SEQ ID NO: 161719 - DNA, 791 bp, Homo sapiens
  misc_feature: GYAE6OF01DA9SH.48.25.C03.1.454.CMB.1.raw
  modified_base (220)..(220): a, c, t, g, unknown or other
  misc_feature (220)..(220): n is a, c, g, or t
  modified_base (239)..(239): a, c, t, g, unknown or other
  misc_feature (239)..(239): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggcctcccagtacttccacgtggaactaaatagtgatgacgccacgtcccccagccctaccctgtctgtgtacctccggaaggggtaaancgttcccacccttctccgngacgaggcctaggtgagacgttctgactacgtccttaccgtagcctacggtaaaccaaacgtaacggcctacggaccctacgcccgtacccgacggtcctaccttagtatttatcgtaaccttacacctcccgaaccggtagggtaccccacgttcggtaccgtaccccgaaggtcccgtacggttaccgaccgggtttgggtccggggttaccgggtacggttacggggaaacctcggtttaccggttacccctaaccgttccctaacccgaacctaccggttacgaaccgggaccttaccgggtccgtacgtacccgttacgttaccgttaaggtaaagttttaacctttttacttaagttttaacttacgttacgtacgtacgtacgtacggttacgttacggtaacggttccgtaccgttacggttacgttaccggaaccgttacgggaacgtaggtaaggtacctaacggtaacgtacgtcggtacgcgtcgacctacgtcttaccgttacgttacgtaccttaccgttaccgtaccctcgtctacg

SEQ ID NO: 161720 - DNA, 722 bp, Homo sapiens
  misc_feature: GYAE6OF01DFP0N.48.25.C03.1.454.CMB.1.raw
  modified_base (203)..(203): a, c, t, g, unknown or other
  misc_feature (203)..(203): n is a, c, g, or t
  modified_base (319)..(319): a, c, t, g, unknown or other
  misc_feature (319)..(319): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctccagattccactggacaaatagtgatgacgcacgtcccagccacctgtctgtgtctccgaggggaaagngtccaccctctcctagcgacgggccaggtgagagttcgttacgacaggtccttccgttacgtccgtaggtaacccaaacgaaacgggccgttacggacccacggtccctacccggngtacctcgttctagtttatacgactactactccgaccgaggcctacgtcgtacgtcccacgtcctacggttcacgtgggtcggtacggtcgtacggggacacggtacgttccactacgtactaaccgtactcggaacgtcgaccgtccagtccctaaggttccgtaaggttaaactttacgtttttaacttaatttacgtttaattcgtactaagcgtttagttacgtaaggttagggtacctacggtttcccggtaacgggttcccggaacgttaaggggaacctaaggttaacgggaactaccggtaaaacgtcggttacggtacggtacgtacgaacgttacctagttacccggtttcttacccgttacttacccgaccctttacccgtcacggtttccc

SEQ ID NO: 161721 - DNA, 737 bp, Homo sapiens
  misc_feature: GYAE6OF01CUBVS.48.25.C03.1.454.CMB.1.raw
  modified_base (210)..(210): a, c, t, g, unknown or other
  misc_feature (210)..(210): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggcctcccagattccactggaacaaatagtgatgacgcacgtccccagccaccctgtctgtgtcctaccggaggggaaancgtaccaccctcctcctgccgacgggccaggtgaggtagttccgttgaccacgtccttccgttacgccgttacggtaaaccaaacgaaaccggtcctacgggcccaaccgtcccctaccccgaggtcccttacccttacgttattttacgtgtaacttaaccacctcccgaacccggaccgggccctaaccggttgggtcccgtaccccgacgtacccgtacggttccgacgggttcggggtccggggtttgggtcgtacggggtaactacggttactaccctacgtccctaccacgtactaccgagtccacgcctaggcctagtctaagtaattaactttttatatttttaactcgtgtacagtctaagttcgtaggtactcgggtacttccggttaaggttcggaaccgtaggtacgtaaggtagggaacgtaaaccgaaacgtacggttggtacgtaccgtcgtacccagtttcgttaccgttcttaccttacggttaccttccccggttcccacgttctacgg

SEQ ID NO: 161722 - DNA, 640 bp, Homo sapiens
  misc_feature: GYAE6OF01C0A4N.48.25.C03.1.454.CMB.1.raw
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
  modified_base (243)..(243): a, c, t, g, unknown or other
  misc_feature (243)..(243): n is a, c, g, or t
  modified_base (386)..(386): a, c, t, g, unknown or other
  misc_feature (386)..(386): n is a, c, g, or t
  modified_base (630)..(630): a, c, t, g, unknown or other
  misc_feature (630)..(630): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggcctccagattccactggaacaaatagtgatgacgcacgtccccagccaccctgtctgtgtctcgaagggaaangtaccaccctcncctgcaggccagtgagtagtctgacngtctacctagccgtggtaaccaaacgtaggcctcggccacgcctaccgaggtcctacgtactagttatagaactaacactccaacggtacggacctagtcggctacccgacgtcgtacgtcagtggtcggtggtcgaggaacnggtactttaccacgtcactacatcgaactcgactctagactcgtatagtaaacttactttactattttaactcgtcgtacgagttacgtagttacgtttaacgtacggtacgttaccgtaaccgttaacgggttacgaaccgggtaacggtacgtaagggtaggaaccgtaactaaaacggtacgtgtcggaacgcggtacctaacgtacttccgttgttaactcctaacgttcccgtacccgnttacgtaccg

SEQ ID NO: 161723 - DNA, 564 bp, Homo sapiens
  misc_feature: GYAE6OF01EEGEA.48.25.C03.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (375)..(375): a, c, t, g, unknown or other
  misc_feature (375)..(375): n is a, c, g, or t
  modified_base (536)..(536): a, c, t, g, unknown or other
  misc_feature (536)..(536): n is a, c, g, or t
  modified_base (557)..(557): a, c, t, g, unknown or other
  misc_feature (557)..(557): n is a, c, g, or t
  modified_base (560)..(560): a, c, t, g, unknown or other
  misc_feature (560)..(560): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaangtcaccctctcctgcagggccagtgagngtcttgacagctccttagcctggtaccaacaaaggcctggccagccctcccaggcctcctcatttatgatacatcccaccgagggccctacgtggtcgtccccagccgtaggttcacgtcgggcgggtggtcgtgggacaggngttcactctcaccatcacgcacgtcctgctagtctagtaagttattttactattttattacttgtacacgtctagtactcgtagtcgtacgtccgtacggtttcggaccgtaacgggaccgtaaggtaggaacgtacgaaacgtacgtgtggctcgcactntctgttctctacttccctccnctntacg

SEQ ID NO: 161724 - DNA, 1042 bp, Homo sapiens
  misc_feature: GYAE6OF01DP1XI.48.25.C03.1.454.CMB.1.raw
  modified_base (573)..(573): a, c, t, g, unknown or other
  misc_feature (573)..(573): n is a, c, g, or t
tcagagtatacatacacgaccggtgctcgatttagtagtgtagatttgggtttgggagacggaaccatggaagccccagcgcagcttctcttcctcctgctactctggctccagattccactggacaaatagtgatgacgcagtccccagccaccctgtctgtcgtctccgaggggaaagcgtccaccctctccgtgcgacgggcctagtgagacgtcgttcgacgtacgtccttaccgttacgcccgttacggtaacccaaaaccgaaacgggtccctacggaccaccggtcccctacccgacggttccctacccttcttaatttaactagtaacttacactaccccgaaccgacggggtacccctaacggttcgggtacctaccccgaacggtacccggttacgggtttacccgtacgggttcgggggtacccggggtttcggggttaccggttaaccgggggaacggttaaacggtttacccgtttaccgtacccctttaaccgttccccgtaaaccgtaaaccgtttccgaaacggttcccgtacccgggttacccgtaccggggttanaaccgggttttaacgttaaaacgggtttaaaacgtttttaaaccggttttttttaacctttttaacggttttttaaacgtttacccgttttacggttaaccggttaaccggttaccggtttaaacggtttaacgggtttaaaccgggtttaaaccggggttaccgggtttaaaccccgggtttaccccgggtttaacccggggttttaaccgggaacccggggttaaaacccgggggttaacccggtaaaacgggggttttaaccgggtaaaaccgggtttaacggtaaaaaccccgggtttacggtttaccgggtcgggttaaccgttaacgtacccgttaaaccgttaacgtttccccgtacgtttccctttaacccgttccgttacccccgttacccgtacctttacgtccggttaacgtttaccggttaatttaccggttaaccttacccggttcggtaacgggg

SEQ ID NO: 161725 - DNA, 849 bp, Homo sapiens
  misc_feature: GYAE6OF01BU53F.48.25.C03.1.454.CMB.1.raw
tcagagtatacatacacgaccggtgctcgatttagtagtgtagatttgggtttgggggaggaactgctcagttaggaccagacggaaccatggaagccccagcgcagcttctcttcctcctgctactctggctcccagacttccactggaacaaatagtgatgacgcacgtcccagcccacctcgtctgtgtcctacggaagggaaacgacgtccacccttcgtccgtgaccgacgggcctagtagagtacgttcttggaccacgtccttaccgttacgccgttacggtaaccgaaacgaacggccgtcggaccgacgtcccgaccgacggtccttaccttacgtattttacgacgtaactacctaccgtacccggaccggtaacgggccctaacggttccgggttaccgtacccgcggtacccggtacggtttaccgacggtcggggtccgggttcgggtcggtacggggtacgtacggtacgggtttacctaccgttaccgtaccgtaaacccgacgttacgaaccggtaccgtacgtaccggttcgtaacccggtacggtttacgttaacggtttaaactttaacgttttttaaactttaactttttaacgtaccgtttacgaccgttaagtaacgtttacggttaacgtttaggttaaccggtaccgtaccgttccggtacggttaccgggaaacccgggtaagggtaaccggtaaacggggttaacgtaacggttaaacccgtaacgggtaacgttccggggtataacccggtcgtacccggtacctacgttcccgttacgttttacctcgttaccctacccgtttcccaacgttcgttaaccg

SEQ ID NO: 161726 - DNA, 695 bp, Homo sapiens
  misc_feature: GYAE6OF01C2503.48.25.C03.1.454.CMB.1.raw
  modified_base (643)..(643): a, c, t, g, unknown or other
  misc_feature (643)..(643): n is a, c, g, or t
  modified_base (676)..(676): a, c, t, g, unknown or other
  misc_feature (676)..(676): n is a, c, g, or t
tcagagtatacatacacgaccggtgctcgatttagtagtgtagatttggggtttggggagacggaaccatggaagccccagcgcagcttctcttcctcctgctactctggcctcccagattccactggaacaaatagtgatgacgcacgtcccagccacctgtctgtcgtctacggaaggggaaagcgtccaccctcgtcctgcgacgggccaggtgaagtgtcttacgacagccttaccgtacggtccgtacggtaaaccaaacgaaacggtccgtacggcctaaccgtcccgtaccgaacggtccttcctcgtaattttcgaagtactacactcccgaacgacgggtccacggttcggtaccgaccctacgccgttacggttccgtaggtcgggtaccgggttcgggtacggtacggggaactagggtactttaccgaccgtcctaaccgtaacccagtccgaggaccctacggtcccttaggacttccgtacgtaaggttaaacgtttactttttacctttagttttattacgttcgacgtacgtagtaagttacgttacggtagtcgtactccgtagtcgaacgtacgacggtagacgaataaccgagtagtgacgcttacactcgtattcgtaccttntactacttccctacctcacgtcttataacgttntaagttcctgtagtccggg

SEQ ID NO: 161727 - DNA, 735 bp, Homo sapiens
  misc_feature: GYAE6OF01AYDDJ.48.25.C03.1.454.CMB.1.raw
  modified_base (214)..(214): a, c, t, g, unknown or other
  misc_feature (214)..(214): n is a, c, g, or t
  modified_base (225)..(225): a, c, t, g, unknown or other
  misc_feature (225)..(225): n is a, c, g, or t
  modified_base (667)..(667): a, c, t, g, unknown or other
  misc_feature (667)..(667): n is a, c, g, or t
  modified_base (711)..(711): a, c, t, g, unknown or other
  misc_feature (711)..(711): n is a, c, g, or t
  modified_base (725)..(725): a, c, t, g, unknown or other
  misc_feature (725)..(725): n is a, c, g, or t
tcagagtatacatacacgaccggtgctcgatttagtagtgtagatttgggtttggggagggaactgcgtcagttaggacccagacggaaccagtcggaagccccagcgcaggcttcgtcttcctcgtgctactctcggcctcccagacttccacgtcggactaaagtcgtgactgacgcacgtcccagccacctgtctcgtcgtctcgaggaancgtccaccgtntcctgccgagcagtcgatagttctaggacacgcttaccgtgccgtacggtaaccaacgtaaggtcctacggacctacgtcccctacccggaacgtcctcctacgttaacttataggtacctaaccgaacgttaccccgaaccggtaacggtccttaacgtcggtaccgtaccccgtacggttaccgttacggtaccgttacggttcgggtccgggtagttccgggtaccggtactacggttaccgtactaccgttcgactaaaccgtcgtacaccgttaccgcgtaccgacgtacgttactaccggtagtaaacgtttacttttaacgtaacgtttacgtacgtcgtactacgtacgttaagttaccggtcggttagtaaccgttcgtaccggttaacggttcgaaaccggtggtaaccgtaggtacgaaagaacctacggngttacgtacggtacgcgaaccacgtgtcgttaccttacgttacncccgttacccgtcncgttagaccg

SEQ ID NO: 161728 - DNA, 600 bp, Homo sapiens
  misc_feature: GYAE6OF01AV82N.48.25.C03.1.454.CMB.1.raw
  modified_base (181)..(181): a, c, t, g, unknown or other
  misc_feature (181)..(181): n is a, c, g, or t
  modified_base (210)..(210): a, c, t, g, unknown or other
  misc_feature (210)..(210): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagngtccaccctctcctgcagggccagtgagngtctgacagctctagcctaggtaccaacaaaggcctggccagccctccgaggcctcctcatctagtcggtcgcgtccaccgacgggcctacttgccatcccagacacgggttcaggtcggcgaggttgggtcgtgggacaggtaccttcacgtctccaaccataccacagaccgtggtacgccttgacttagtatttcgcttagtttgtttttccgtgtctagtactaagttagtcgggtaacttcaccgttacggactacgttccggaccggagggtaaccgtaagggtacgtaaacgtacgtaaacggtacgttaggacgtacgtcgcctaactacttcgttcgtaccttacgtcttccgttacccacgtatacgtatattgtctacg

SEQ ID NO: 161729 - DNA, 719 bp, Homo sapiens
  misc_feature: GYAE6OF01A5BJU.48.25.C03.1.454.CMB.1.raw
  modified_base (184)..(184): a, c, t, g, unknown or other
  misc_feature (184)..(184): n is a, c, g, or t
  modified_base (303)..(303): a, c, t, g, unknown or other
  misc_feature (303)..(303): n is a, c, g, or t
  modified_base (325)..(325): a, c, t, g, unknown or other
  misc_feature (325)..(325): n is a, c, g, or t
  modified_base (463)..(463): a, c, t, g, unknown or other
  misc_feature (463)..(463): n is a, c, g, or t
tcagagtatacatacacgaccggtgctcgatttagtagtgtagatttgggtttggggagacggaaccatggaagccccagcgcagcttctcttcctcctgctactctggctcccagattccacgtggacaaatagtgatgacgcacgtccccagccaccctgtctgtgtcctacgaaggggaanacgtccaccctctcctgcgagggccaggtgagtagtcttgactacgccttacctacgccgtacggtaaccaaacgaacggtcctaggacccacgtccctacccgaaggtcccttacctnttaatttacgacgtaactaccncctacccgaaccggaccggcctaacggttcggtcgtaccccgagtacccgtacggtttccacgggttcgggtccggggttggtaccggtacgggactaggtacgtttccacgttccacctaacctagtaccgagaccncggtacctgactacgttactaaggtaaatttcttttaacttagttttactcttagtactagtactagtacgtacgtaaggtcgtaccgttaccggttcgttacggaacggtaacggtaagtaagggtacgaaacgtaacggaaacgtacggtcggtacggtctacgaccgtactacgtcgttaccttccgttacgtaccttcccgtaccgtacttacgtgtaacttacggacttagttaacttgtaccggtacggg

SEQ ID NO: 161730 - DNA, 867 bp, Homo sapiens
  misc_feature: GYAE6OF01B41ZS.48.25.C03.1.454.CMB.1.raw
tcagagtatacatacacgaccggtgctcgatttagtagtgtagattgggtttgggagacggaaccatggaagcccagcgcagcttctctcctcctgctactctggctccagacttccacgtggacaaatagtgatagaccgacacgtccccaggcccaccccttggtcctggtcgtcctaccgagggggaaagacgtccaccctctccgtgccgacgggccagtcgagtagtcgttgacgacgtccttaccgttagcctacggtaaccaaacgtaacggcctggccacggtccctaccgacgtcctaccgttactacgtttacgtgtaaccgtacaacctacccggaaccgtacgggaccctacggttacggtaccgtaccccgtagtcccgtacggttccgtaacggttcggggtacgggtttcgggtaccggtacggggttaacgtaccggtaacggttccctaacgttccccgaccgtaaaccctattaaccgaccgtaaaccgtcggtccgtaacggtccggtacgttaacgtaacggtaaacggtcggtttacggttaaccgtaacgttaaaccgtttaacgtttacggttaaaccggttaaacgttaaaacgtttaccgtttaacctaacccgtttcccgtaaccccgttaaccgtacccgtacccgttaccgggaaccccggtaacgggtaacccgacgggtacccgtaagggaacccgttaaacgggttaaacccgtacggtttacggccgttacgtacgtaccgtacccgttaactccggttccgttaccgtttacggaccttccccgttacccgaacctttaccgtcggtaacttcgtacttacgttaacttaccgg

SEQ ID NO: 161731 - DNA, 858 bp, Homo sapiens
  misc_feature: GYAE6OF01DVDKS.48.25.C03.1.454.CMB.1.raw
  modified_base (217)..(217): a, c, t, g, unknown or other
  misc_feature (217)..(217): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagacttccactggaactaaatagtgatgaccgcacgtccccagcccaccttgtcttgtcgtccgtaccgaagggggaaancgtcccaccccttctcctggaccgacggggccaaggttcggaggtacgttccgttacggaactcgttccttaccgttaacgtcccgttaacggtaaaccaaacggtaaaccggccgtacggacccaacgtccccgtaccgaacggtccttcccttacttaagttttacgtacgtaactaaccgaaccttaccccgaaccgaccgggtacctaacgttcggtccgtacccgacgtccgtacggttaccgacggtcgggtcggtcggttacggacgggtactaggttacgtcctaccgttcctacgaacctaacgtccggaacgtcgaccgtaccgtacggtaccgtacgttaaccgttaaggttaaacgtttttaacttttaaacgttttactttttaaacgtttacgttacgtacccgtaagttaccgtttaaggttaacgtttacgggttaacggttaccggtaccggttaacgggtttacgggttaccggaacgggtaaaccgggtaaccggtaagggtaacgtaacgtaaacgtaacgggtaacgttcgggagttcccggtacgaccgttaccgttcgttaccttaccggtttaccttacccggttaccttaacccggttccccctagttcgtaaccg

SEQ ID NO: 161732 - DNA, 922 bp, Homo sapiens
  misc_feature: GYAE6OF01EVJP8.48.25.C03.1.454.CMB.1.raw
  modified_base (182)..(182): a, c, t, g, unknown or other
  misc_feature (182)..(182): n is a, c, g, or t
  modified_base (504)..(504): a, c, t, g, unknown or other
  misc_feature (504)..(504): n is a, c, g, or t
tcagagtatacatacacgaccggtgctcgatttagtagtgtagatttgggtttggggagacggaaccatggaagccccagcgcagcttctcttcctcctgctactctggctcccagtacttccactggacaaatagtgatgacgcacgtccccagccacctgtctgtgtctacgagggaaangtaccaccctctcctgcgacgggccaggtagagtacgttcttgacgacgtccttcccttagcccgttacgtaacccaaacgaaaccgggtcccttacggacccaaccgtccccgttacccgtagggtcccttccccgttacttaacgttttaagtcgtaaacttacctaacctacccccgtaacccggacggggtacccctacggtttccgggtacccgtaccccgaacggtccccgtagggtttcccgacggttccggggtcgggtttacggggtcggttacgggaacgtagttccggttaaccaccgttcctaccgaacnccgtaccgacgtccaacgtcccgtagtaccgtaacggttacgtaaggtttaaacgtttacgtttttaacgtttaatttttaaccgtttaccggttacgtttaccgtaacgttaaccgttaaggtttaaaccgggttacggtttaaacgggtcccgggtttaaccccggtttaaccgggttaccggtttacccgggaaacccgggtaaccgggtaaacgggtaacggggttaaccggtaaccgtaaaccgggtaaacggtaccggttgggtaaccgggtcccttacggtaacccctacgttccgttaccgtttacccgtttaaccgcccgttttaccccgttcccccgttaccctacccgttaagttcccgttacgtaccgtttaggtaaccctttacggttacccgtgggttaccggg

SEQ ID NO: 161733 - DNA, 587 bp, Homo sapiens
  misc_feature: GYAE6OF01BBE1S.48.25.C03.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (370)..(370): a, c, t, g, unknown or other
  misc_feature (370)..(370): n is a, c, g, or t
  modified_base (552)..(552): a, c, t, g, unknown or other
  misc_feature (552)..(552): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaangtcaccctntcctgcagggccagtgagagtcttgacagctccttagcctggtaccaacaaggcctggccagcctcccaggctcctctatttatgatacactccgaccacgggcctacgtggtctccccgagccgtaggttcacgtgggccggtggtcgtagggacnggtacgttcactctaccaccatcacgcacggcctgacgtacgtactagtaagttacttttaactatttttacttacttcgtacagtctaagtagttacgtaggtcggtacttccgtacggtttacggaccgtaagggacctaagggtacggaacgtacaacgacgtgtggctcgacaccgtntctcgttcttactacttaccttcccgctcgttacg

SEQ ID NO: 161734 - DNA, 835 bp, Homo sapiens
  misc_feature: GYAE6OF01D2QWB.48.25.C03.1.454.CMB.1.raw
tcagagtatacatacacgaccggtgctcgatttagtagtgtagatttgggtttggggagacggaaccatggaagccccagcgcagcttctcttcctcctgctactctggctccagattccactaggacaaatagtgatgacgcacgtcccagcccacctgtactggtcgtcgtaccgaaggggaaagtcgtcctacctcgtcctgcgaacgggcctaggtagacgtagttcttagacgtacgtaccttaccgtacgtaccgttacggtaaaccgaaaacgtaaacggtccctacggacccgacgtccccttaccgacggtcctaccttactaacttttagactactaccacgtacccaccggacgtacccgtacgttaccggtccgtaaccccgaggtacccgtaaggttcgtaacgggtcggggtaaccggtcggggttacgacgggtacgtaacgtacgttccaaccgttactacccgaactacgacgaacgtcgacgtcgttacgacctagtacgtttaacgtaaacgtttacttttaaactttaacgttttattaaccggttacgtaacgtacggttaaactaaggtacggttttaaacggtaaccggttccgtacggtaccggtttaacggttacggaaccggtaagggtaaaccggtaaggggtaacggtaaccggtaaacgtaaaccggtaagtttcgggaaccgacttaaccggacctaaacgttgttaaccgtactttcctttaaccgtaaccgggtttccccaacccggttctcgttaaaacttcggtaattttaacaacggtttacttaccggttggaacgggg

SEQ ID NO: 161735 - DNA, 628 bp, Homo sapiens
  misc_feature: GYAE6OF01BJTMW.48.25.C03.1.454.CMB.1.raw
  modified_base (203)..(203): a, c, t, g, unknown or other
  misc_feature (203)..(203): n is a, c, g, or t
  modified_base (312)..(312): a, c, t, g, unknown or other
  misc_feature (312)..(312): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatgtgatgacgcagtccccagccaccctgtctgtgtctccgaggggaaangtccaccctctcctgcacgggccaggtgagagttcttgacacgtctccttagccctaggtaaccaaaccgaaaggccctaggccagccctcccaggcctcctcatttangatacactccaccagggccactcggtcgtccccagcctagtcacgtgggcggtggtcgtgggacagtacgttcgactctctaccatcagcacgccttgctagtcgtagtaacgttattttaactatttttaattacgttgtactagtactagtaattcgtaagtcggtacttaccggtacgtttgggaacccgtaagggtacccggtaagggtacggaacgtaacgtaaaaccggacgttacgggtagtccgtacgtacctacgtacttacgttcgttaccgttcgtaccttaccggtttcccccgacttacgtcg

SEQ ID NO: 161736 - DNA, 765 bp, Homo sapiens
  misc_feature: GYAE6OF01C7D37.48.25.C03.1.454.CMB.1.raw
  modified_base (216)..(216): a, c, t, g, unknown or other
  misc_feature (216)..(216): n is a, c, g, or t
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
  modified_base (399)..(399): a, c, t, g, unknown or other
  misc_feature (399)..(399): n is a, c, g, or t
tcagagtatacatacacgaccggtgctcgatttagtagtgtagatttgggtttggggagacggaaccatggaagcccagcgcagcttctcttcctcctgctactctggctccagacttccactggacaaatagtgatgacgcacgtcccagtccaccctgtctgtgtctacgaaggggaaatacgtccaccctctacctgacagggccagtgacgngtcttgactagccttctacgcctcggtaacaacgaacggtcctggcctagcccctcgacgtcctactcgtatttacngtaacactacnccaccgagggaccctagtgggtcctacccgaggtccgaaggtttcccaggttcgggcgggttacggtcgtaggggacctaagccggttttaaccnccgtacctacgtacgtacgtcgtaccgccaccggtcgttgacgttaacgttacggttaaacgtaaaagttttcttttttaaacgtttaacgtttttacgttaccgtacgtacgtaagttaacgttaacgtttaacgtaacgggtttaacggttaccggttaccggtttaccgggttaaccggttaacggtaaccgggtaacggggtaacggtaacgggttaacggtaaacggtaaccgtaaacggtacggttcgggtacgtcgttaccggacgtacgtcgttcttaccgtaccttaccggtaccttcccgttaccgtacttacgtattacgttaacgttacgttaacttacgttcgtacggtacgg

SEQ ID NO: 161737 - DNA, 786 bp, Homo sapiens
  misc_feature: GYAE6OF01A1GX7.48.25.C03.1.454.CMB.1.raw
  modified_base (97)..(97): a, c, t, g, unknown or other
  misc_feature (97)..(97): n is a, c, g, or t
  modified_base (547)..(547): a, c, t, g, unknown or other
  misc_feature (547)..(547): n is a, c, g, or t
  modified_base (585)..(585): a, c, t, g, unknown or other
  misc_feature (585)..(585): n is a, c, g, or t
tcagagtatacatacacgaccggtgctcgatttagtagtgtagatttgggtttgggggaggaactgctcagttaggacccagacggaaccatggaanccccagcgcagcttctcttcctcctgcttactctggctcccagtattccagtggactaaatgtgatgacgctacgtccccagccctacccgtgtcctgtcgtccgtaccgaagggggaaactcgtccgacccctcgtccgtggcgaacgggtccaaggttggaagtacgttccgttagaccgtacgtccgttaccgtttacggcccgttaacggaacccaaaacggtaaccggtcccgttagggaccctaaccggtccccgttacccgaggtcccttaccgtataagtttacgtacgtaactacctacgtacccgaaccgtacgggccctacggttggttcccgaccccggtacgtaccgttaggttccgaacggttcggggtacgggtacgggtacgttacgggaacttacggtaccgtttaccgtaaccgttccgtaccgtaacccgngttaccgacgtccgtaccgcgttacgacgttacggttntaaggtaaattttccggttttaattacgtttacgtacgtcggtactagtaccttagttaacgtcgggttaacgaccgttcgttccgggttaattccgggaccgtaaacgggcctaaggttacgaaccgtagaaaccgttgttccggactcgtaacgtctaggtcttacgtcgttctacggccttaccggcttatgtacccg

SEQ ID NO: 161738 - DNA, 1002 bp, Homo sapiens
  misc_feature: GYAE6OF01B761W.48.25.C03.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
tcagagtatacatacacgaccggtgctcgatttagtagtgtagatttgggtttgggggaggaactgctcagttaggacccagacggaacatggaagccccagcgcagcttctcctcctcctgctactctggctcccagattccactggaacaaatagtgatgacgcacgtccccagccacctgtctgtgtctcgagggaanagtcacctctccngcgtaggccaggtcgagtacgttcgttgacacgtccttaccgtacgccgtaggtaaaccaaacgaaacggcctcggaccacgccctcccgaggtccttcctactattttacgacgtaacttaactaccttacccgaaccgacgggaccctaacgttcgggtccgttacccacggtacctaagggttccaacggttggggtaccggggttcgggttaccgtaggggaactacggtacgtttacgtaccttaccgtaccaacctaacgttacgaaccgtacgtaccggttaccgtacggtccgtaacggtttaccggttaacggttaaaacggtttttaacttttttaaaccttttaaacggttttttttaacgttaacgttttaccgggtttaccgtaacggttttacgtaaacgggttttaacgtttaacgggggtttaaaacgggtttacccggttaaacccgggttttaacccgggtttaacggggtttaaccccgggtaaacccggggttaaaacccgggggtaaaacccgggtttaaacggggggtttaaaaccggggttaaaccgggttaaaaccccgggtttaaaaaacccgggttaacgggttttacccggggtttaaaccgggggttaaccccgttacggggttaaacccccggttaaacccggttttaacccgtttaaccgggtttttaccccggtttaacccggtttacccgttttaaaccccggttttcccccggtttaacccccgggtttacccttttaaaccggtttaacccggg

SEQ ID NO: 161739 - DNA, 988 bp, Homo sapiens
  misc_feature: GYAE6OF01DM34K.48.25.C03.1.454.CMB.1.raw
  modified_base (475)..(475): a, c, t, g, unknown or other
  misc_feature (475)..(475): n is a, c, g, or t
tcagagtatacatacacgaccggtgctcgatttagtagtgtagatttggggtttgggggagacggaaccatggaagccccagcgcagcttctcttcctcctgctactctggctcccagtattccactggacaaatagtgatgacgcacgtcccagccaccctgtctgtcgtctacgaagggaaagtcgtccaccctctcctgcgagggcctaggtgagtacgtcgttagacacgtcttccgttacgccgttacggaaaccaaacggaacggtccgtcggtacccacgtaccccgtccgacggtcccttaccgtctaagtttactagtaacaacctaccgtcccgaccgtacggtccccgtagttccggggtacctaccccgacggtacccgttacggttaccggtacgggtacggggtcggggttcgggtacggtacgggtaaacgtacggttacgtttaccacccgtttacccnccgaaaccgtactaccgaacgtaccggtaccgccgttaacggtacgttaccggttaacgttaaacggttaaacggttttttaacgttttttaaacgttacggtttttttaaaccgttcgttaccgggttaaccgtacggtaaaccggttttaaaggttaacccgttttaaacggggtttaacgggttaccccgggttaaaccgggttttcccccggggttaaacgggttttaaaccgggtaaaccccgggggtaaaacccggttaacgggggttaaaccggggttaacggggtaaaccgtaaaccggttaaaccgggtaccggttaggaccggttacctacgggtacccctacggtttcgttaacccggtttccgtttaccgttaaacccgttccgttttaccccggggtaaccccttccgggttaaaccgtttaacgggtttaacccgttttaaagggtttacccgttttaacggtttacccgggttaaccgtttcccggggtaaccggggg

SEQ ID NO: 161740 - DNA, 749 bp, Homo sapiens
  misc_feature: GYAE6OF01AFVU5.48.25.C03.1.454.CMB.1.raw
  modified_base (458)..(458): a, c, t, g, unknown or other
  misc_feature (458)..(458): n is a, c, g, or t
  modified_base (743)..(743): a, c, t, g, unknown or other
  misc_feature (743)..(743): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcacgtccccagccacctgtctgtcgtctccgaagggggaaagcgtccaccctctcctgcgacgggccagtcgagacgttcttgacacgtcttccgttacgcctacgggtaaccaaacgaacggccgtcggcccaacgtcccctacccgaggtccttacccgtattagtttaacgtagtaactaccacgttacccaccggcggggtaccctaacgtcgggtttaccgcccacggtccgttacgggtcctacggggttgggtccggggtcgggtttcggtagggaacgtacggggttactttccacttccccggttanaacccgtataccgcgtacccgacgtccgtacgacgttcggtataggttaagttactttttaacgtttagttttacttacgttgccgtaagttacgaacgttttagtaacgggttcggtaaccggttacggtacccgggtttggttaccggaacccggaagggtaacccgaagggttaacgaaggtaaaccgtaaacgtctgggaccgtacgaccgtacctatgtcccttgttacccttactccggtcccctacgccttaagtcaaggttactgttactatttcgngtaggg

SEQ ID NO: 161741 - DNA, 978 bp, Homo sapiens
  misc_feature: GYAE6OF01E0HMB.48.25.C03.1.454.CMB.1.raw
tcagagtatacatacacgaccggtgctcgatttagtagtgtagatttgggtttgggggaggaactgctcagttaggacccagacggaaccatggaagccccgagcgcagcttctcttcctcctgctactctggctcccagattccactggacaaatagtgatgacgcacgtccccagcccacctgtctgtcgtcctaccgaaggggaaagacgtaccaccccttctcctggccgacgggccaaggtcgaaggtacgttcgttagaccacggtccttaccgttacggtacccgttacggtaaacccaaaacggtaaacggtcccgtacgggacccgacggtccccctacccggacggtcccttaccctcttaacgttttatacgtactaaccgaccgttaccccgaacccgggacggggtacccctacggttaccggttacccgtaccccgaacggtacccgttacgggtttccgtaaccggtcggggtccggggttacggggtccgtaacgggggacccttaacggttaccgtttacccgtaccgttacccgtacccgtaaacccctagtaaccggaccgtaccgtaccggttacccgttaggtacccgttaaaccggtttacgtaacggtttaaacttttaaacgttttttaaccttaagttttttaacccggttaactcgttaacgtaacggttacctttaaaggttaccggtttacgggttaaacgggtaccccggttaaccgttcccgggggttttaaaccggttaaccgggtaaaccgggtaaacccggggtaaccggtttaaaagggggacccggttaaaccggttaaacccgtaaaacgggttaacccgggtttcgggaaccggttaacggtcccgtaaaacccgttacgttaaccgtttcccggttaacctttaccccgtttaacctacccggttaccccctttcccccgggtaacttacgttaacccgg

SEQ ID NO: 161742 - DNA, 267 bp, Homo sapiens
  misc_feature: GYAE6OF01EC7GZ.48.25.C03.1.454.CMB.1.raw
  modified_base (187)..(187): a, c, t, g, unknown or other
  misc_feature (187)..(187): n is a, c, g, or t
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (216)..(267): a, c, t, g, unknown or other
  misc_feature (216)..(267): n is a, c, g, or t
tcagagtatacatacacgaccggtgctcgatttagtagtgtagatttgggtttgggggatcaggactcctcagttcaccttctcacaatgaggctccctgctcagctcctggggctgctaatgctctgggtcccaggactgtgctgcacatctgtctcatccttcccgcatctgatatgtatactcngacggcggctggaccaggccgnatagntnnnnnnnnnnnnnnnnnnnnnnnnnnnnnnnnnnnnnnnnnnnnnnnnnnnn

SEQ ID NO: 161743 - DNA, 831 bp, Homo sapiens
  misc_feature: GYAE6OF01C09TM.48.25.C03.1.454.CMB.1.raw
  modified_base (206)..(206): a, c, t, g, unknown or other
  misc_feature (206)..(206): n is a, c, g, or t
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (390)..(390): a, c, t, g, unknown or other
  misc_feature (390)..(390): n is a, c, g, or t
tcagagtatacatacacgaccggtgctcgatttagtagtgtagatttgggtttgggggaggaactgctcagttaggacccagacggaaccatggaagcccagcgcagcttctcttcctcctgctactctggctcccagattccactggaacaaatagtgatgacgcagtccccagccaccctgtctgtgtctccgaagggggaaangtacaccctctcctgcagggccagtgaagagtcttgacagcttacctagcctggtaaccaaacaaaggcctgggaccaaggccctacccgaggcctacctanaattttangtaataacactccaccgagggcccagtggtctacccgagacctagggttacaccgtgggaccggttgggtacgngggaacgagtacggtttacaacgttcctaccacccgtaatcgaaggccacgtccctgaccctagggttactacggtaaagttaactttttttaacgtaactttttttaaaacttaccgtggttaacctaaggttacctaaagggtttaacgttaaccggtttaaacgggttggggtaaaccccgtttaccggttaaccggggtttttaacgggaaaccccgggtaaacggggggtaaaccccgtaaaagggggtttaccgggggtaaaacgttaaacccggtaaaaaaaaccgggtttaaacgtcggggttaaggggtacccgttaaaccgggtaaccccaaaccggtttaaaacgttttcccgttaaccgggtttactttacccgttaaaacgtttcccccgtttttaaaccccccgggaaccctttaaggggttaaccc

SEQ ID NO: 161744 - DNA, 727 bp, Homo sapiens
  misc_feature: GYAE6OF01AMWSB.48.25.C03.1.454.CMB.1.raw
  modified_base (390)..(390): a, c, t, g, unknown or other
  misc_feature (390)..(390): n is a, c, g, or t
  modified_base (496)..(496): a, c, t, g, unknown or other
  misc_feature (496)..(496): n is a, c, g, or t
  modified_base (722)..(722): a, c, t, g, unknown or other
  misc_feature (722)..(722): n is a, c, g, or t
tcagagtatacatacacgaccggtgctcgatttagtagtgtagatttgggtttgggggaggaactgctcagttaggacccagacggaaccatggaacgccccagcgcagcttctcttcctcctgctactctggctcccagattccactggacaaatgtgatgacgcagtccccagcccacctgtactgtacgtcctaccgaaggggaaacgcgttacccacccgttctaccgtgccgaggggtcccagttcgagtagtcgttacgaccgtagtccttaccgttacggaccgttacggtaaaccaaaccgtaaacgggcccttacggggaccctaacggtcccccgtaacccggtacggttccccttacccggtacctttaagttttaacncgtaaccgttacctaccgtaacccgtaaccggacgggtacccttaaggtcggtccgtacccacgaccgttacggtcctaacggtcgggtcgtggtacgcggaacgngtacgtttcacctcgacacgtactacgagcctacgcctagaccttgactagtactttaacgtttactaattttctacgttcgtacgtactactaagttacgtacgttaaggtccgtaccgttcggttaccgtacggaccgtaacggaacgttagggtacgaataacgaccgtgacgtcgacgtacgactaacgtcttcgtacgttactcgccttacctaccgtctnttacg

SEQ ID NO: 161745 - DNA, 642 bp, Homo sapiens
  misc_feature: GYAE6OF01EN6OM.48.25.C03.1.454.CMB.1.raw
  modified_base (257)..(257): a, c, t, g, unknown or other
  misc_feature (257)..(257): n is a, c, g, or t
  modified_base (292)..(292): a, c, t, g, unknown or other
  misc_feature (292)..(292): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
  modified_base (409)..(409): a, c, t, g, unknown or other
  misc_feature (409)..(409): n is a, c, g, or t
  modified_base (633)..(633): a, c, t, g, unknown or other
  misc_feature (633)..(633): n is a, c, g, or t
tcagagtatacatacacgaccggtgctcgatttagtagtgtagatttgggtttgggggaggaactgctcagttaggacccagacggaaccatggaagcccccagcgcagcttcctcttccctcctgcctactctggcctcccagattccactggaacaaatgtgatgacgcacgtcccccagcctaccctgtctgtgtcctccgaaggggtaatcgtccaacccttctccgtgcgagggccagtgagtagtctgacngctcctagccgtagaaccaacgaacgcctcggccngccctccgcgcctctntattancgatacnctccaccgtcggcctacgtcgctaccgacgccgtaggttccaggtcgggcggtcggtcgtagggactaggtcgtccacgtccacaccntaccgacgtcacgtccgtgctagtcgtagtaactttatttaacgttatttagtacgtcgtacgtcgtacgtaagttacgtacggtacgtccgtaacggttccgttaacgggttaccgaaccggtaacgggaccgttaaggtacggtaacgtacgtaaacggtcgtaggtccgtacgcgtactaacgtcttccgtagttaccttcctaccgttcccgttcccgtntaccgttag

SEQ ID NO: 161746 - DNA, 798 bp, Homo sapiens
  misc_feature: GYAE6OF01EKCBL.48.25.C03.1.454.CMB.1.raw
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
  modified_base (271)..(271): a, c, t, g, unknown or other
  misc_feature (271)..(271): n is a, c, g, or t
  modified_base (765)..(765): a, c, t, g, unknown or other
  misc_feature (765)..(765): n is a, c, g, or t
  modified_base (793)..(793): a, c, t, g, unknown or other
  misc_feature (793)..(793): n is a, c, g, or t
tcagagtatacatacacgaccggtgctcgatttagtagtgtagatttgggttgggggaggaactgctcagttaggacccagacggaaccatggaagccccagcgcagcttctcttcctcctgcctactctggcctcccagtacttccacgtggacaaatagtgatgacgcagtcccagcctacctgtctgtntactcgaagggaangtccacctctccgagcacgggtaccaggttagagtacgtcttcggaacacgtacctaccgtttanaccccgttaggaaacccgaaaacgaaaccggttaccgacgggtaacccacggtaccccgtaacccgtaacggggtcccttaccgtaaccttaattttaacggttaaccgtaataaacccgttaacgtaaccccgaaacccggtaaccgggtacccgtaaacgttccgggttccgtaaccccgaaggtaccccggttaaacggttaccaaccgggttcggggtccgggttaacggggttccggtaaggggaacgtaacggtacgtaccgtaaccttccggtaaccaacctagtaccgaaagctaccgtaccgtcgtaacgtacgttaacgtaggtaaactttacgtttaactaacgttttaataaccgtacgttcgtagtaacgtagttaacgtacgttaacggtcggtactaccggttacggttacgacgtaaagggacctaaggtaacgaacgttaacgaaacgtacggttgtacgtcgtagtcaacgttacncgttatcgttactactaccctcgacctntaacg

SEQ ID NO: 161747 - DNA, 648 bp, Homo sapiens
  misc_feature: GYAE6OF01BBOYX.48.25.C03.1.454.CMB.1.raw
  modified_base (183)..(183): a, c, t, g, unknown or other
  misc_feature (183)..(183): n is a, c, g, or t
  modified_base (317)..(317): a, c, t, g, unknown or other
  misc_feature (317)..(317): n is a, c, g, or t
  modified_base (426)..(426): a, c, t, g, unknown or other
  misc_feature (426)..(426): n is a, c, g, or t
  modified_base (437)..(437): a, c, t, g, unknown or other
  misc_feature (437)..(437): n is a, c, g, or t
  modified_base (571)..(571): a, c, t, g, unknown or other
  misc_feature (571)..(571): n is a, c, g, or t
  modified_base (578)..(578): a, c, t, g, unknown or other
  misc_feature (578)..(578): n is a, c, g, or t
  modified_base (590)..(590): a, c, t, g, unknown or other
  misc_feature (590)..(590): n is a, c, g, or t
  modified_base (609)..(609): a, c, t, g, unknown or other
  misc_feature (609)..(609): n is a, c, g, or t
  modified_base (617)..(617): a, c, t, g, unknown or other
  misc_feature (617)..(617): n is a, c, g, or t
tcagagtatacatacacgaccggtgctcgatttagtagtgtagatttgggtttggggagacggaaccagtggaagccccagcgcagcttctcttcctcctgctactctggctcccagacttccactggacaaatagtgatgacgcacgtcccagtccaccctgtctgtgtctccgagggaagngtccacctctccgtgcgagggccagtggagtgtcgttgacacggtccttcgttacgccttacgggtaaccaacgaaacgggtccgacggcccgagtaccccgtccgaacggtcccttacccgtactactttaancgtacttaacgacttccaaccgcgggacctacgtggtaccgtcccgagaccgtcgttacacggtgtcggttaggtacgtgaccgtagcgttactcgtactacacacgtnacgcgaactcncgtacgtacgtcgagtaagctttagtaccgtactaacttacgttactacggtactaacgattacgttacgtaacgtacccgttacgttactacggttcgacgggtacgacgtaggcgagtactagtaacgtagnggtactnacgcactacgtntcgtacgtccacgtttccncccgttanccgtactacgtattacgtccgtaccttacgg

SEQ ID NO: 161748 - DNA, 840 bp, Homo sapiens
  misc_feature: GYAE6OF01CCZP0.48.25.C03.1.454.CMB.1.raw
  modified_base (204)..(204): a, c, t, g, unknown or other
  misc_feature (204)..(204): n is a, c, g, or t
  modified_base (779)..(779): a, c, t, g, unknown or other
  misc_feature (779)..(779): n is a, c, g, or t
  modified_base (832)..(832): a, c, t, g, unknown or other
  misc_feature (832)..(832): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccatggacaaatagtgatgacgcagtccccagcctaccctgtctgtgtctccgaggggaaancgtccaccctctcctgcagggccagtgagacgtcgttagacacgtcttccgttagccttacgggtaacccaaacgaaacggtcccgttcgggacccacggtacccccttacccggaacgggtcccttacccgttaccttaatttttacgtacggtaacctaaccgtaccgttaccccgaaaccggtaccggggtaccctaaccggtttcgggttacccggtacccccgacgggtaccccgttaacgggtttcccgaaccgggtttcgggggtaccgggggtttcggggttaccggtacggggggtaaccgaacgggttaccggtttacccaaccggttcctaccctaaaccgtacgttacgacggccgtacgtccgttcgacgtacggttcgtaacggttaacgttttaaacttttacgttaatttttacgtactcgtactacgtactagttaacgtacggttaagtaccggtaccgttcggttacggttcggaaccggtaacggtacggtacgggtaacgtaacgtaccgtaaaggttaccggtggtaccgtcgtaccgtacccgaaaccgttnttaccgttccgttaccgtttaccgtaccccgttaccccgttacccgtacgttnttacccgg

SEQ ID NO: 161749 - DNA, 665 bp, Homo sapiens
  misc_feature: GYAE6OF01BL0EK.48.25.C03.1.454.CMB.1.raw
  modified_base (181)..(181): a, c, t, g, unknown or other
  misc_feature (181)..(181): n is a, c, g, or t
  modified_base (217)..(217): a, c, t, g, unknown or other
  misc_feature (217)..(217): n is a, c, g, or t
  modified_base (277)..(277): a, c, t, g, unknown or other
  misc_feature (277)..(277): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaanagtcaccctctctgcagggccagtgagagtctgacngctccttagcctaggtaccaacaaggcctggccagccctcccaggcctcctctagtttangatacatccaccgagggcccacgtggtctcccagcctaggttcacgtggcggtgggctagggacagtacgttccacgttcaccacctatccgagccgacgtccgtcgactacggtacgtaggtaaacgtttactttttaaactttaatttttacgttaccgttagtacgtaagtactaagttacgtacggtaaggttcggtaaccgttccggtacgtttacggaccggtaacgggaccgtaaagggtaggtaaacgtaacgtaaacggtagttacggtacgtcgtacgacctaaccgtagttccgttacgttaccgttacgtactttcccgttacccgccgttacgttccgtagttacttacgttagttacttaccgtcggttacggg

SEQ ID NO: 161750 - DNA, 276 bp, Homo sapiens
  misc_feature: GYAE6OF01EG24K.48.25.C03.1.454.CMB.1.raw
  modified_base (156)..(156): a, c, t, g, unknown or other
  misc_feature (156)..(156): n is a, c, g, or t
  modified_base (186)..(186): a, c, t, g, unknown or other
  misc_feature (186)..(186): n is a, c, g, or t
  modified_base (234)..(235): a, c, t, g, unknown or other
  misc_feature (234)..(235): n is a, c, g, or t
  modified_base (237)..(276): a, c, t, g, unknown or other
  misc_feature (237)..(276): n is a, c, g, or t
tcagagtatacatacacgaccggtgctcgatttagtagtgtagatttggggtttgggggatcaggactcctcagttcaccttctcacaatgaggctccctgctcagctcctggggctgctaatgctctgggtcccagggaactggtggctgcaccntctgtcttcatccttcccgccatctgattntgtatactcgtggacggccgggctgggacgaagggccgactaagtagnngnnnnnnnnnnnnnnnnnnnnnnnnnnnnnnnnnnnnnnnn

SEQ ID NO: 161751 - DNA, 849 bp, Homo sapiens
  misc_feature: GYAE6OF01AZY0U.48.25.C03.1.454.CMB.1.raw
tcagagtatacatacacgaccggtgctcgatttagtagtgtagatttgggtttggggagacggaaccatggaagccccagcgcagcttctcttcctcctgctactctggctcccagattccactggacaaatagtgatgacgaacgtccccagccaccctgtctgtcgtctccgagggaagacgtcaccctctcctgacgacggccaggttgagtacgtcttagacagtccttcgttacggtccgttacggtaacccaaacgaaacggtcccgtggcccaccgtcccgtaccgacggccttaccctcttattttaagtgtactacacttaccgaccgacggtccctacggttcgggtacgtacccgacgtaccgtacggttccacggttcggggtccgggttcggggttcgtacggggacgtagtacggttcctacttccgtaccacgtactcgaccgtctacggccgtacgcgtaacgttcgtaacgttaaggtttaacttttaacctttaattttaactttcgttagttaccgtaacgtacttaaagttaacgttacggttaaacggttccggtaacccggttaccgggtttacggtttaaccgggtaaccgggtaaccgggtaaccggttaacggggttaacgggtaaaccgttaaaccggaaaacggttacggttacggtacgggttaccctacgggtaaccctaccggttaaccttccggtttacgttcccgttaaccgtttaaccgtttcccccgtttaccccgacgttaacccgtttcgttaaacggttactttaaacgggtttactttaacgttacccgttacggttacggggtaccgggg

SEQ ID NO: 161752 - DNA, 881 bp, Homo sapiens
  misc_feature: GYAE6OF01A8Z4W.48.25.C03.1.454.CMB.1.raw
tcagagtatacatacacgaccggtgctcgatttagtagtgtagatttgggtttggggagacggaaccatggaagccccagcgcagcttctcttcctcctgctactctggctcccagattccactcggacaaatagtgatgacgcacgtccccagcccacccttgtctgtcgtctccgtaggggaacgacgtccacccttctcctgcgacgggcctaagtgagtacgtcttagaccgagtcctccgttacgtccgtaggttaacccgaacgtaaacggtccctacgggacccacggtccccttacccggacggtccgttaccttacgttacttttacgtacgtacttaacgttacctacccgaccggtacgggccctacggtaggtccgtacctacggtccgtacgttccgacggttcgggaccggtgggtccgtgggactaggactttccgaactttccgtacgtaacccgatacgtaccgtacaacggtcccgttaacggtccgtacggtactttaaccgggaaaccttttagttttaaacccgttagtttttaccgttacgtaccgttaacgtaccttaccggttaagtttaccgtttaacgggttaaacgttccgggtaaacccgtttaccgggtttaacccggtttaacggaccccggtttaaagggccgggtttaaaccgggtacggttaaacccgtaacgggtaaaccggtttacgtaacgggtttccggaaccgttaccggtaacctaccggtttaccgttaccggttaacgttcccgtttaaacccgttcccttaccccggttaccccgttaacgtccgtttactaacgtttccttaaacgggtttcctaaaccttggttaaaccggttcggg

SEQ ID NO: 161753 - DNA, 878 bp, Homo sapiens
  misc_feature: GYAE6OF01DYTDU.48.25.C03.1.454.CMB.1.raw
tcagagtatacatacacgaccggtgctcgatttagtagtgtagatttgggtttgggggaggaactgctcagttaggacccagacggaaccatggaagcccagcgcagcttctcttcctcctgctactctggctcccagattccacgtggaacaaatgtgatgacgcacgtccccagcctacctgtctggtcgtctccgaaggggaacgcgtccaccctctcctgcgacgggccagtgagcgttctcgacacgtccttaccgtacgcctacggtaaccaaacgaacggtccgtacggaccgacgcccgtacccgacggtcctacctactactttagtacgtaataacctacgtacccgtaccggaccggggtacctacggttcggtaccgttaccccgacgtacccgttacgggtttaccgaaccgggttcggggtaccggggttacgggtccggtacggggtaaactacgggttacgtttaccgtaccttccgtaaccctaacctacgtaccgtacgtaccgtacgtccgttacggaccgttaacggtttaacgtaacggttaaactttttaaccgtttttaactttaactttttaacgttaccggtagttaaccgtacgtaacgttacggtttaaggttaaccgggttaacgttaccgggtaacccggttttaaccgggttaccggttaacgggaacccgggtaaaccgggttaaaccgggtaaacgggtaaccgggtaacgtaaacccggtaaacggttccggttagggtccgttaaccggtaccgtaaccgttaacccgttagtttacccggtttccgttacccgtttaccgttacccgtttacccccgtacccgttaaccgttcggttaaccgg

SEQ ID NO: 161754 - DNA, 770 bp, Homo sapiens
  misc_feature: GYAE6OF01ASORX.48.25.C03.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (243)..(243): a, c, t, g, unknown or other
  misc_feature (243)..(243): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcacgtccccagccaccctgtctgtgtcctaccgaggggaanagtcaccctntcctgcagggccagtgagagtctgacngtctccttagcctaggtaaccaacgaacggcctggccagtcccgtcccgaggccttcccgtactattttatacgacttacacttcccgaaccgtacgggaccctaacgttcgggtaccgtaccccgaagtccccgtacgggtttccaaccggttgggtccgggttagggtcgtacgggggactacggttacgtttccgaccgttacctaccgaaccctgttaccacggtccacggtcctacggctaacggttctaaggtaacgtttactttttaacctaattttttaccgttaacgttacgtactaggtactacggttacgttacgggttacggttacggaccctttcgggttaaccgtttcgggaaccgtaaacggggttaacctaaggggttacggtaaacgtaacccgaaaagtaaccgggttggtaaacgggtcgtcccggtaccgacccgttagttacccggtttactttacccgtttaccaccgtttttaccccggcccccttaccggtactttacccggg

SEQ ID NO: 161755 - DNA, 830 bp, Homo sapiens
  misc_feature: GYAE6OF01BFYJQ.48.25.C03.1.454.CMB.1.raw
  modified_base (187)..(187): a, c, t, g, unknown or other
  misc_feature (187)..(187): n is a, c, g, or t
  modified_base (234)..(234): a, c, t, g, unknown or other
  misc_feature (234)..(234): n is a, c, g, or t
tcagagtatacatacacgaccggtgctcgatttagtagtgtagatttgggtttggggagacggaaccatggaagccccagcgcagcttctcttcctcctgctactctggcctcccagattcccactggacaaatagtgatgaccgcacgtccccagcccaccctgtctgtcgtctccgaggggaaancgtccaccctctcctgccgagggcctaggtgagtacgttcttgaccngtccttccgttagcccgtaggtaacccaaacgtaacgggcctcgggacccacgtcccctacccgaggcccttccctattaactttagtacgtaaccttaaccgacttaccccgaacccggtacggggtaccccctacggtcggggttcccgtacccccgaggtacccgtacggggtttaccacggggttcgggggtacccgggggttgggttcgggtaacgggggaccgttaacgggttaacgttcccgtaccttccctaacccgtaccgtaatcccgacggaccctacggtccgtccgacgtagttccgtaaagttaaccgtttaacttttacgtttattttaacgttacgttagtacgtaacgttaccgttaaggttacgtaccggttaacggtacggttaacccggttaccgggtttacggttaccggaaccggtaacgggaaccgggttaagggacggtaaacgtaaccgtaaaggtacggttacggtcgtaccgtagtaccgtaaccttcttacgttcgttcccttaccgaccgttcccctacccggtccttagttcctagttacttagttacgttacttccgtgggtacg

SEQ ID NO: 161756 - DNA, 637 bp, Homo sapiens
  misc_feature: GYAE6OF01B830H.48.25.C03.1.454.CMB.1.raw
  modified_base (472)..(472): a, c, t, g, unknown or other
  misc_feature (472)..(472): n is a, c, g, or t
  modified_base (606)..(606): a, c, t, g, unknown or other
  misc_feature (606)..(606): n is a, c, g, or t
  modified_base (614)..(614): a, c, t, g, unknown or other
  misc_feature (614)..(614): n is a, c, g, or t
tcagagtatacatacacgaccggtgctcgatttagtagtgtagatttgggtttggggagacggaaccatggaagccccagcgcagcttctcttcctcctgctactctggctccagattccactggacaaatagtgatgacgcagtccccagccaccctgtctgtgtctccgaaggggaaagcgtccaccctctccgtgcgagggcctagtgagagtcttgacagcttcttagccgtaggtaaccaaacgaacggcctacgggcccacgtccctacccgaggtcctccgtactaattttatacgtactaactactacccacgacggtccacgtggtcgtcccgagtacccgaggttcgacgtcgggtcgggtcggtacgtgggaacaggtactccgtactccgactacccagtccacgctacgcctgaccgtattaccgagtaaacttagttttactaagttttacttacgtntactagtctaagtacgtacgtacggtcgacttcggtaccgttacggacgtaacgggtaacgtaacggtagaacggtaacgaaacgtacgtagtggactgaccaccgtatcgttcagttcctacgtccctacctntacctgtntactagtactaactcgtgacggg

SEQ ID NO: 161757 - DNA, 736 bp, Homo sapiens
  misc_feature: GYAE6OF01DIQKD.48.25.C03.1.454.CMB.1.raw
  modified_base (199)..(199): a, c, t, g, unknown or other
  misc_feature (199)..(199): n is a, c, g, or t
  modified_base (241)..(241): a, c, t, g, unknown or other
  misc_feature (241)..(241): n is a, c, g, or t
  modified_base (488)..(488): a, c, t, g, unknown or other
  misc_feature (488)..(488): n is a, c, g, or t
tcagagtatacatacacgaccggtgctcgatttagtagtgtagatttgggtttgggggaggaactgctcagttaggacccagacggaaccagtggaagccccagcgcagcttctcttcctcctgccttacgtctcggcctcccgagtacttcccaagtggaactaaagtgtgatcgacgcacgtcccagccctaccgtntctgtcgtcgtacggaaggggaactacgtccaccctcgtccngcgtagggcctaaggtcgaagtcgttcttaggactagtccttccgttacggcgttacggaaacctaaacggaaactccggtacgaccgtaacggtccaccgtaactacctcctacgtatcgttatacgtatccggacgttaccgaccggtacgggcctacggtccgggtccgtacccgcgtgtacggacgtcgacgtcgggttcggtcgtacgggtacacgttacttcaaccgtttcaccctaaacncgtacgtacgaccgtaagaccgtaacggaccggtacgttaacgtttagtttaccggttacggttttactacggttcgtacacggtacgtcggtacggccgttaaccggacttccggtcccgtcttaaccggggtccggttaccggggaacggaacgggtaccggtaggtacctaccgtaaacggtaccgaacggttaggcgtcgtatcggacttccgattccgttagtctaccgtacttcccgctacg

SEQ ID NO: 161758 - DNA, 757 bp, Homo sapiens
  misc_feature: GYAE6OF01AMVZL.48.25.C03.1.454.CMB.1.raw
  modified_base (186)..(186): a, c, t, g, unknown or other
  misc_feature (186)..(186): n is a, c, g, or t
  modified_base (213)..(213): a, c, t, g, unknown or other
  misc_feature (213)..(213): n is a, c, g, or t
  modified_base (487)..(487): a, c, t, g, unknown or other
  misc_feature (487)..(487): n is a, c, g, or t
tcagagtatacatacacgaccggtgctcgatttagtagtgtagatttgggtttgggggaggaactgctcagttaggacccagacggaccatggaagccccagcgcagcttctcttcctcctgctactctggctccagattccactggacaaatagtgactgacgcagtcccagccacctgtctgtntcgtccaggggaacgagtccgaccctntcctacgcagggccagtcgtagagtcttgacagtctccttagccgtaggtaaccaaacgtaaacggccgtacggaccgacgtacccgtcccgacggtccttaccttactagtttaagtacgtaactaaccgacttaccccacggaacgggccacggttcggtacttacccgacgtccgtaggtttaccgacgtgggtcggttcgggtacgtacggggtactacggaggttttaccacgtaccgttcaacctatacgacgtacgtaccgaccgtntacccggatttccgtaagtaaagtttaacgttttaacttacttttaaattacgttctacgtacgtaacgtaacggttatttaaccggtaaggttacggaccgtttacgttaacggttacgggacccgtaaagggggttacctaaaacggggcttaaacggtaacccaaagggttaccgtaaacgggttccgggataaccgggtacttaccgactttccggttacgttcccgtacttaaccgtaccccgtttcctaaccgtccttaacggg

SEQ ID NO: 161759 - DNA, 864 bp, Homo sapiens
  misc_feature: GYAE6OF01DX3SE.48.25.C03.1.454.CMB.1.raw
  modified_base (184)..(184): a, c, t, g, unknown or other
  misc_feature (184)..(184): n is a, c, g, or t
  modified_base (195)..(195): a, c, t, g, unknown or other
  misc_feature (195)..(195): n is a, c, g, or t
  modified_base (231)..(231): a, c, t, g, unknown or other
  misc_feature (231)..(231): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcacgtccccagcccaccctgtctgtgtctccgagggggaaancgtccaccctntcctgcgacgggcctagtgaggacgtcgttagaccncgtcctacgtttacggccctacgggttaaccaaaccggtaacggtccgtacggtacccaccgtccccgttacccgacggtacccttcccgttaccttaagtttagtcggtaaccttacgtaccgttacccccgaaaccggtacgggtaccccctaacgtttcgggtacccggtaccctaaccgggtccggttaacggtttacccggaaccggttcggggtccggggttacggggtttaccggtacgggggtacctaacggggttaccgtttaccgacccgtttccgttaacccgtaaccgacgtttacgaccggtaccgaaccggtcccgtacgacggtacgttccgtaacggttaaacgtttaacttttacgtttaactttttacttacgttacgtacgtacgtacgttaacgttacgtaacggttacggtacgttaccggtaaccggttacggttacggaccggtaacggtaaccggtagggtaacggtaacgtaacgaacggtaacgtacggtacgtcgtacgtcgtaacccgtattaccgtcgttaccgttaccgtaccgtttccccgtccgtaaccgttacggtacctagttaaccttaggttaccttacgttcctgggttaaccggg

SEQ ID NO: 161760 - DNA, 214 bp, Homo sapiens
  misc_feature: GYAE6OF02G9SIM.48.25.C03.1.454.CMB.1.raw
  modified_base (213)..(214): a, c, t, g, unknown or other
  misc_feature (213)..(214): n is a, c, g, or t
tcagagtatacatacacgaccggtgctcgatttagtagtgtagatttgggtttgggatcaggactcctcagttcaccttctcacaatgaggctccctgctcagctcctggggctgctaatgctctgggtcccaggaactgtggctgcaccatctgtcttcatcttcccgccatctgatatgtatactctgagcgggctggcaaggcgcatagnn

SEQ ID NO: 161761 - DNA, 234 bp, Homo sapiens
  misc_feature: GYAE6OF02GL0I2.48.25.C03.1.454.CMB.1.raw
  modified_base (214)..(234): a, c, t, g, unknown or other
  misc_feature (214)..(234): n is a, c, g, or t
tcagagtatacatacacgaccggtgctcgatttagtagtgtagatttgggtttggggatcggagggctcctcagttcaccttctcacaatgaggctccctgctcagctcctgggctgctaatgctctgggtcccaggaactgtggctgcaccatctgtcttcatcttccgccatctgatatgtatactctgagcgggctggcaaggcgcatagnnnnnnnnnnnnnnnnnnnnn

SEQ ID NO: 161762 - DNA, 505 bp, Homo sapiens
  misc_feature: GYAE6OF02JD5BK.48.25.C03.1.454.CMB.1.raw
  modified_base (476)..(476): a, c, t, g, unknown or other
  misc_feature (476)..(476): n is a, c, g, or t
  modified_base (486)..(486): a, c, t, g, unknown or other
  misc_feature (486)..(486): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtggtctgggacagagttcactctcaccatcagcagcctgcagtctgaagtattttacattttatactgtcagcagtatcgtaatggactcgacgtttggccaagggaccaagggtgaaagtcaaacgactgnggctgcacgntctgtctcatctccgcatc

SEQ ID NO: 161763 - DNA, 217 bp, Homo sapiens
  misc_feature: GYAE6OF02I4A01.48.25.C03.1.454.CMB.1.raw
  modified_base (214)..(217): a, c, t, g, unknown or other
  misc_feature (214)..(217): n is a, c, g, or t
tcagagtatacatacacgaccggtgctcgatttagtagtgtagatttgggtttgggggatcaggactcctcagttcaccttctcacaatgaggctccctgctcagctcctggggctgctaatgctctgggtcccaggaactgtggctgcaccatctgtcttcatcttccgccatctgatatgtatactctgagcgggctggcaaggcgcatagnnnn

SEQ ID NO: 161764 - DNA, 503 bp, Homo sapiens
  misc_feature: GYAE6OF02J00ST.48.25.C03.1.454.CMB.1.raw
  modified_base (492)..(492): a, c, t, g, unknown or other
  misc_feature (492)..(492): n is a, c, g, or t
  modified_base (501)..(501): a, c, t, g, unknown or other
  misc_feature (501)..(501): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcacgtggcggtgggtctgggacagagttcactctcaccatcagcagcctgcagtctgaagtattttacattttatactgtcagcagtatcgtaagtggacttcgacgtttgccaagggaccaaggtgaagtacaaacgactgtgctgcacatctgtcttcgatccttccgctatctgatntgtatactntg

SEQ ID NO: 161765 - DNA, 216 bp, Homo sapiens; identical to SEQ ID NO: 161535
  misc_feature: GYAE6OF02HRSMM.48.25.C03.1.454.CMB.1.raw
  modified_base (214)..(216): a, c, t, g, unknown or other
  misc_feature (214)..(216): n is a, c, g, or t

SEQ ID NO: 161766 - DNA, 516 bp, Homo sapiens
  misc_feature: GYAE6OF02IINJZ.48.25.C03.1.454.CMB.1.raw
  modified_base (370)..(370): a, c, t, g, unknown or other
  misc_feature (370)..(370): n is a, c, g, or t
  modified_base (512)..(512): a, c, t, g, unknown or other
  misc_feature (512)..(512): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctccaggctcctcatttatgatacatccacagggccactggtgtcccagccaggttcactggcggtggtctgggacagagttcactctcaccatcagcagcctgcagtctgaagtnttttacattttattactgtcagcagtatcgtaagtggacttcgtacgtttggaccaaagggaccaagggtgaagtacaaacgtactgtagctgcacctatctgtcttcattccttccgcctatctgatattgtacttacgtntagg

SEQ ID NO: 161767 - DNA, 511 bp, Homo sapiens
  misc_feature: GYAE6OF02IW0H5.48.25.C03.1.454.CMB.1.raw
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
  modified_base (335)..(335): a, c, t, g, unknown or other
  misc_feature (335)..(335): n is a, c, g, or t
  modified_base (480)..(480): a, c, t, g, unknown or other
  misc_feature (480)..(480): n is a, c, g, or t
  modified_base (497)..(497): a, c, t, g, unknown or other
  misc_feature (497)..(497): n is a, c, g, or t
  modified_base (509)..(509): a, c, t, g, unknown or other
  misc_feature (509)..(509): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttangatacatccaccagggccactggtntcccagccaggttcacgtggcggtgggtctgggacngagttcactctcaccatcagcagcctgcagtctgaagtattttacattttattactgtcagcagtatcgtaagtggactcgtacgtttggaccaagggaccaagggtgaagtacaaacgaacgtgtgctgcaccatctgtcttcnttccttccgcctatctnatatgtatactntg

SEQ ID NO: 161768 - DNA, 214 bp, Homo sapiens
  misc_feature: GYAE6OF02HEQ0O.48.25.C03.1.454.CMB.1.raw
  modified_base (213)..(214): a, c, t, g, unknown or other
  misc_feature (213)..(214): n is a, c, g, or t
tcagagtatacatacacgaccggtgctcgatttagtagtgtagatttgggtttgggggatcaggactcctcagttcaccttctcacaatgaggctccctgctcagctcctggggctgctaatgctctgggtcccaggaactgtggctgcaccatctgtcttcatcttcccgatctgatatgtatactctgagcgggctggcaaggcgcatagnn

SEQ ID NO: 161769 - DNA, 629 bp, Homo sapiens
  misc_feature: GYAE6OF02H3N5S.48.25.C03.1.454.CMB.1.raw
  modified_base (340)..(340): a, c, t, g, unknown or other
  misc_feature (340)..(340): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagcctcccaggcctcctcatttatgatacatcccaccagggccactggtcgtcccagccaggttcacgtggcggtgggtctgggacaggngttcactctcacatcagcagcctgcagtctgaagtattttacattttattactgtactagtctagtactcgtaagtcggaccttccggtacgtttcggaccgaaaggggtaccctaaagggttcggaaacgttaccgaaaacggtaaccgttggtacgggaccttacggacctaacccgttagttcccgttaggtttaccttttaccgaacgtttccccgtttacccccggacccttacttcccgttacggtaacttacgtttacggtttaacttaccgttactacggg

SEQ ID NO: 161770 - DNA, 554 bp, Homo sapiens
  misc_feature: GYAE6OF02GFYX6.48.25.C03.1.454.CMB.1.raw
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctccaggctcctcatttatgatacatccaccaggccactggtcgtcccagccaggttcactggcgtggtctgggacagagttcactctcaccatcagcagcctgcagtctgaagtattttacattttatactgtcagctagtatcgtaagtggactcgagtttcggacctaagggacctaagggtggaaagtacgaaaacgacgttaggtacggcgttcggaccaaccgtattccgttagtcctttacgaacttcccgtttaccccggctacttccg

SEQ ID NO: 161771 - DNA, 600 bp, Homo sapiens
  misc_feature: GYAE6OF02JQ6N3.48.25.C03.1.454.CMB.1.raw
  modified_base (276)..(276): a, c, t, g, unknown or other
  misc_feature (276)..(276): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagccctccgaggcctcctcatttangatacatccacgaggccacgtggtcgtcccagccaggttcacgtgggcggtgggtctgggacaggtagttcactctacacctatcagcagcctgctagtctagaatattttacattttatactgtacagtctaagttactcggtaagtcggtaccttccggtacggtttacggaccgtaaagggacctaaggggtacgaaacgtacgaaaacggtacgttaggtacggtactacgacctaaccgtagttccgtacgttcttaccgaaccgtttccgttacccgaccttattccgtagtacttagttctacgttacgtcgtacgg

SEQ ID NO: 161772 - DNA, 537 bp, Homo sapiens
  misc_feature: GYAE6OF02IXIAB.48.25.C03.1.454.CMB.1.raw
  modified_base (180)..(180): a, c, t, g, unknown or other
  misc_feature (180)..(180): n is a, c, g, or t
  modified_base (273)..(273): a, c, t, g, unknown or other
  misc_feature (273)..(273): n is a, c, g, or t
  modified_base (298)..(298): a, c, t, g, unknown or other
  misc_feature (298)..(298): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaaggcctggccagcctccaggctcctcatttangatacatccaccagggacactggtntcccagccaggttcactggcggtggtctgggacagagttcactctcaccatcagcagcctgcagtctgaagtattttacattttatactgtcagtcagtatcgtaagtgactacgtacgtttgccaaagggaccaagggtgaaagtacaaaacgaactgtacggctcggcaacagtctagtcttacgacttccttacccgcctaattcctaggtaattagttagtacttacctgtacgg

SEQ ID NO: 161773 - DNA, 504 bp, Homo sapiens
  misc_feature: GYAE6OF02HYGGY.48.25.C03.1.454.CMB.1.raw
  modified_base (475)..(475): a, c, t, g, unknown or other
  misc_feature (475)..(475): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtggtctgggacagagttcactctcaccatcagcagcctgcagtctgaagtattttacatttatactgtcagcagtatcgtaagtggactccgtagtttggcctaagggaccaaggtgaagtcaaagactgnggctgcacatctgtctcatcctccgcatc

SEQ ID NO: 161774 - DNA, 504 bp, Homo sapiens
  misc_feature: GYAE6OF02FV1PH.48.25.C03.1.454.CMB.1.raw
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctccaggctcctcatttatgatacatccaccagggccactggtgtcccagccaggttcactggcggtggtctggggacagagttcactctcaccatcagcagcctgcagtctgaagtatttacattttatactgtcagcagtatcgtaagtggactcgagtttgccaagggccaaggtggaagtcaacgactgtggctgacaccatctgtcttcactctcccgcatc

SEQ ID NO: 161775 - DNA, 521 bp, Homo sapiens
  misc_feature: GYAE6OF02I5VU2.48.25.C03.1.454.CMB.1.raw
  modified_base (517)..(517): a, c, t, g, unknown or other
  misc_feature (517)..(517): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccacagggccactggtcgtcccagccaggttcactgggcggtgggtctggggacaggtagttcactctcaccatcagcagcctgcagtctgaagtattttacattttatactgtcagtcagtatcgtaagtggacttcgtacgtttggaccaagggaccaagggtgaagtacaaacgtactggtgctgcaccatctgtcttcacttccttcccgctattctgtatatgtactactntagg

SEQ ID NO: 161776 - DNA, 222 bp, Homo sapiens
  misc_feature: GYAE6OF02HR0BH.48.25.C03.1.454.CMB.1.raw
  modified_base (214)..(222): a, c, t, g, unknown or other
  misc_feature (214)..(222): n is a, c, g, or t
tcagagtatacatacacgaccggtgctcgatttagtagtgtagatttgggtttgggggatcaggactcctcagttcaccttctcacaatgaggctccctgctcagctcctggggctgctaatgctctgggtcccaggaactgtggctgcaccatctgtcttcatcttcccgcatctgatatgtatactctgagcgggctggcaaggcgcatagnnnnnnnnn

SEQ ID NO: 161777 - DNA, 525 bp, Homo sapiens
  misc_feature: GYAE6OF02HTTH2.48.25.C03.1.454.CMB.1.raw
  modified_base (182)..(182): a, c, t, g, unknown or other
  misc_feature (182)..(182): n is a, c, g, or t
  modified_base (191)..(191): a, c, t, g, unknown or other
  misc_feature (191)..(191): n is a, c, g, or t
  modified_base (487)..(487): a, c, t, g, unknown or other
  misc_feature (487)..(487): n is a, c, g, or t
  modified_base (520)..(520): a, c, t, g, unknown or other
  misc_feature (520)..(520): n is a, c, g, or t
tcagagtatacatacacgaccggtgctcgatttagtagtgtagatttgggtttggggagacggaaccagtggaagccccagcgcagcttctcttcctcctgctactctggctcccagattccactggacaaatagtgatgacgcagtccccagccaccctgtctgtgtctcctaggggaaangtcaccctntcctgcagggccagtgagagtcttggacagctccttagcctggtaccaacaaggcctggccagcctccaggctcctcatttatgatacatccaccagggccacgtggtcgtcccagccaggttcacgtggcggtgggtctggggacagtagttcactctcacatcagcagcctgcagtctgaagtattttacattttactactgtcagcagtactcgtaagtgacttccgtagtttggacctaagggaccaaggtgaaagtacaaacggtactggtgctgacaccatcgtgtcttnattccttcccgctatctagatagttgtattccntacgg

SEQ ID NO: 161778 - DNA, 514 bp, Homo sapiens
  misc_feature: GYAE6OF02FGP40.48.25.C03.1.454.CMB.1.raw
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
  modified_base (369)..(369): a, c, t, g, unknown or other
  misc_feature (369)..(369): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaangtcaccctctcctgcagggccagtgagagtcttgacagctccttagcctggtaccaacaaggcctggccagcctcccaggctcctcatttangatacatccacaggccactggtcgtcccagcccaggttcacgtggcggtgggtctggggacaggagttcactcncaccatcagcagcctgcagtctgaagtattttacattttatactgtcagcagtatcgtaagtggactccgacgtttggaccaagggaccaagggtgaagtcaacgatgtggctgcaccacctgtcttcactccttccgctatctg

SEQ ID NO: 161779 - DNA, 516 bp, Homo sapiens
  misc_feature: GYAE6OF02HFK8F.48.25.C03.1.454.CMB.1.raw
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactgggcggtgggtctggggacaggagttcactctcaccatcagcagcctgcagtctgaagtatttacattttatactgtcagctagtatcgtaagtggactccgtagtttgccaagggaccaagggtgaagtacaacgatgtggcgtgacacatctgtcttcattccgttcccgctatc

SEQ ID NO: 161780 - DNA, 544 bp, Homo sapiens
  misc_feature: GYAE6OF02GM0CO.48.25.C03.1.454.CMB.1.raw
  modified_base (298)..(298): a, c, t, g, unknown or other
  misc_feature (298)..(298): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggcctcctcatttangatacatccaccagggccactggtcgtcccagccaggttcactggcggtggtctggggacaggtagttcactctcaccatcagcagcctgcagtctgaagtatttactatttattactgtcagtctagtatcgtaagtcggtactccggtacgtttggaccgtaagggacctaagggtcggaacgtacgaaacgtactgtacggctggaccacctatctagtcttctacttcctcccgactactcg

SEQ ID NO: 161781 - DNA, 544 bp, Homo sapiens
  misc_feature: GYAE6OF02H0GGN.48.25.C03.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaangtccaccctctcctgcagggccagtgagagtcttgacagctccttagcctggtaaccaacaaaggcctggccagccctcccaggctcctcatttangatacatccaccagggccactggtcgtcccagccaggttcactggcggtggtctgggacagagttcactctcaccatcagcagcctgcagtctagaagtatttacatttatactgtcagctagtatcgtagtcggtactccgacgtttcgggacctaaggggaccaagggttaggaacgtacgaaacgtactgtaggcgtgaccaccgtattcctgttccttctacttcccttcccgcctattcg

SEQ ID NO: 161782 - DNA, 527 bp, Homo sapiens
  misc_feature: GYAE6OF02HP62N.48.25.C03.1.454.CMB.1.raw
  modified_base (204)..(204): a, c, t, g, unknown or other
  misc_feature (204)..(204): n is a, c, g, or t
  modified_base (362)..(362): a, c, t, g, unknown or other
  misc_feature (362)..(362): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaanagtcaccctctcctgcagggccagtgagagtcttgacagctccttagcctggtaccaacaaaggcctggccagcctcccaggctcctcatttatgatacatccaccagggccacgtggtgtcccagccaggttcacgtggcggtggtctgggacaggngttcactctcacatcagcagcctgcagtctagagtatttacattttatactgtcagcagttatcgtagtgactcgtacgttgaccgaaggacctaagggtggaacgtacgaaacgtacgtagtggactgaccacattcgtgttccttcacttcctcccgctatcg

SEQ ID NO: 161783 - DNA, 653 bp, Homo sapiens
  misc_feature: GYAE6OF02JA3F8.48.25.C03.1.454.CMB.1.raw
  modified_base (181)..(181): a, c, t, g, unknown or other
  misc_feature (181)..(181): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaanagtccaccctctcctgcaggccagtgagagtcttgacagcctccttagcctggtaccaacaaggcctggccagccctcccgaggcctcctcatttatgatacactccacaggccacgtggtcgtcccagccaggttcacgtggcggtggtctgggacagcgttcactctcaccatcagcacgcctgcacgttcgtagaagttattttacgtatttttaacttacttgttcacgtactagttactacgggttaaacgtcgggtaaccttaccggttaccgttttcgggacccgaaacggggtaacccgtaaggggttacggaaaaggttaccaaaaccggtaacgttacgggtacgggtacttacggccctaaccgtagttccgttgttacctttccgtaacgtttccccgttaccccgtacctaacttcccgttagtactttaaccgttcgttacttaccgtgttaaccggg

SEQ ID NO: 161784 - DNA, 216 bp, Homo sapiens
  misc_feature: GYAE6OF02F5JG0.48.25.C03.1.454.CMB.1.raw
  modified_base (214)..(216): a, c, t, g, unknown or other
  misc_feature (214)..(216): n is a, c, g, or t
tcagagtatacatacacgaccggtgctcgatttagtagtgtagatttgggtttgggggatcaggactcctcagttcaccttctcacaatgaggctccctgctcagctcctggggctgctaatgctctgggtcccaggaactgtggctgcaccatctgtcttcatcttccgccatctgatatgtatactctgagcgggctggcaaggcgcatagnnn

SEQ ID NO: 161785 - DNA, 577 bp, Homo sapiens
  misc_feature: GYAE6OF02GNM8V.48.25.C03.1.454.CMB.1.raw
  modified_base (274)..(274): a, c, t, g, unknown or other
  misc_feature (274)..(274): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctcttagcctggtaccaacaaggcctggccagccctcccaggcctcctcatttangatacatccaccagggccacgtggtcgtcccagccaggttcacgtggcggtggtctgggacagacgttcactctcaccatcagcagcctgcagtctagaagtatttactattttatactgtcagctagtatacgtaagtcggtacttccgtacgtttcggaccgtaaagggaccgtaagggtaggaaacggtaccaaacggaacttggtcggactgccaaccacttcgtagttcttaccactttcccttaccccgtacctactttccgtagtaacttattacgttaacttaccgttctacggg

SEQ ID NO: 161786 - DNA, 514 bp, Homo sapiens
  misc_feature: GYAE6OF02F2H1Y.48.25.C03.1.454.CMB.1.raw
  modified_base (273)..(273): a, c, t, g, unknown or other
  misc_feature (273)..(273): n is a, c, g, or t
  modified_base (479)..(479): a, c, t, g, unknown or other
  misc_feature (479)..(479): n is a, c, g, or t
  modified_base (510)..(510): a, c, t, g, unknown or other
  misc_feature (510)..(510): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctccaggctcctcatttangatacatccaccagggccactggtgtcccagccaggttcactggcggtgggtctgggacaggagttcactctcaccatcagcagcctgcagtctgaagtattttacattttatactgtcagcagtatcgtaagtggacttcgacgtttggccgtaagggaccaagggtgaagtacgaaacgacgtgtggctgcacatctgtcttcntccttcccgcctatctgattatgtactactntcgg

SEQ ID NO: 161787 - DNA, 842 bp, Homo sapiens
  misc_feature: GYAE6OF02F32KX.48.25.C03.1.454.CMB.1.raw
tcagagtatacatacacgaccggtgctcgatttagtagtgtagatttgggtttgggggtaggacggaaccataaggaacgccccagtccgccagacttactcccttccgtcctgctactctggctcccacgattccgactggaccaagtagtcgattgacgcagtccccagccaccctgtctgtcgtctcccaggggaacagtcgaccctctacctgcgaggccaggtgagagtccttggaccaggtctccgttagcccttgggtacccaaacgaaacggtccctgggacccagccccttccaggcctaccctatacttttacagtagtacacgtcccgaccacgggtccacgtacgggtcgttacccgaggtcccgaggtttccgaacgttgggtccggttcgggttacttcggggacacggtacgtttaccaaccgttccgtacaaccctagtaccgtacgcgacgtcctacgcctaacgttacgtacggaaacggttaacttttaaacgtaacgtttttaactaacgttagttacctaggtccgtaagttaccttacggtaaaggtcggtaacccttaccggtacgttttacggacccgtaaacgggggtacccgaaaggggttacgggtaaaccgttaccgtaaaaccggttaaccgtttcggggtacggtaccgttaagggtaacccgttaaacccgttaacttacccgttacgtttacccgtttaccgtaaccgtttaccccgtttttaacccccggaccctttaaccgtttaccggttacgtttaacgtttaaccggttaccgttaacgtttacccggttacccggttaaccggg

SEQ ID NO: 161788 - DNA, 564 bp, Homo sapiens
  misc_feature: GYAE6OF02HOBXX.48.25.C03.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagngtcaccctctcctgcagggccagtgagagtcttgacagctccttagcctggtaccaacaaggcctggccagcctcccaggctcctcatttangatacatcccaccagggcccatggtctccccagccaggttcacgtgggcggtggtctggggacaggagttcactctcaccatcagcagcctgcagtctagaagtattttacattttatactgtcagtcagttatcgtaagtcggacttccggtacgtttcggaccgaaggggtaccaaggggtcggaaacgttaccgaaacgtacgtggtcggacgtggacctaacctattccgttgttccttcgacttcccgttcccgacctatccg

SEQ ID NO: 161789 - DNA, 830 bp, Homo sapiens
  misc_feature: GYAE6OF02I69KV.48.25.C03.1.454.CMB.1.raw
tcagagtatacatacacgaccggtgctcgatttagtagtgtagatttgggtttgggggtagggaacgtgctcagttaggacccagacggaaccatggaagcccagcgcagcttctcttcctcctgctactctggctcccagattccactggacaaatagtgatgacgcacgtcccagcccaccctgtctgtgtctccgaggggaaagacgtccaccctctcctgcacgggccagtgagagtcttgacagctccttagcctggtaccaacgaaggcctggccacgccctacccgacggcctacccgtctaacttttacgtagacttacctactcccaaccgtacggggtcccaaccgttcgggtcgttacccccgaagtcccgtaagggtttccaacggtcgggaccgggtttcgggtaccgtacggggacctaagggtacggttttccgaccgtttccgtaccgaaccgtacgttacccacggtacctacggtcccgttacggtaccgtaacggttaccgtttaacggaaaacgtttaacgtttttaaacgttaacgtttttttaaacttaaccgttttaggttacctaagggttacctaaggtttaaccgttaacggttaaacggtttacgggttaaccgttaccgggttaaccgggtttttacggaacccggtaaacggggtaaccgttaaagggtacgggtaaaacgttaaccggtaaaccggttacgtttacgggtacggtaccggtcggtaaccctaaccggtaacgttccgttacggtttcccgttactaaccgtttcccgttaccccggtactcgtttaccgg

SEQ ID NO: 161790 - DNA, 544 bp, Homo sapiens
  misc_feature: GYAE6OF02GZ6PE.48.25.C03.1.454.CMB.1.raw
  modified_base (298)..(298): a, c, t, g, unknown or other
  misc_feature (298)..(298): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtccaccctctcctgcagggccagtgagagtcttgacagctccttagcctggtaccaacaaaggcctggccagcctcccaggctcctcatttangatacatccaccagggccacgtggtcgtcccagccaggttcacgtggcggtggtctggggacagagttcactctcaccatcagcagcctgcagtctgaagtattttacattttattactgtactagctagtatacgtaagtggactccgtacggtttggacctaaggggaccaagggtggaaagtacgaaacgtacgtgtaggctggccaacgtatcttgtctttcacttccgttcccgcctattc

SEQ ID NO: 161791 - DNA, 507 bp, Homo sapiens
  misc_feature: GYAE6OF02GMMOP.48.25.C03.1.454.CMB.1.raw
  modified_base (273)..(273): a, c, t, g, unknown or other
  misc_feature (273)..(273): n is a, c, g, or t
  modified_base (473)..(473): a, c, t, g, unknown or other
  misc_feature (473)..(473): n is a, c, g, or t
  modified_base (502)..(502): a, c, t, g, unknown or other
  misc_feature (502)..(502): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagcctcccaggctcctcatttangatacatccaccagggccactggtgtcccagccaggttcactggcggtgggtctgggacagagttcactctcaccatcagcagcctgcagtctgaagtatttacattttatactgtcagcagtatcgtaagtgactccgtacgtttggccgaagggaccaaggtggaagtacaaacgaactgtgctgcacatctgtctcntcctcccgctatctgtatatgtactactntacgg

SEQ ID NO: 161792 - DNA, 506 bp, Homo sapiens
  misc_feature: GYAE6OF02HUEOG.48.25.C03.1.454.CMB.1.raw
  modified_base (476)..(476): a, c, t, g, unknown or other
  misc_feature (476)..(476): n is a, c, g, or t
  modified_base (494)..(494): a, c, t, g, unknown or other
  misc_feature (494)..(494): n is a, c, g, or t
  modified_base (504)..(504): a, c, t, g, unknown or other
  misc_feature (504)..(504): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggcctcctcatttatgatacatccaccagggccactggtcgtcccagccaggttcacgtgggcggtggtctgggacagagttcactctcacatcagcagcctgcagtctgaagtattttacattttattactgtcagctagtatcgtaagtgacttcgtacgttggaccaagggaccaaggtgaagtacaaacgactgtgctgcacatctgtctcnttcctccgctatctgatntgtactactntg

SEQ ID NO: 161793 - DNA, 534 bp, Homo sapiens
  misc_feature: GYAE6OF02I16UO.48.25.C03.1.454.CMB.1.raw
  modified_base (295)..(295): a, c, t, g, unknown or other
  misc_feature (295)..(295): n is a, c, g, or t
  modified_base (373)..(373): a, c, t, g, unknown or other
  misc_feature (373)..(373): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagcctccaggctcctcatttangatacatccaccagggccactggtcgtcccagccaggttcactgggcggtggtctggggacagagttcactctcaccntcagcagcctgcagtctgaagtattttacattttactactgtctagctagtattacgtaagtcggtactccggtacgtttcggaccgtaagggaccctaagggtcggaagtacgaaacgactgtggcgtgcacatcgtgtcttctactccttcccgctatc

SEQ ID NO: 161794 - DNA, 571 bp, Homo sapiens
  misc_feature: GYAE6OF02HBMKX.48.25.C03.1.454.CMB.1.raw
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagcctcccaggctcctcatttatgatacatcccaccagggccactggtcgtcccagccaggttcacgtggcggtggtctggggacaggtagttcactctcaccatcagcagcctgcagtctgaagtatttactattttatactgtctagtctagtagtacgtagtggtactccggtacgtttcggaccgtaagggacctaaggggtcggaaagtaccgaaacggtacgttggtacggtcgtagaccgaccgtagttccgtgttccttacgtacttcccgttccccgtactacgttccg

SEQ ID NO: 161795 - DNA, 568 bp, Homo sapiens
  misc_feature: GYAE6OF02HIABS.48.25.C03.1.454.CMB.1.raw
  modified_base (203)..(203): a, c, t, g, unknown or other
  misc_feature (203)..(203): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaangtcaccctctcctgcagggccagtgagagtcttgacagctccttagcctggtaccaacaaggcctggccagccctcccaggctcctcatttactgatacatcccaccgagggccacttgggtctccccagcccaggttcacgtgggcggtgggtctggggacaggagtttcactctacaccatcagcagcctgcagtctagaagtattttacattttatactgtcagtctagttatcgtaagtggacttccggtacgtttcggaccaaggggtaccaagggttcggaaacgttacgaaacgtacgtggtcggactcggaccacgtacttccgtgttccttccgactttcccgttcccgactatcg

SEQ ID NO: 161796 - DNA, 561 bp, Homo sapiens
  misc_feature: GYAE6OF02G6T9J.48.25.C03.1.454.CMB.1.raw
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccaagcctcccaggcctcctcatttatgatacatccaccagggccactggtgtcccagccaggttcacgtgggcggtgggtctgggacagagttcactctcacatcagcagtcctgcagtctagaagtattttacattttatactgtcagcagtatcgtaagtggaccttcgtagtttcggaccaagggtaccaagggtagaagtaccaaacggtactggtacggtctaggaccaacctattcctgttccttacgtacttccttccccgacctacgttccttacggacttacgttgtaacttacctgtacgg

SEQ ID NO: 161797 - DNA, 503 bp, Homo sapiens
  misc_feature: GYAE6OF02FI29O.48.25.C03.1.454.CMB.1.raw
  modified_base (501)..(501): a, c, t, g, unknown or other
  misc_feature (501)..(501): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagcctcccaggctcctcatttatgatacatccaccagggccactggtgtcccagccaggttcactggcggtgggtctgggacagagttcactctcaccatcagcagcctgcagtctgaagattttacattttatactgtcagcagtatcgtaagtggactccgacgtttggccaagggaccaaggtggaagtcaaacgaactgtggctgcacatctgtcttcatccttcccgccatctgatatgtatactntg

SEQ ID NO: 161798 - DNA, 517 bp, Homo sapiens
  misc_feature: GYAE6OF02IIEB2.48.25.C03.1.454.CMB.1.raw
  modified_base (204)..(204): a, c, t, g, unknown or other
  misc_feature (204)..(204): n is a, c, g, or t
  modified_base (323)..(323): a, c, t, g, unknown or other
  misc_feature (323)..(323): n is a, c, g, or t
  modified_base (494)..(494): a, c, t, g, unknown or other
  misc_feature (494)..(494): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagngtcaccctctcctgcagggccagtgagagtcttgacagctccttagcctggtaccaacaaaggcctggccagcctcccaggctcctcatttatgatacatccaccagggccacgtggtntcccagccaggttcactggcggtggtctggggacagagttcactctcacatcagcagcctgcagtctgaagtattttacattttatactgtcagtcagtatcgtaagtggactccgtacgttggaccgaagggaccaagggtgaacgtacgaaacgtactgtggctgcacntctgtcttcatcctcccgcatcg

SEQ ID NO: 161799 - DNA, 216 bp, Homo sapiens; identical to SEQ ID NO: 161534
  misc_feature: GYAE6OF02F5F6L.48.25.C03.1.454.CMB.1.raw
  modified_base (215)..(216): a, c, t, g, unknown or other
  misc_feature (215)..(216): n is a, c, g, or t

SEQ ID NO: 161800 - DNA, 583 bp, Homo sapiens
  misc_feature: GYAE6OF02JKO1A.48.25.C03.1.454.CMB.1.raw
  modified_base (205)..(205): a, c, t, g, unknown or other
  misc_feature (205)..(205): n is a, c, g, or t
  modified_base (240)..(240): a, c, t, g, unknown or other
  misc_feature (240)..(240): n is a, c, g, or t
  modified_base (418)..(418): a, c, t, g, unknown or other
  misc_feature (418)..(418): n is a, c, g, or t
tcagagtatacatacacgaccggtgctcgatttagtagtgtagatttgggtttgggggagggaactgctcagttaggacccagagggaaccatggaagccccagcccagcttctcttcctcctgctactctggctcccagcagccaccggagaaattgtgctgacacagtctccagccaccctgtccttgtctccagggcaaagngcctccctctcctgcagggccagtcagcatgttanccacctacttagccctggtaacccaacaaaacgccctggaccacggcctcccagacctcctcactcctatgatgcgtctaccgacgggccacgtggccgtcccggccaggttcagtcgccagtcggggtctggggaccagtaccttcgacttcgtacaccatcacgacacgctaggcncccgaaagtcttttggcgttttatacgtgtcagcagcgtgaccctaacgtggccttcgccgtacggtcggggaccgaggggaccctaagggtcgaacgtactacgaacgacttagggtcggctgacccaacgtatcgtggtcctttcgacttcccgttcgtaccc

SEQ ID NO: 161801 - DNA, 597 bp, Homo sapiens
  misc_feature: GYAE6OF02F5VTF.48.25.C03.1.454.CMB.1.raw
  modified_base (274)..(274): a, c, t, g, unknown or other
  misc_feature (274)..(274): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttangatacatccaccagggccacgtggtcgtcccagcctaggttcacgtggcggtggtctgggacaggagttcactctcaccatcagcagcctgcagtctagaagtattttactattttattactgtcagtctagttatacgtaagtgtacgttaccgtacgtttcggaccgtaacgggaccgaaagggtacggtaaacggtaccgtaaaacggtaaacgttggtacggtctaggaccgtaaccgtactaccgttgttccttacgtacgttccctttaccccgcctactccgttagtacttattacgttaacttacgttcgtacgg

SEQ ID NO: 161802 - DNA, 585 bp, Homo sapiens
  misc_feature: GYAE6OF02JARQB.48.25.C03.1.454.CMB.1.raw
  modified_base (274)..(274): a, c, t, g, unknown or other
  misc_feature (274)..(274): n is a, c, g, or t
  modified_base (519)..(519): a, c, t, g, unknown or other
  misc_feature (519)..(519): n is a, c, g, or t
  modified_base (579)..(579): a, c, t, g, unknown or other
  misc_feature (579)..(579): n is a, c, g, or t
tcagagtatacatacacgaccggtgctcgatttagtagtgtagatttgggtttggggagacggaaccatggaagcccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaaccaacaaaggcctggccagcctccaggctcctcattttangatacatcccacgagggcccactgggtcgtccccaggcccaggttccacgttcgggcgggttgggtctggggacaggagttccacgtctccaacctatccgaagcacgtccctgcagttctaggaacgtatttttaactattttaattactgtcagtctagtattcgtaagtgtaacctcgtagtttcggaccgtaaggaccgtaaggtggaagtacgaaaacgacgtaggtagctgacctaacngtactgtcttacgtcttaccgtccgacctacgttcgtagtacttattggtaacttacgtnttacgg

SEQ ID NO: 161803 - DNA, 524 bp, Homo sapiens
  misc_feature: GYAE6OF02H963M.48.25.C03.1.454.CMB.1.raw
  modified_base (275)..(275): a, c, t, g, unknown or other
  misc_feature (275)..(275): n is a, c, g, or t
  modified_base (374)..(374): a, c, t, g, unknown or other
  misc_feature (374)..(374): n is a, c, g, or t
  modified_base (486)..(486): a, c, t, g, unknown or other
  misc_feature (486)..(486): n is a, c, g, or t
  modified_base (519)..(519): a, c, t, g, unknown or other
  misc_feature (519)..(519): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggcctcctcatttangatacatccaccagggccatggtcgtcccagccaggttcactgggcggtgggtctgggacagagttcactctcacatcagcagcctgcagtcagaagtnttttactattttattactgtcagctagtatacgtaagtggaccttccgtagtttcggacctaagggaccaagggtgaacgtacaacgactgaggctgcaccatctgtcttcntccttccgctagtctgacttatgttactacgtntacgg

SEQ ID NO: 161804 - DNA, 600 bp, Homo sapiens
  misc_feature: GYAE6OF02F0N37.48.25.C03.1.454.CMB.1.raw
  modified_base (299)..(299): a, c, t, g, unknown or other
  misc_feature (299)..(299): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaagagtcaccctctcctgcagggccagtgagagtcttgacagctccttagcctggtaccaacaaaggcctggccagcctcccaggcctcctcatttangatacatccaccgagggcccacgtgggtcgtcccagccgaggttcacgtgggcggtggtctggggacaggtattcactctacaccatcagcagcctagctagtctagaagtatttaactattttatactgtacagtcagtatcgtaagtcggtactcgtacgtttggaccgtaagggaccgaagggtacggaaacgttaccgaaacggtaacgttggtacggccgttacggacctaacccgtaacgttccgttacggttacctttacaaccgtttcccgtttcccccggaccttactaccg

SEQ ID NO: 161805 - DNA, 574 bp, Homo sapiens
  misc_feature: GYAE6OF02JFFEA.48.25.C03.1.454.CMB.1.raw
  modified_base (273)..(273): a, c, t, g, unknown or other
  misc_feature (273)..(273): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctccaggctcctcatttangatacattccaccagggccactggtctcccagccaggttcactggcggtgggtctgggacagtagttcactcgtcacctatcagcagcctgctagtctagaagtactttttaacatttttatacgtgtcaagtctagtactggtaagtcggacttccggtacgtttcggaccgtaaagggacctaagggtcggaaagttaccgaaacggtacgtggtacggtctacggacaaccagttcctagttcctctaacgttccttacccgctattccgagtacttacgtagtacttactcgtacgg

SEQ ID NO: 161806 - DNA, 508 bp, Homo sapiens
  misc_feature: GYAE6OF02IKCXC.48.25.C03.1.454.CMB.1.raw
  modified_base (497)..(497): a, c, t, g, unknown or other
  misc_feature (497)..(497): n is a, c, g, or t
  modified_base (505)..(505): a, c, t, g, unknown or other
  misc_feature (505)..(505): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggcagcctccaggcctcctcatttatgatacatccaccagggccactggtcgtcccagccaggttcactggcggtggtctgggacagagttcatctcaccatcagcagctgcagtctgaagtattttacattttatactgtcagctagtactgtaagtggaccttcgtagtttggaccaagggaccaagggtggaagtacaaacgactgtgactgacacgatctgtcttcacttcctccgctatctgatntgtatctntgg

SEQ ID NO: 161807 - DNA, 557 bp, Homo sapiens
  misc_feature: GYAE6OF02GXX4E.48.25.C03.1.454.CMB.1.raw
  modified_base (203)..(203): a, c, t, g, unknown or other
  misc_feature (203)..(203): n is a, c, g, or t
  modified_base (296)..(296): a, c, t, g, unknown or other
  misc_feature (296)..(296): n is a, c, g, or t
  modified_base (382)..(382): a, c, t, g, unknown or other
  misc_feature (382)..(382): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaangtcaccctctcctgcagggccagtgagagtctgacagctccttagcctggtaccaacaaggcctggccagccctcccaggcctcctcatttangatacatcccaccgagggccactggtcgtcccagcccaggttcactgggcggttggtctggggacaggtacgttcactctccaccntcagcagcctgcagtctagaagtatttaactattttattactgtacagtctagtatcgtaagtcggactccgtacgtttcggaccgaagggtaccgaagggtaggaaacgtacgaaacgtacgtgtcggcgtcgactaccagttctgtacttctacgttcccttccgtcctatcg

SEQ ID NO: 161808 - DNA, 520 bp, Homo sapiens
  misc_feature: GYAE6OF02I645I.48.25.C03.1.454.CMB.1.raw
  modified_base (180)..(180): a, c, t, g, unknown or other
  misc_feature (180)..(180): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (484)..(484): a, c, t, g, unknown or other
  misc_feature (484)..(484): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaggcctggccagcctcccaggctcctnatttangatacatccaccagggccactggtcgtccagccaggttcacgtggcggtgggtctgggacaggtagttcactctcacctatcagcagcctgcagtctagaagtattttacgattttattactgtcagtcagtatcggtaagtcggacttcgagtttcggaccgaagggaccaagggtgaagtcaaagactgtcgctgcacatctgtcttcncttcctccgctatcttagcttactgtacttctgtgg

SEQ ID NO: 161809 - DNA, 624 bp, Homo sapiens
  misc_feature: GYAE6OF02FL7N0.48.25.C03.1.454.CMB.1.raw
  modified_base (273)..(273): a, c, t, g, unknown or other
  misc_feature (273)..(273): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagcctccgaggctcctcatttangactacatccacgagggccacgtggtcgtcccagcctaggttccacgtgggcggtgggtctgggacagagttcactctacaccatcagcagcctgcagtctagagtattttactattttattactgtactagactagtattcgtaaggtcggtacttccgtacgttttcgggacccgtaaaggggtaccgtaagggttaggaaacggtaacgtaaaccggtaacgttagggtacggtacgttcgactaaccgtacgttacgttcgtttaccgttaccgtacttacccgtttaccccggaccttaaccgttcgtacgtaacttacgttacggtttacttaccgttgtacggg

SEQ ID NO: 161810 - DNA, 550 bp, Homo sapiens
  misc_feature: GYAE6OF02GZ5BN.48.25.C03.1.454.CMB.1.raw
  modified_base (279)..(279): a, c, t, g, unknown or other
  misc_feature (279)..(279): n is a, c, g, or t
  modified_base (539)..(539): a, c, t, g, unknown or other
  misc_feature (539)..(539): n is a, c, g, or t
tcagagtatacatacacgaccggtgctcgatttagtagtgtagatttgggtttggggagacggaaccatggaagccccagcgcagcttctcttccctcctgctactctggctcccagattccactggacaaatagtgatgacgcagtccccagccaccctgtctgtgtcctccaggggaaagagtcaccctctcctgcagggccagtgagagtcttgacagctccttagcctggtaccaacaaaggcctggccagccctcccaggcctccctcatttangactacatcccaccagggcccacgtggtcgtccccagcccaggttccacgtgggcggtgggtctgggacaggagttcacgttctcaccgatcagtcacgcctgcagtctagaatattttacattttactactgtacagtactagttacttacgtaagtggaccttccgtagtttcgaccgtaagggaccaagggtcggaagtacaaacgactggtggactgaccacatctgtctcactccttcccgctctctgtatactntacttctctgg

SEQ ID NO: 161811 - DNA, 684 bp, Homo sapiens
  misc_feature: GYAE6OF02IHY30.48.25.C03.1.454.CMB.1.raw
  modified_base (179)..(179): a, c, t, g, unknown or other
  misc_feature (179)..(179): n is a, c, g, or t
  modified_base (652)..(652): a, c, t, g, unknown or other
  misc_feature (652)..(652): n is a, c, g, or t
  modified_base (679)..(679): a, c, t, g, unknown or other
  misc_feature (679)..(679): n is a, c, g, or t
tcagagtatacatacacgaccggtgctcgatttagtagtgtagatttgggtttggggagacggaaccatggaagcccagcgcagcttctcttcctcctgctactctggctcccagattccactggacaaatagtgatgacgcagtccccagccaccctgtctgtgtctccgagggaaangtcaccctctcctgcagggccagtgagacgtcttgacagctccttagcctggtaaccaacaacggcctggcacgcctcccgaggcctccgtactatttactagactacatcccacgagggccacgttggtctcccgagtccgaggtttccacgtgggccggttgggtcctacgggacctaggtacgttccaacttccgaccgtaaccataccgaagccgtaacggtccttacgactaggttacctagtaaagtttacttttttacgaattttttaccgacttcgggtacctaaaggccgttaaaggttacttaaccgggtaaagttccgggaaccctttaccggttaaacgggttttcggaaccccgaaaaggggtaccctaaaggggttgtaaaccgttaccgaaaaaccgtcggttgtacgggtctaacgtccaaccgttattcctgttacctccgactttccgtacccgnttagtcctagattgtacgtactaccgntacgg

SEQ ID NO: 161812 - DNA, 643 bp, Homo sapiens
  misc_feature: GYAE6OF02FGJSD.48.25.C03.1.454.CMB.1.raw
  modified_base (180)..(180): a, c, t, g, unknown or other
  misc_feature (180)..(180): n is a, c, g, or t
  modified_base (217)..(217): a, c, t, g, unknown or other
  misc_feature (217)..(217): n is a, c, g, or t
  modified_base (270)..(270): a, c, t, g, unknown or other
  misc_feature (270)..(270): n is a, c, g, or t
  modified_base (344)..(344): a, c, t, g, unknown or other
  misc_feature (344)..(344): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaangtcaccctctcctgcagggccagtgagagtcttgacngctccttagcctggtaccacaaggcctggccagcctccaggctcctcatttangatacatccaccagggccactggtcgtccagccaggttcactggcggtgggtctgggacagtagttcactctcnccatcagcagcctgcagtcagaactatttcgactaacgttatttactgtactaactactttaaactaacttaccctactactaacgtaccgttaccggacctaacgggtaacccgacgggttttttacggaaacccgaaacggtaccggtaaaccgtacggttacgggtaccgtacgaccctaaccgtacttaccgtttacggtacctttaccgttaacttaccccgtttaccccgtacccgtaaccttaccgttacggttaacttaacgttacggttacttaccgttaccgttacggg

SEQ ID NO: 161813 - DNA, 615 bp, Homo sapiens
  misc_feature: GYAE6OF02IWESL.48.25.C03.1.454.CMB.1.raw
  modified_base (186)..(186): a, c, t, g, unknown or other
  misc_feature (186)..(186): n is a, c, g, or t
  modified_base (289)..(289): a, c, t, g, unknown or other
  misc_feature (289)..(289): n is a, c, g, or t
tcagagtatacatacacgaccggtgctcgatttagtagtgtagatttgggtttggggagacggaaccatggaagccccagcgcagcttctcttcctcctgtctactctggctcccagacttccactggacaaatagtgatgacgctagtcccagccaacccttgtctgtgtctccacggggaaagngtccaccctcgtcctggaccagggccaggtcgacgagtcttgacacgctccttagcctcggtacccaacgaacgcctgccagcctccaggctccgtcatttancgactacgactccaccagggccacgtggtcgtcccagccaggttcacgtgggcggtgggtctgggacaggcgttcactcgtcaccatcagcagcctgcagtctagaagtattttactacttttaatttacttgtactagcgtagtactacgttaagtcggtaccgttaccggtacggtttacgggtaccgtaacgggaaccgtaagggtacggaacggtacgtaaacgtaacgtaggtacggtcgtcgacgacccccgatcgtcgttcgttctacttccttccgtacctacttctacgtacttagttagtacgttacgtagtacgg

SEQ ID NO: 161814 - DNA, 510 bp, Homo sapiens
  misc_feature: GYAE6OF02GDBF9.48.25.C03.1.454.CMB.1.raw
  modified_base (506)..(506): a, c, t, g, unknown or other
  misc_feature (506)..(506): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtcgtcccagccaggttcactggcggtgggtctgggacaggagttcactctcaccatcagcagcctgcagtctgaagtattttacatttttatactgtcagcagtatcgtaagtggactcgtacgtttggaccaagggaccaagggtgaagtcaaacgactggtgctgcacatctgtcttcatccttcccgctatctgatatgtatactntagg

SEQ ID NO: 161815 - DNA, 591 bp, Homo sapiens
  misc_feature: GYAE6OF02G230Y.48.25.C03.1.454.CMB.1.raw
  modified_base (203)..(203): a, c, t, g, unknown or other
  misc_feature (203)..(203): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaangtcaccctctcctgcagggccagtgagagtcttgacagctccttagcctggtaccaacaaaggcctggccagcctcccaggctcctcatttatgatacatccaccagggccactggtcgtcccagccaggttcacgtgggcggtggtctgggacagagttcactctcaccatcagcagcctgcagtctagaagtattttactattttatactgtcagtctagttatacgtaaggtcgtacgttccggtacgtttcgggaccgtaagggacctaaagggtcggaaacgttacgaaaacgtacttgggttacggaccgttaggaccctaaccgaacgttccgttacgttcctttacgtacctttcccggttaccccgtacccgtattccg

SEQ ID NO: 161816 - DNA, 554 bp, Homo sapiens
  misc_feature: GYAE6OF02GW716.48.25.C03.1.454.CMB.1.raw
  modified_base (180)..(180): a, c, t, g, unknown or other
  misc_feature (180)..(180): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaggcctggccagcctcccaggctcctcatttatgatacatcccaccagggcccactggtgtcccagccaggttcactggcggtgggtctgggacagagttcactctcaccatcagcagcctgcagtctgaagtattttacattttatactgtcagcagtatcgtaagtggacttccggtacgtttggaccgtaagggacctaagggtggaaacgtaccgaaacgtacgttggtcggctgccaaccgtatcgtgttccttacgtacttccttccccgcctacttccgtgtattacgttgtacttacctcgtacgg

SEQ ID NO: 161817 - DNA, 270 bp, Homo sapiens
  misc_feature: GYAE6OF02H1BYV.48.25.C03.1.454.CMB.1.raw
  modified_base (74)..(74): a, c, t, g, unknown or other
  misc_feature (74)..(74): n is a, c, g, or t
  modified_base (220)..(223): a, c, t, g, unknown or other
  misc_feature (220)..(223): n is a, c, g, or t
  modified_base (225)..(270): a, c, t, g, unknown or other
  misc_feature (225)..(270): n is a, c, g, or t
tcagagtatacatacacgaccggtgctcgatttagtagtgtagatttgggtttggggggagtcaggactccctnagttcaccttctcacaatgaggctccctgcctcagctcctggggctgctaatgctctgggtcccaggaactgtggctgcacatctgtcttcatcttcccgcatctgatatgtatactctgagcgggctggacaagggcacaatagnnnngnnnnnnnnnnnnnnnnnnnnnnnnnnnnnnnnnnnnnnnnnnnnnn

SEQ ID NO: 161818 - DNA, 536 bp, Homo sapiens
  misc_feature: GYAE6OF02IQVHJ.48.25.C03.1.454.CMB.1.raw
  modified_base (180)..(180): a, c, t, g, unknown or other
  misc_feature (180)..(180): n is a, c, g, or t
  modified_base (272)..(272): a, c, t, g, unknown or other
  misc_feature (272)..(272): n is a, c, g, or t
  modified_base (532)..(532): a, c, t, g, unknown or other
  misc_feature (532)..(532): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaangtcaccctctcctgcagggccagtgagagtcttgacagctccttagcctggtaccaacaaaggcctggccagcctccaggctcctcatttangatacatccaccagggccactgggtcgtccccaggccaggttcacgtgggcggtggtctgggacagagttcactctcaccatcagcagcctgcagtctgaagttattttacattttatactgtcagctagtatcggtaagtggtaactccgtacgtttcggaccaaacggggacctaagggtgaaagtacgaaaacgacttggtaggctgacaaccatctgtcttcgacttcctccgctatctagtattagtgtatactntagg

SEQ ID NO: 161819 - DNA, 605 bp, Homo sapiens
  misc_feature: GYAE6OF02IR8Z8.48.25.C03.1.454.CMB.1.raw
  modified_base (205)..(205): a, c, t, g, unknown or other
  misc_feature (205)..(205): n is a, c, g, or t
  modified_base (298)..(298): a, c, t, g, unknown or other
  misc_feature (298)..(298): n is a, c, g, or t
  modified_base (438)..(438): a, c, t, g, unknown or other
  misc_feature (438)..(438): n is a, c, g, or t
tcagagtatacatacacgaccggtgctcgatttagtagtgtagatttgggtttgggggagggaactgctcagttaggacccagacggaaccatggaagccccagcgcagcttctcttcctcctgctactctggctcccagattccactggacaaatagtgatgacgcagtccccagccaccctgtctgtgtctccaggggaaagngtccaccctctcctgcagggccagtgagagtctgacagctccttagcctggtaccaacaaggcctggccagccctcccaggctcctcatttangatacatccaccagggccacgtgggtctccccgagccctagggttccacgttcgggcggttcgggtctaggggacaggtacgtttccacgtctacgacctatcgagcagccctgccagtcagaagtattttacattttanactgtactagctagtatacgttaagcggtactaccggtacgtttcggaccaagggtacctaagggttacggaaagtaccgaaaacgtacgtaggtacggaccgtacgacaaccgtagttccgttacgttccttacgaacctttccgttaccccgtaccgtattaccg

SEQ ID NO: 161820 - DNA, 538 bp, Homo sapiens
  misc_feature: GYAE6OF02IV7KJ.48.25.C03.1.454.CMB.1.raw
  modified_base (203)..(203): a, c, t, g, unknown or other
  misc_feature (203)..(203): n is a, c, g, or t
  modified_base (298)..(298): a, c, t, g, unknown or other
  misc_feature (298)..(298): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaaggcctggccagcctcccaggcctcctcatttangatacatccacagggccactggtcgtcccagccaggttcacgtggcggtggtctggggacagtacgttcactctcaccatcagcagcctgcagtctagaagtatttacattttatactgtcagtcagtatcgtaagtcggactccgtacgttgaccgtaagggacctaagggtagaaacgtacgaaacgtactggtagacgtgaccactatctgttaccttcacttcctacccgctatcg

SEQ ID NO: 161821 - DNA, 529 bp, Homo sapiens
  misc_feature: GYAE6OF02G3J09.48.25.C03.1.454.CMB.1.raw
  modified_base (298)..(298): a, c, t, g, unknown or other
  misc_feature (298)..(298): n is a, c, g, or t
  modified_base (353)..(353): a, c, t, g, unknown or other
  misc_feature (353)..(353): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccagggggaaagagtccaccctctcctgcagggccagtgagagtcttgacagctcctagcctggtaccaacaaaggcctggccagcctcccaggctcctcatttangatacatccaccgagggccatggtctcccagccaggttcacgtgggcggtggtcnggggacagagttcactctcaccatcagcagcctgctagtctagatattttacattttatactgtactagtctagtatcgtaagtggactcgtacgttggaccgtaagggaccaaggtaggaactacgaaacgtacgtgtggctgcctacatctgtctctacttccgtcccgctatc

SEQ ID NO: 161822 - DNA, 588 bp, Homo sapiens
  misc_feature: GYAE6OF02F9BJZ.48.25.C03.1.454.CMB.1.raw
  modified_base (207)..(207): a, c, t, g, unknown or other
  misc_feature (207)..(207): n is a, c, g, or t
  modified_base (299)..(299): a, c, t, g, unknown or other
  misc_feature (299)..(299): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtcccccagcccaccctgtctgtgtctccgaggggaaagngtcaccctctcctgcagggccagtgagagtctgacagctccttagcctggtaccaacaaggcctggccagccctccaggcctcctcatttangatacatccaccagggccagtggtctcccagcccaggttcacgtgggcggtggtctgggacaggagttcactcacacatcagcagcctgcagtctgtaagtatttactatttatactgtacagactagtatacgtaagtcggtactccggtacggtttcggaccgtaaacgggtaccgtaaagggtacggaaacgtaaccgaaacggtaacgtcggtaggaccgtacggtacctaccgtaagttccgttagttaccgttactaccttcccttacccgtacctacttacg

SEQ ID NO: 161823 - DNA, 583 bp, Homo sapiens
  misc_feature: GYAE6OF02IXSS2.48.25.C03.1.454.CMB.1.raw
  modified_base (274)..(274): a, c, t, g, unknown or other
  misc_feature (274)..(274): n is a, c, g, or t
  modified_base (363)..(363): a, c, t, g, unknown or other
  misc_feature (363)..(363): n is a, c, g, or t
  modified_base (414)..(414): a, c, t, g, unknown or other
  misc_feature (414)..(414): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagccctccaggcctcctcatttangataccatcccaccgagggcccacgtggtctccccaggccaggttccacgtgggcggttgggtctgggacaggtagttcactctcaccntacagcacgtcctgctagtctagaattattttactattttatactgtacanctagtatcgtaagtcggtacttcgtacgtttggaccgaagggacctaagggtcggtaaacgtacgaaacgtacgtggtacgactgaccacgtattccgtacgttcttactacttcccgttacccgtcctactccgtagaacttacgttacgttacttacttcggtacgg

SEQ ID NO: 161824 - DNA, 621 bp, Homo sapiens
  misc_feature: GYAE6OF02GLZYT.48.25.C03.1.454.CMB.1.raw
  modified_base (337)..(337): a, c, t, g, unknown or other
  misc_feature (337)..(337): n is a, c, g, or t
tcagagtatacatacacgaccggtgctcgatttagtagtgtagatttgggtttggggggaggaactgctccacgttaggacccgagacggaacctatggaacgccccagccgcagcttctcttccctcctcgtctactcgtggctcccagattccactggacaaatagtgatgacgcagtacccccagccaccctcgtctgtgtctccaggggaaacacgttcaccctcgtcctgccacgggccagttgaggagtcgttggacgacgctccttacgcctacggtacccaaacgaaacggccctaggccaggccctcccgaggcctcctctatttagngatacatccaccgacgggccacgtggtcctcccagccaggttacacgtggcggtggtctagggacacgacgttacactctacaacctatcgagccacgcctgacagtctaggtaacttatttacatttactactagtcagtctagtctacgtaagtcgacgtcggtacgtttcgaccgtaagggtacctaagggttcgtaacgtacgaaacgtacgttggtacggaccgtgggacctaccgtacttcgtacgttccttcgtacttccctacccgacctactccg

SEQ ID NO: 161825 - DNA, 592 bp, Homo sapiens
  misc_feature: GYAE6OF02HL67D.48.25.C03.1.454.CMB.1.raw
  modified_base (274)..(274): a, c, t, g, unknown or other
  misc_feature (274)..(274): n is a, c, g, or t
  modified_base (553)..(553): a, c, t, g, unknown or other
  misc_feature (553)..(553): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctccaggcctcctcatttangatacatccacagggccactggtctcccagccaggttcacgtggcggtggtctgggacagtagttcactctcaccatcagcagcctgctagtctagaacgttatttttacatttttatactgttcagtctagttactacggtaagtcgtaacttccggtacggtttcggaccgtaaaggggtaccaagggttggaaacgtaccaaacggtaacgttggtaggtcgtacgacctaacctagttcgtgttacttcgaacttcccgtacccgacctaacttntacggtaattacgttacgttaacttcccgttagtacggg

SEQ ID NO: 161826 - DNA, 576 bp, Homo sapiens
  misc_feature: GYAE6OF02F47AO.48.25.C03.1.454.CMB.1.raw
  modified_base (205)..(205): a, c, t, g, unknown or other
  misc_feature (205)..(205): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagtattccactggacaaatagtgatgacgtcagtccccagccaccctgtctgtgtctccaggggaaangtcaccctctcctgcagggcccaggtcgagagtcttgacagctccttagcctggtaccaacaaggcctggccagcctccagctcctnatttangatacatccgacngggccacgtggtcgtccagcagttcagtggcggtggtctgggacagagttcacgtcgtcacctatcagtccagcctgctacgtctagtaacgtatttactattttactactgtacagctagtatcgtaagtcgtactcgtacgtttcggaccgtaaggaccgtaaggtggaaacgtacgaaacggtatacggtggtaccgtcggacctaacgtacgttcgttacgttcttacgtacgttacccgttacccgtaccgtacttaccg

SEQ ID NO: 161827 - DNA, 651 bp, Homo sapiens
  misc_feature: GYAE6OF02I1JU2.48.25.C03.1.454.CMB.1.raw
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (243)..(243): a, c, t, g, unknown or other
  misc_feature (243)..(243): n is a, c, g, or t
  modified_base (292)..(292): a, c, t, g, unknown or other
  misc_feature (292)..(292): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtcctgtgtctccgaggggaanacgtccaccctntcctgcagggccagtgagagtctgacngctctagctgacaacaaggcctggccagcctccaggctcctcatttagngaatacactacccgaccgtacggaccctactcggtcgtccccaggaccctaggttccacggtcgggtcggtacggtcctaggggacagtacgtttcacgtctacgaaccctatcgaacgcacgtcctcgactagtacgtagtaagtttactttacgtattttaacgtacttgttacacgtacttacgtagttacgtaacgtacggaccgttccggttaacgttcgggtaacccgtaagggaaccgttaagggtacggtaaacgtaaccgtaaacgtacgttacggtacggtacgtagaacccgtactacgttccgttacgtcctttccgtacccgttcccgaccgttacgttccgtacg

SEQ ID NO: 161828 - DNA, 535 bp, Homo sapiens
  misc_feature: GYAE6OF02GN3JL.48.25.C03.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (405)..(405): a, c, t, g, unknown or other
  misc_feature (405)..(405): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaaggcctggccagccctcccaggcctcctcatttangatacatccaccagggccacgtggtcgtcccagccaggttcacgtgggcggtggtctggggacaggagtttcactctcaccatcagcagcctgcagtctagaagtnttttaacattttatactgtacagctagtatcgtaagtggtactccggtacgtttcggacctaagggaccaagggtgaagtacaaacgtactgtggctgaccacatcgtgtcttcattcctcccgctatcg

SEQ ID NO: 161829 - DNA, 553 bp, Homo sapiens
  misc_feature: GYAE6OF02IC91U.48.25.C03.1.454.CMB.1.raw
  modified_base (278)..(278): a, c, t, g, unknown or other
  misc_feature (278)..(278): n is a, c, g, or t
  modified_base (400)..(400): a, c, t, g, unknown or other
  misc_feature (400)..(400): n is a, c, g, or t
  modified_base (406)..(406): a, c, t, g, unknown or other
  misc_feature (406)..(406): n is a, c, g, or t
  modified_base (547)..(547): a, c, t, g, unknown or other
  misc_feature (547)..(547): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaaccaaacaaacggcctggccagcctcccaggcctcctcatttangatacatccacagggcccatcggtgtcccagccaggttcacgtggcggtgggtctgggacagcgttcacgtctcacatcagcagcctgcagtctagaattacttttactatttttatacgtntcagtntagttagtacgtagtggtacctccggtagtttggaccaagggtaccaagggtacgaagtaacgaaacgtaatggaggtctgaccaactatcttgtactttcacttccctccgtcctagtctagacttagtcgttatacctntacggg

SEQ ID NO: 161830 - DNA, 559 bp, Homo sapiens
  misc_feature: GYAE6OF02HMYR1.48.25.C03.1.454.CMB.1.raw
  modified_base (205)..(205): a, c, t, g, unknown or other
  misc_feature (205)..(205): n is a, c, g, or t
  modified_base (297)..(297): a, c, t, g, unknown or other
  misc_feature (297)..(297): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaagngtcaccctctcctgcagggccagtgagagtcttgacagctccttagcctggtaccaacaaaggcctggccagcctccaggctcctcatttangatacatccaccagggccacgtggtcgtcccagccaggttcacgtggcggtggtctggggacagtgtcactctcacatcagcagcctgcagtctagaagtattttaacattttatacttgtctagtcagttatacgtagtggtactccggtacgtttcggaccgaagggaccgaagggtggaaagtacgaaacgtacgtggtaggtctcggacctacctagttctagttccttacaaccgttcccttccccgacctacttcg

SEQ ID NO: 161831 - DNA, 606 bp, Homo sapiens
  misc_feature: GYAE6OF02IUKOV.48.25.C03.1.454.CMB.1.raw
tcagagtatacatacacgaccggtgctcgatttagtagtgtagatttgggtttgggggaggaactgctcagttaggacccagacggaaccatggaagccccagcgcagcttctcttcttcctgctactctggctcccagattccactggacaaatagtgatgacgcagtcccccagccaccctgtctgtgtctccaggggaaagagtccaccctctcctgcagggccagtgagagtcttgacagctccttagcctggtaccaacaaaggcctggccagccctcccaggctcctcatttatgatacatccaccaggggccacgtggtgtcccacgccaggttcacgtggcggtggtctgggacagagttcactctcaccatcagcagcctgcagtctagaagtattttactattttaacttactgtactagctaagttatacggttaaggtcggtacgttccggtacggttttacgggaccgtaaacggggtaccgaaagggttacggaaacgtaaccgaacggtaacgtggtacgggacgtcggtacctaaccgtacgttacgttaggttaccttacgtacttccccgtaccccgtacctattccg

SEQ ID NO: 161832 - DNA, 703 bp, Homo sapiens
  misc_feature: GYAE6OF02HN5FU.48.25.C03.1.454.CMB.1.raw
  modified_base (190)..(190): a, c, t, g, unknown or other
  misc_feature (190)..(190): n is a, c, g, or t
  modified_base (221)..(221): a, c, t, g, unknown or other
  misc_feature (221)..(221): n is a, c, g, or t
  modified_base (290)..(290): a, c, t, g, unknown or other
  misc_feature (290)..(290): n is a, c, g, or t
tcagagtatacatacacgaccggtgctcgatttagtagtgtagatttgggtttgggggagacggaaccatggaagccccgagcggcagcttactcttcctcctgctactcctggcttcccagtatttccactggacaaatagtgatgacgcagtccccgagccaccctgtctgtgtctccgtagggaaancgtccacccgtctcctgcagggccagtgagngtcttgacagctcctagcctaggtacccaagaaggccttaggccacgaccctccagcctctcatttagnatacatccacgacggccactcggtacgccctagcctaaggttccacgttcgggacgggtcggtacgtcgggaccaggtattccgaattccgtaccaacgtacgttccgaggtacctacgtccttggacctacgtaccgtagtaagttacttttacgtaacttttactacgttacgtacgtagtactaagttaacgttacggttaacggtacgttaccggttaccggttacggttttacgggacccgtaaaacggggaaccgtaaacgggttaacggtaacgttaaaccggtaacggtaaccgttacggtacggttaccgtcggaaacctacgtaattccgtagttacctttacgtacgttcccttacccggtactacgttctagttactagttaccgttaacttcgtctacgg

SEQ ID NO: 161833 - DNA, 618 bp, Homo sapiens
  misc_feature: GYAE6OF02GCQUF.48.25.C03.1.454.CMB.1.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
  modified_base (381)..(381): a, c, t, g, unknown or other
  misc_feature (381)..(381): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagngtcaccctctcctgcagggccagtgagagtcttgacagctcttagcctggtaccaacaaggcctggccagcctcccaggcctcctctatttangatacactccaccgagggccacgtggtctcccagcctaggttcacgtgggcggtggtctgggacaggtacgttcactctcaccntcagcacgtcctgctagtcagtaagttattttactattttactactgtacgtagtctaagttacgtacgttaaggtcggtaaccgttcgtacggtttcgggaccgtaaacgggtaccgtaagggtacggtaaacggtaccaaaaccggtgttacggtcggtacgttcgaccctaacgtaacgttccgtagtttacccttacgtaccgtttacccgttaccccgaccttacgttaccg

SEQ ID NO: 161834 - DNA, 571 bp, Homo sapiens
  misc_feature: GYAE6OF02F7MWY.48.25.C03.1.454.CMB.1.raw
  modified_base (179)..(179): a, c, t, g, unknown or other
  misc_feature (179)..(179): n is a, c, g, or t
  modified_base (235)..(235): a, c, t, g, unknown or other
  misc_feature (235)..(235): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaanagtcaccctctcctgcagggccagtgagagtcttgacagctctagcctgtaccaanaagcctggccagcctccaggctcctnatttangatacatccaacagggccacgtggtcgtcccagcctaggttcacgtgggcggtgggtctagggacaggtagttccacgttcctacgacctatccgagcacgcctgctagtctaggaacgttattttactattttacttacgttgtcagtactagtagtacgtaagtcggtacttccggtacgtttcggacgtaagggacctaagggtcgaagtacaaacgtacgttggtacgcgtgacacgtagtctgtactttcgtccgttcccgctactcgttagacttagtcgtactacttcgtagtacgg

SEQ ID NO: 161835 - DNA, 581 bp, Homo sapiens
  misc_feature: GYAE6OF02GWR4V.48.25.C03.1.454.CMB.1.raw
  modified_base (241)..(241): a, c, t, g, unknown or other
  misc_feature (241)..(241): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacngctccttagcctggtaccaacaaggcctggccagccctcccaggcctcctcatttatgatacatcccaccgagggcccacgtggtcgtcccagccaggttccacgtgggcggtggtctggggacaggtagttcactctacaccatcagcagcctgcagtctagtaagtattttactattttatacttgtctagtctagttactcgtaagtggtaccgtccggtacggtttcggacctaaaggggtacctaagggtacggaacgtacgaaacgtacgttggtacggactcggacctacctatccgttcgttccttctacgttcccttacccgtcctatccg

SEQ ID NO: 161836 - DNA, 694 bp, Homo sapiens
  misc_feature: GYAE6OF02IWJSO.48.25.C03.1.454.CMB.1.raw
  modified_base (209)..(209): a, c, t, g, unknown or other
  misc_feature (209)..(209): n is a, c, g, or t
  modified_base (249)..(249): a, c, t, g, unknown or other
  misc_feature (249)..(249): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccaccctgtcctgtgtcctaccgagggggaaanacgtccaccctctcctgcgagggccagtgagagtctgacngcttctagcctggaccaacgaaggcctggccagcccctaccgacggccttaccctactatttactagaacttacacgtcccaaccgacgggaccctagttcgggtaccgtccccaaggcccgtacggttccacgtggggccgggttggtccgtaggggaccaggtacgttcgaccttctaccgaacctactcgagccacgtccgtacgacgtagttccgaggttaacgtctttttaactaagttttactaccgtgttacaagtcgtaagttacgttacggtaagtccggaccttaccggttaacggtttcggacccgtaaaggggcccgtaaagggttacgaaacttaaccggaacgttacggtcggttacgggactacggaacctaccgtaagttccgttacgttaccgtttaccgaccttttcccgtaccccggctaattccg

SEQ ID NO: 161837 - DNA, 589 bp, Homo sapiens
  misc_feature: GYAE6OF02FNA6E.48.25.C03.1.454.CMB.1.raw
  modified_base (204)..(204): a, c, t, g, unknown or other
  misc_feature (204)..(204): n is a, c, g, or t
  modified_base (298)..(298): a, c, t, g, unknown or other
  misc_feature (298)..(298): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccagggggaaangtcaccctctcctgcagggccagtgagagtcttgacagctccttagcctggtaccaacaaggcctggccagccctcccaggcctcctcatttangatacatccaccagggccagtggtctcccagccaggttcacgtgggcggtggtctgggacaggagttcactctcaccatcagcagcctgcagtctagaagtattttactattttacttacttgtacacgtctagttagttacgtaagtcgggtaccttccggtacggttttcggaccgtaaggggtaccgtaaaggggtcggaaacgttacgaaaccggtaacgttggtacggtcgtggaccaaccgtagttccttggttccttctaccttcccgttcccgtactattccg

SEQ ID NO: 161838 - DNA, 573 bp, Homo sapiens
  misc_feature: GYAE6OF02JEJFJ.48.25.C03.1.454.CMB.1.raw
  modified_base (223)..(223): a, c, t, g, unknown or other
  misc_feature (223)..(223): n is a, c, g, or t
tcagagtatacatacacgaccggtgctcgatttagtagtgtagatttgggtttgggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctncccttaggcctaggtaacaccaaagggccctagggccacgacgtccctacggactccttacatttaattcaggacttaccaagtcccaacctaggggcccaacctggtacgtcccctaaggcccaagggttccgaacgttcggcgggtagggtctggggacaggacgttcactctcaccatcagcagcctgcagtctgaagtatttacatttatactgtactagctaagtatacgtaagtggtactccgaacgttcggacgtaagggacaaggtaggaagtacgaaacgactagtaggactagctacgatctagtcttcactcttcccgacatctagtatactgtatacg

SEQ ID NO: 161839 - DNA, 559 bp, Homo sapiens
  misc_feature: GYAE6OF02G9IK8.48.25.C03.1.454.CMB.1.raw
  modified_base (296)..(296): a, c, t, g, unknown or other
  misc_feature (296)..(296): n is a, c, g, or t
  modified_base (525)..(525): a, c, t, g, unknown or other
  misc_feature (525)..(525): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagccctccaggctcctcatttangatacactccaccagggccacgtggtctcccagccaggttcacgtggcggtggtcgtgggacagagttcactctcaccatcagcagcctgcagtctagtaagtattttactattttattactgtactagtctagtatacgttaagtcggtactccggtacgtttcggaccgtaagggtaaccaagggtagtaacgtaccgaaacgtaacgtggtaggtcgtgacacctnttctacgttcttcgacttccttacccgctactcg

SEQ ID NO: 161840 - DNA, 608 bp, Homo sapiens
  misc_feature: GYAE6OF02H0NPX.48.25.C03.1.454.CMB.1.raw
  modified_base (380)..(380): a, c, t, g, unknown or other
  misc_feature (380)..(380): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggcctcctcatttatgatacatccaccagggccactggtcgtcccagccaggttcacgtgggcggtgggtctggggacaggtagttcactctcaccatcagcagcctgcagtctgaagtnttttactattttattactgttcagtctagtatcggtaagtggtacttaccggtacgtttcggacccgtaagggaccctaaagggtggtaaacgtacgaaaacgtacgttggtacggtcttcgacctaaccgtagttccgttacgttcctttaccgaactttcccgttaccccggaccttaacgttccgtacgtacttacgttacggtttaacttccgttcgttacggg

SEQ ID NO: 161841 - DNA, 943 bp, Homo sapiens
  misc_feature: GYAE6OF02H68RE.48.25.C03.1.454.CMB.1.raw
  modified_base (327)..(327): a, c, t, g, unknown or other
  misc_feature (327)..(327): n is a, c, g, or t
tcagagtatacatacacgaccggtgctcgatttagtagtgtagatttgggtttggggggtagggaactgctcagttaggacccacgacggaaccatggaagccccacgcgcagcttctcttcctcctgctactctggctcccagattccactggaacaaatagtgatgacgcagtccccagcccacccttgtctgtcgtctaccgaggggaaagcgtccacccctctcctgcacgggccaggtggagtagttcttagacagcttaccgtacgcctaggtaaccaacgaacggctcggccacgccctcccaggtctcctactatttangaactacactccgaccacgggccacgtcggtccgtcccgagccgtacgggttcaccggttgggcgggtcgggtccgtgggtactacggtcgtttacctccgttcctacgacccgtaagttacccaacggtaccgtaccgtacccgtaggtaccgttacggtttaccgttacggtaaaacgtttaacgttttttaaaccgtaacgttttttaaccgttaaccgttttaccggttaccgttaaccgggttacccgtaaacggggtttaccgttttaaccgggttttaaaccgggggttaccggggttaaaccccggggttttaccccgggggtttaaaaccggggtttttcccggggaaaccccggggttaaaacgggggggttaacccggttaaaacccggggggtttaggggtaaaacccgggttaacccggaaaaaacccgggggttttaccgttaaccgggggttcggtaaaccccggttttacccgggtaacccgtttaaacccgttacccgggtttttaaccccgtttccgggttttaaccccttttaacccgtaaccccgttttccccggtttttaaacccccccggaaccgttttacgttaaaccccggg

SEQ ID NO: 161842 - DNA, 216 bp, Homo sapiens
  misc_feature: GYAE6OF02G5QIO.48.25.C03.1.454.CMB.1.raw
  modified_base (213)..(216): a, c, t, g, unknown or other
  misc_feature (213)..(216): n is a, c, g, or t
tcagagtatacatacacgaccggtgctcgatttagtagtgtagatttgggtttgggggatcaggactcctcagttcaccttctcacaatgaggctccctgctcagctcctggggctgctaatgctctgggtcccaggaactgtggctgcaccatctgtcttcatcttcccgccatctgatatgtatactgagcgggctggcaaggcgcatagnnnn

SEQ ID NO: 161843 - DNA, 580 bp, Homo sapiens
  misc_feature: GYAE6OF02JE64U.48.25.C03.1.454.CMB.1.raw
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagcctccaggctcctnatttangatacatcccaccagggcccacgtggtactcccagccaggttcacgtggcggtgggtctgggacaggtagttcactctcaccatcagcagcctgctagtctagaatattttactattttattactgtcagctagtagtacgtaagtggtacttccggtacgtttcggaccgtaagggtaccgaaggttaggaagtaccgaaacgtacgtaggtggacctgaccacctatcgtcgttcttacgtaacttcccgttacccgtacctacgttaccgttagtacttagttcgttaacttaccgtagtacggg

SEQ ID NO: 161844 - DNA, 525 bp, Homo sapiens
  misc_feature: GYAE6OF02FML6O.48.25.C03.1.454.CMB.1.raw
  modified_base (488)..(488): a, c, t, g, unknown or other
  misc_feature (488)..(488): n is a, c, g, or t
tcagagtatacatacacgaccggtgctcgatttagtagtgtagatttgggtttggggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtcgtcccagcccaggttcactggcggtggtctggggacaggtagtcactctcaccatcagcacgcctgcagtctagaagtattttacattttattactgtcagtctagtatacgtagtgactccgtacgttggaccaagggaccaagggtgaagtacaaacgactgnggctggcacgatctgtcttcactccttccgcctatcg

SEQ ID NO: 161845 - DNA, 517 bp, Homo sapiens
  misc_feature: GYAE6OF02FXR5P.48.25.C03.1.454.CMB.1.raw
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccagggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctggggacagagttcactctcaccatcagcagcctgcagtctagaagtattttacattttatactgtcagcagtatcgtaagtggactccgtacgtttggccgaagggaccaaggtgaagtcaaacgactgtggctgacacatctgtcttcattcctcccgcctatc

SEQ ID NO: 161846 - DNA, 769 bp, Homo sapiens
  misc_feature: GYAE6OF02HWGJU.48.25.C03.1.454.CMB.1.raw
  modified_base (255)..(255): a, c, t, g, unknown or other
  misc_feature (255)..(255): n is a, c, g, or t
  modified_base (315)..(315): a, c, t, g, unknown or other
  misc_feature (315)..(315): n is a, c, g, or t
  modified_base (371)..(371): a, c, t, g, unknown or other
  misc_feature (371)..(371): n is a, c, g, or t
  modified_base (428)..(428): a, c, t, g, unknown or other
  misc_feature (428)..(428): n is a, c, g, or t
tcagagtatacatacacgaccggtgctcgatttagtagtgtagatttgggtttgggggtagggaacgtgctcagttaggaccagacggaaccatggaagcccagcgcagcttctcttcctcctgctactctggctcccagattccactggaacaaatagtgatgacgcacgtccccagcctaccctgtctgtgtcctaccgaaggggaaatacgtccaacccttctccgtgcagggccagtgagagtcttgaacngtctcttagccgtgtaaccaacaaacggctcggaccagcctccaggcctcctctatttangtactaacactccaaccgaggccacgtcggttcgaccccagcctaagggttcacgngggtcggtcggttcgaggacgagtacgtttcacgttcaccgtaacacgttacaacgnaacggtccctaggcctaaggtccgttaaggtaaacgttatttttaacaagtttttaacctacgtttacgacgtttaacgcgtaaggttaaccttagggtaaaacgttaccgggtaaccttacccggggtttaaacccgggttttcgggaacccggtaaaaccggggggttaaccgaaaaccgggggtttaaggggaaacgtttaaaacccgaaaaaacggtaacgtttacggggttacgtaccggtttacggaaccaacccgttaaagtttccccgggttgttttacccttaaccgtaccttttaccccgggtttccccgaacccgttatttaaccccggg

SEQ ID NO: 161847 - DNA, 615 bp, Homo sapiens
  misc_feature: GYAE6OF02I95FC.48.25.C03.1.454.CMB.1.raw
  modified_base (180)..(180): a, c, t, g, unknown or other
  misc_feature (180)..(180): n is a, c, g, or t
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (292)..(292): a, c, t, g, unknown or other
  misc_feature (292)..(292): n is a, c, g, or t
  modified_base (541)..(541): a, c, t, g, unknown or other
  misc_feature (541)..(541): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatgtgatgacgcagtccccagccaccctgtctgtgtctccgaggggaaangtccaccctctcctgcgagggccagtgagagtctgacagctctagctgaccanaagcngcagcctccgagctcncatttngactacntccacgacggccacgtggctacccngccaggttccacgtgggcggtgggtcgtagggacaggtacgttccaacgtcctaccgacctaatcaacggcacggccctaggcctagttctaggtaatttacttttactacttttaataccgttgtacctagtacgtagtaacgtacggttaagtcgtaccgtaccggtacggtttacggaaccgtaacgggtacgtagggttaacgaagtaacgtaaaaccgtgtaggtacgactcgaccgtaaccgngttacgtgttaccttacgtaacgttcctaccgtccgtaacgtcgtagttactacgttagtactcgttacgcggg

SEQ ID NO: 161848 - DNA, 528 bp, Homo sapiens
  misc_feature: GYAE6OF02HYWDL.48.25.C03.1.454.CMB.1.raw
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
  modified_base (470)..(470): a, c, t, g, unknown or other
  misc_feature (470)..(470): n is a, c, g, or t
  modified_base (490)..(490): a, c, t, g, unknown or other
  misc_feature (490)..(490): n is a, c, g, or t
  modified_base (523)..(523): a, c, t, g, unknown or other
  misc_feature (523)..(523): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagccctcccaggcctcctcatttatgatacatccaccagggccacgtggtcgtcccagccaggttcacgtgggcggtggtctgggacagagttcactctcaccatcagcagccngcagtctagaagtnttttactattttattactgtacagctagtatacgtaagtggactccgtagtttggaccgaagggaccaaggtgaagtacgaaacgacgtgngctgcacgatctgtcttacncttccttccgctactctagtatatagtactctntacgg

SEQ ID NO: 161849 - DNA, 577 bp, Homo sapiens
  misc_feature: GYAE6OF02FUUPI.48.25.C03.1.454.CMB.1.raw
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctccaggcctcctnatttangatacatccaccagggccactggtcgtcccagccaggttcacgtggcggtggtctgggacaggagttcactctcaccatcagcacgcctgctagtctagaagtatttactatttttatactgtcagtctagtatacgtaagtcggtaccttccggtacgtttcggaccgaagggtaccgtaagggtacggaagtacgaaacggtaacttggtagggtctcgacctacgtattcgtcgttcttacgtacttcccgttacccgtctacgttctacgtacttagttagttacttacctcgttacgg

SEQ ID NO: 161850 - DNA, 608 bp, Homo sapiens
  misc_feature: GYAE6OF02GNDM6.48.25.C03.1.454.CMB.1.raw
  modified_base (203)..(203): a, c, t, g, unknown or other
  misc_feature (203)..(203): n is a, c, g, or t
  modified_base (296)..(296): a, c, t, g, unknown or other
  misc_feature (296)..(296): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaggcctggccagcctcccaggctcctcatttangatacatccaccagggcccacgtggtcgtcccagcctagggttcacgtgggcggttggtcgtggggacaggagtttcactctcaccatcagcagcctgctagtctagaagtacttttactattttacttactgtctagtctagttatacggtaagtcggaccttccggtacgtttcggaccgtaacggggtacctaaggggttacggaaacggtaccgaaaacggtacgttaggtacggtacgtacggacctaccgtacgttccgttacgttaccttactaccgttcccgttacccggtaccttagttaccg

SEQ ID NO: 161851 - DNA, 583 bp, Homo sapiens
  misc_feature: GYAE6OF02F6YK7.48.25.C03.1.454.CMB.1.raw
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacgaaaggcctggccagccctcccgaggcctcctctatttatgatacatccaccgagggccacgtggtcgtcccagcctaggttccacgtgggcggttgggtctgggacaggacgttcactctcaccatcagcagcctgctagtctagaatattttactattttatactgtactgtactagtatacgtaagtcggacttcggtacgtttcggaccgtaaggaccgaagggtagaagtacgaaacggtacgtggtacgctcgaccaacgtactcgttcgttcttacgtacttcccgttacccgacctagttccgttagtacttacttacgttacttacttcgtacgg

SEQ ID NO: 161852 - DNA, 506 bp, Homo sapiens
  misc_feature: GYAE6OF02F77HD.48.25.C03.1.454.CMB.1.raw
  modified_base (299)..(299): a, c, t, g, unknown or other
  misc_feature (299)..(299): n is a, c, g, or t
  modified_base (475)..(475): a, c, t, g, unknown or other
  misc_feature (475)..(475): n is a, c, g, or t
  modified_base (484)..(484): a, c, t, g, unknown or other
  misc_feature (484)..(484): n is a, c, g, or t
  modified_base (501)..(501): a, c, t, g, unknown or other
  misc_feature (501)..(501): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtcccccagccaccctgtctgtgtctccaggggaaagagtcaccctctcctgcagggccagtgagagtcttgacagctccttagcctggtaccaacaaaggcctggccagcctcccaggcctcctcatttangatacatccaccagggccactggtctcccagccaggttcactgggcggtggtctggggacagagtcactctcacatcagcagcctgcagtctgaagtattttacattttatactgtcagctagtatcgtaagtggactcgtagttgaccaagggacaaggtgaagtcaacgtatgngctgccacntctgtctcatctcccgntatcg

SEQ ID NO: 161853 - DNA, 540 bp, Homo sapiens
  misc_feature: GYAE6OF02IOVIW.48.25.C03.1.454.CMB.1.raw
  modified_base (204)..(204): a, c, t, g, unknown or other
  misc_feature (204)..(204): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccacttgacaaatagtgatgacgcagtcccccagccaccctgtctgtgtctccaggggaaangtcaccctctcctgcagggccagtgagagtcttgacagctccttagcctggtaccaacaaggcctggccagccctcccaggcctcctctatttatgatacactccaccgagggccacgtggtctcccagcctaggttcacgtggcggtggtcgtgggacaggtagttcactctcaccatcagcagcctgcagtcagaagtattttacatttatactgtcagcagttatacgtaagtcgactccgtagttcggaccgtaagggaccaagggtgaagtaacaacgagtgtgcgtgaccaccgtatccgtgttccttcgacttcccgtaccgcctatcg

SEQ ID NO: 161854 - DNA, 559 bp, Homo sapiens
  misc_feature: GYAE6OF02GSICS.48.25.C03.1.454.CMB.1.raw
  modified_base (203)..(203): a, c, t, g, unknown or other
  misc_feature (203)..(203): n is a, c, g, or t
  modified_base (298)..(298): a, c, t, g, unknown or other
  misc_feature (298)..(298): n is a, c, g, or t
  modified_base (321)..(321): a, c, t, g, unknown or other
  misc_feature (321)..(321): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaanagtccaccctctcctgcagggccagtgagagtcttgacagctccttagcctggtaccaacaaaggcctggccagcctcccaggctcctcatttangatcatccaccaggccactggtncccagccaggttcactgggcggtggtctgggacagagttcactctcacatcagcagcctgcagtctagaacgtattttacattttactactgtcagcagtatcgtagtgactccggagtttcggaccaagggtaccaagggtacggaaacgtacgaaacgacgttgtacggacttcggaccaaccgtagttccgtaggttccttacggaccttccgtttaccccgacttacgttaccg

SEQ ID NO: 161855 - DNA, 519 bp, Homo sapiens
  misc_feature: GYAE6OF02GZK7A.48.25.C03.1.454.CMB.1.raw
  modified_base (203)..(203): a, c, t, g, unknown or other
  misc_feature (203)..(203): n is a, c, g, or t
  modified_base (429)..(429): a, c, t, g, unknown or other
  misc_feature (429)..(429): n is a, c, g, or t
  modified_base (504)..(504): a, c, t, g, unknown or other
  misc_feature (504)..(504): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaagngtcacctctcctgcagggccagtgagagtcttgacagctccttagcctggtaccaacaaaggcctggccagcctcccaggcctcctctatttatgatacatccaccagggccacgtggtgtcccagcctaggttcacgtggcggtggtctgggacaggagttcactctcaccatcgagcacgctgctagtcgtgaagtatttatactttatactgtctagctagtntacgtagtgacttcgagtttcgacgaaggcaaggtacggaatacgaagacgtgtgcgtcgcactatctgtcttcncttcctccgctatcg

SEQ ID NO: 161856 - DNA, 517 bp, Homo sapiens
  misc_feature: GYAE6OF02FWNFZ.48.25.C03.1.454.CMB.1.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (405)..(405): a, c, t, g, unknown or other
  misc_feature (405)..(405): n is a, c, g, or t
  modified_base (427)..(427): a, c, t, g, unknown or other
  misc_feature (427)..(427): n is a, c, g, or t
  modified_base (466)..(466): a, c, t, g, unknown or other
  misc_feature (466)..(466): n is a, c, g, or t
  modified_base (511)..(511): a, c, t, g, unknown or other
  misc_feature (511)..(511): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtcccccagccaccctgtctgtgtctccaggggaaanagtcaccctctcctgcagggccagtgagagtcttgacagctctagcctggtaccaacaaggcctggccagcctcccaggctcctcatttangatacatcccaccagggcccacgtggtctaccaagccaggttcacgtgggcggtggtctggggacaggtagttcacttctcaccatccagcagcctgcagtctggaaatntttacattttattactgtcagnagtatcgtaagtgactcgtagttgccaaggacctaaggngatacaagactgtgctgcacgattcgtgtcttcacttccgtcccnctatcg

SEQ ID NO: 161857 - DNA, 652 bp, Homo sapiens
  misc_feature: GYAE6OF02I82IO.48.25.C03.1.454.CMB.1.raw
  modified_base (181)..(181): a, c, t, g, unknown or other
  misc_feature (181)..(181): n is a, c, g, or t
  modified_base (221)..(221): a, c, t, g, unknown or other
  misc_feature (221)..(221): n is a, c, g, or t
  modified_base (285)..(285): a, c, t, g, unknown or other
  misc_feature (285)..(285): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaanagtccaccctctcctgcgagggccagtgagagtcttgacngtcctccttagcctaggtaaccaaacaaacggcctggccagccctccgaggcctcctctatttntgactacactcccacgacgggcctacgtggtccgtcccacggcctaggtcacgtcgggcggttgggtcgtgggacaggtacgttccacttccgtaccactatcaggcaacgtcctgtcacgttactaaggtaacgtttactttttaacgtaatttttaacgtacttcgtacagtctaagttatacggttaagtcggtaccttcgttaggttcgaaccgtaaagggacctaagggtcgaaacgttaccgaaaacggtacttggtacggtacctaggaccctaacgtacttacgttcgttacctacgtcctttaccccgttcgacccttataccgtagtacttacttcggttaacttacgtcggtacgg

SEQ ID NO: 161858 - DNA, 662 bp, Homo sapiens
  misc_feature: GYAE6OF02IXB6U.48.25.C03.1.454.CMB.1.raw
  modified_base (201)..(201): a, c, t, g, unknown or other
  misc_feature (201)..(201): n is a, c, g, or t
  modified_base (293)..(293): a, c, t, g, unknown or other
  misc_feature (293)..(293): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatgtgatgacgcagtcccagccacctgtctgtgtctccgaggggaaancgttaccctctcctggcagggccagtgagagtctgacagctccttagcctggtaccaacaaggcctggccagcctccaggctcctcatttangatacatccaccgtagggccacgtcggtcgtcccagcccaggttcactgggcggtggtctggggacaggtcgttcactctacgtaccattcaggtccaggtccctgacctaagttcgtacgtaaagtactttttacgtatttttaacgttcctaggttcaagttacctaggttacttaccggtaagttacggtaccttacccgggtacgttttacgggacccgtaaaaggggtaccctaaagggtttacgggaaaaccggttactaaaaaaccgggtacgttcgggtagggtaccttagggacccttaaccgaagtttcctcggttaacttccgtacgttaccgttccccgacgtttactccgttaagg

SEQ ID NO: 161859 - DNA, 516 bp, Homo sapiens
  misc_feature: GYAE6OF02FMYT6.48.25.C03.1.454.CMB.1.raw
  modified_base (180)..(180): a, c, t, g, unknown or other
  misc_feature (180)..(180): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaaggcctggccagcctcccaggctcctcatttatgatacatccaccagggccactggtgtcccagccaggttcacgtggcggtgggtctggggacaggagttcactcgtcaccatcagcagcctgcagtctgaagtattttacattttatactgtcagctagtatcgtaagtggactccgtacgtttggccaagggaccaagggtgaagtacaaacgtaacgtgtaggctgcaccatctgtcttcgatccttcccgctatctgatatgtatctctg

SEQ ID NO: 161860 - DNA, 596 bp, Homo sapiens
  misc_feature: GYAE6OF02G47QF.48.25.C03.1.454.CMB.1.raw
  modified_base (204)..(204): a, c, t, g, unknown or other
  misc_feature (204)..(204): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaangtcaccctctcctgcagggccagtgagagtctgacagctccttagcctggtaccaacgaaggcctggccagccctcccgaggcctcctctatttatgaatacactcccaccgacgggccacgtggtcgtcccagcctaggttcacgtgggcggtggtcgtggggacaggtacgtttcacgttctaccaacctatcgagccacgccctgccagtctagaagttattttactattttatactgtactagtctagttagttacgtaagtcggtacttccggtacggtttcggaccgtaacgggaccgtagggtacggaaacgtaacgaacgtacgtggtacggtcgtcgacctacgtagttcgtagttcttctacgttcccgtacccgctactcg

SEQ ID NO: 161861 - DNA, 642 bp, Homo sapiens
  misc_feature: GYAE6OF02GKSQL.48.25.C03.1.454.CMB.1.raw
  modified_base (269)..(269): a, c, t, g, unknown or other
  misc_feature (269)..(269): n is a, c, g, or t
  modified_base (276)..(276): a, c, t, g, unknown or other
  misc_feature (276)..(276): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaagagtcaccctctcctgcagggccaggtgagagtcttgacagctctagcctggtaaccaacaagcctggccagccctccgaggcctcctntatttangatacactccaccgagggccctacgtggtcgtcccagccgtaggttccacgtggcgggtggtcgtgggacaggtacgttcactctacacatccgagcacgctgctagtcgagtaattacttttactaattttacttactagtcagtactagtacgtacgttaagtcggtaccttaccggtacgtttacggaccgtaaacggggtacgtaagggttacggtaaacggtaaccgtaaacggtaacggttggtacggtactcgacccgtaacgtacttccgttagttaccttacgttaaccttcccgttaccccgacgttacgttaccgtacgttaacgttagtacgtttactttacgttcgtaacggg

SEQ ID NO: 161862 - DNA, 702 bp, Homo sapiens
  misc_feature: GYAE6OF02HSEUC.48.25.C03.1.454.CMB.1.raw
  modified_base (280)..(280): a, c, t, g, unknown or other
  misc_feature (280)..(280): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaagagtcaccctctcctgcacgggccagtgagagtcttgacagctccttagcctggtaccaacgaaaggcctggccacgcctcccaggcctcctctatttangatacatcccacgacgggccacgtcggtcgtcccagcctaggttccacgtggcgggtgggtctgggactaggtagttccacttctccgaaccctacgtcgacgaccaggccctagccgtagttacctagtaaacgttaacttttttaactagttttttaactactttaggtaccaggttacctaaagttctaaccggttaaaggttcggtaaccgttcccggtaacggtttggaacccggtaaaggggaccctaaaggggttacgggaaaacgtaaccgaaaaccggtagtcggtacggtccgttacggaacctaaccgtacttcgttcgtttacccttacgtacctttacccgttcccgtaaccctacgtttacctaagtaactttcgttaacgtttaaccttaccggttcggttaacggg

SEQ ID NO: 161863 - DNA, 650 bp, Homo sapiens
  misc_feature: GYAE6OF02HRM5A.48.25.C03.1.454.CMB.1.raw
  modified_base (181)..(181): a, c, t, g, unknown or other
  misc_feature (181)..(181): n is a, c, g, or t
  modified_base (273)..(273): a, c, t, g, unknown or other
  misc_feature (273)..(273): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaangtcaccctctcctgcagggccagtgagagtcttgacagctccttagcctggtacaacaaggcctggccagcctccaggcctcctctatttangactacatcccaccgagggacccacgtcggtcgtcccagccgtacggttcacgttcgggcgggttgggtcgtgggacagtacgttcactcctacacctatcgacgtccacggtcctgaccgtagttcctaggtaacgtttactttttacgttaattttacttacgttgtactagtactagttacgtacgtaaggtcgtaccgttccggttacgttcgggaccgtaaagggtaccgtaaaggtggaaacgtacgtaaacggacgttggtacgtacgtcgaccgtaacgtcgttccgttacgttacctttacgaaccgtttcccgtcccgttacctacgttcgtacgttaagttcttacggtttacttccgtagtacgg

SEQ ID NO: 161864 - DNA, 630 bp, Homo sapiens
  misc_feature: GYAE6OF02GQ7IE.48.25.C03.1.454.CMB.1.raw
  modified_base (300)..(300): a, c, t, g, unknown or other
  misc_feature (300)..(300): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaagagtccaccctctcctgcagggccagtgagagtcttgacagctccttagcctggtaccaacgaaaggcctggccagcctccaggctcctctatttangatacactccaccgagggccacgtcggtcgtacccagcccgtaggttccacgtcgggcggtgggtcgtggggacaggtacgttcactcgtcacctatcagcacgcctgctagtctagtaagttattttactattttactactgtactagtactagttacgtacggtaagtcggaaccttccggtacgtttcggaccgtaaagggaccgtaagggtacggaaacgttaaccggaaaacgtacgttaggtacggtacctacggtaccctaacctgttaccgttcggtttaccttaccgtaccgttcccgtttaccccgtacgttacttccgg

SEQ ID NO: 161865 - DNA, 589 bp, Homo sapiens
  misc_feature: GYAE6OF02IGMCP.48.25.C03.1.454.CMB.1.raw
  modified_base (180)..(180): a, c, t, g, unknown or other
  misc_feature (180)..(180): n is a, c, g, or t
  modified_base (273)..(273): a, c, t, g, unknown or other
  misc_feature (273)..(273): n is a, c, g, or t
  modified_base (337)..(337): a, c, t, g, unknown or other
  misc_feature (337)..(337): n is a, c, g, or t
  modified_base (353)..(353): a, c, t, g, unknown or other
  misc_feature (353)..(353): n is a, c, g, or t
  modified_base (578)..(578): a, c, t, g, unknown or other
  misc_feature (578)..(578): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtacaacaaaggcctggccagcctccaggcctcctcatttangatacatccaccagggccacgtcggtacgtcccagccagttccacgtggcggtggtctgggacngagttcactctcgacntcagcgagcctagacagtctaggaagttacttttacattttataccgtgactagctaagttactacggtaagttcggacttcccggtagtttcggacctaaaggggccaaagggtcggaatacgaaacgacgttgcgtatcgcgtaacctagtcctagtcctttacgacttcccgttccccgaacttacgtcgttacggaactttaccgtaagttactttacccncgttaaccggg

SEQ ID NO: 161866 - DNA, 597 bp, Homo sapiens
  misc_feature: GYAE6OF02HWVH0.48.25.C03.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccagggggaaangtcaccctctcctgcagggccagtgagagtcttgacagctccttagcctggtaccaacaaaggcctggccagcctccaggctcctcatttangatacatccaccagggccacgtggtctcccagccaggttcacgtggcggtgggtctggggacaggagttcactctcaccatcagcacgcctgcagtctagaagtattttacattttatactgtacagtctagttatacgtaagtcggtacgttaccgtacggttttcggaccgtaaacggggaccgtaaaggggttacggaaacggttaccgaaaacggtaccgttggttacgggccgtggtaccaaccgtacgttccgttagttcctttacgacctttcccttccccggtctactttacg

SEQ ID NO: 161867 - DNA, 600 bp, Homo sapiens
  misc_feature: GYAE6OF02IE3I0.48.25.C03.1.454.CMB.1.raw
  modified_base (370)..(370): a, c, t, g, unknown or other
  misc_feature (370)..(370): n is a, c, g, or t
  modified_base (411)..(411): a, c, t, g, unknown or other
  misc_feature (411)..(411): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtcccccagccaccctgtctgtgtctccaggggaaagagtcaccctctcctgcagggccagtgagagtcttgacagctccttagcctggtaaccaacaaaggcctggccagccctcccaggcctcctcattttatgatacatcccaccgagggcccactggtctcccagcctaggttcacgtgggcggtgggtctgggacagngttcactctacaccatcagcagcctgctagtctgaaagttnttttaactatttttacttacgttagtccagtcgtagttattacgtaagtggtaccgttccggtacggtttcggacccgtaagggtacccgaaagggttggaaacgtcgaaaacggtactaggtacggctcggacctacgtacttccgtcgttcctttacgtactttccccgttcccgtacctattaccg

SEQ ID NO: 161868 - DNA, 647 bp, Homo sapiens
  misc_feature: GYAE6OF02F3NC1.48.25.C03.1.454.CMB.1.raw
  modified_base (276)..(276): a, c, t, g, unknown or other
  misc_feature (276)..(276): n is a, c, g, or t
  modified_base (349)..(349): a, c, t, g, unknown or other
  misc_feature (349)..(349): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctcctagcctggtaaccaacaaaggcctggccagccctcccaggctcctcattttangatacatcccaaccacggggccacgttgggtcgtccccagccaggttcacgtgggcggtgggtctgggacagngttcactctcaccatcagcagcctgcagtctagaagtattttacatttttatacttgtcagtctaagttattacggtaagtcggtaccttccggtacgttttcgggacccgtaaaggggtacccaaaggggttacggaaacggttaccgaaaacggtaacgttagggttacggtccgtagacccgtaaccgtacttccgttacgttccgtttaccgtacgtttacccgtttcccccggtaccttaacgttccgttagtaactttacttacgtttaaccgtttaccttcgttaaccggg

SEQ ID NO: 161869 - DNA, 723 bp, Homo sapiens
  misc_feature: GYAE6OF02J14IH.48.25.C03.1.454.CMB.1.raw
  modified_base (180)..(180): a, c, t, g, unknown or other
  misc_feature (180)..(180): n is a, c, g, or t
  modified_base (209)..(209): a, c, t, g, unknown or other
  misc_feature (209)..(209): n is a, c, g, or t
  modified_base (285)..(285): a, c, t, g, unknown or other
  misc_feature (285)..(285): n is a, c, g, or t
  modified_base (699)..(699): a, c, t, g, unknown or other
  misc_feature (699)..(699): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaanagtcaccctctcctgcagggccagtgagngtcttgaccagcttcctagcctaggtaaccaacgaagtcctggcccaggtccctccgaggtctcctctagtttagngtactacctactccacccggacgggccctacgttcggtcgtccccgagtccgtaaggttccaacggttcgggccgggttgggtccgtagggggtaacctaggtacgttcctaacggtcccgtcaaccgtacttacgacgccgtacgcctagacccagttccgtaagaacgttacttttactactttttacgtaaccgttgttacgacgtacgttagttacgttacggttaacggtacgtaccgttacggttaaccggtttcggtaccgtaaacggggtccttaaagggtacggtaaacgtaccggaaaaccgtacgttaacggtcggttacgtacggtacctccgtaacgttcgtttacggtctttacgaaccgtttacccgtaccgtacccgttactacggttctaaccggtnttacgttactacccgttatccggg

SEQ ID NO: 161870 - DNA, 603 bp, Homo sapiens
  misc_feature: GYAE6OF02FOX1T.48.25.C03.1.454.CMB.1.raw
  modified_base (203)..(203): a, c, t, g, unknown or other
  misc_feature (203)..(203): n is a, c, g, or t
  modified_base (297)..(297): a, c, t, g, unknown or other
  misc_feature (297)..(297): n is a, c, g, or t
  modified_base (362)..(362): a, c, t, g, unknown or other
  misc_feature (362)..(362): n is a, c, g, or t
  modified_base (396)..(396): a, c, t, g, unknown or other
  misc_feature (396)..(396): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtcccccagccaccctgtctgtgtctccaggggaangtcaccctctcctgcagggccagtgagagtcttgacagctccttagcctggtaccaacaaggcctggccagcctcccgaggcctcctcatttangatacactccaccgagggccacgtggtcgtcccagccaggttcacgtgggcggtggtctgggacngagttcactctcaccatcagcagtcctgcagtcngaatattttacattttactactgtacagtactagttactacggttagtcggtaccttccggtacggtttcggaccgtaacgggtacccgtaagggttacggaaacgttaacgtaaaccgtacgttacgggtacggtcctacgggacctaaccgtacttacgttcgttaccgttacgaccgtttcccgtaccccgtactacgttaccg

SEQ ID NO: 161871 - DNA, 731 bp, Homo sapiens
  misc_feature: GYAE6OF02J2QMP.48.25.C03.1.454.CMB.1.raw
  modified_base (205)..(205): a, c, t, g, unknown or other
  misc_feature (205)..(205): n is a, c, g, or t
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
  modified_base (325)..(325): a, c, t, g, unknown or other
  misc_feature (325)..(325): n is a, c, g, or t
  modified_base (726)..(726): a, c, t, g, unknown or other
  misc_feature (726)..(726): n is a, c, g, or t
tcagagtatacatacacgaccggtgctcgatttagtagtgtagatttgggtttgggggaggaactgctcagttaggaccagacggaaccatggaagccccagcgcagcttctcttcctctgctactctggctcccagattccactggacaaatagtgatgacgcacgtccccagcctaccctgtctgtgtctaccgaggggaaancgtccaccctctcctgcgagggcctaggtgacgngttctgacncgtccttccttagccgtaggtaccaaacgaacggtcctcggcacgccctcccgaggtcccttccttactattttacncgtaatacctcctccgaccgacgggtacctacgttcgggtcctacccgacggcctacggttcgacggttcggggcggttgggctacggggactaacggttctcgaccttacgtccgaacctaggttccaggtccctaggtcctacggctaacggttctaaggtaattttaacttttactttagttttacttcccgtagtacttaggtaccgttagttaccgttaaaggtcggttaccggtaccgttacccgggttacggtttaccggaaccggtaaaccgggtaacgtaaccggggtataaaaacccggtataaacgggacgtttcggaccggtacctactacgaacccttgttcccgttagttccctttaacgcccgttttacccgtcccgtaccgtttntccgg

SEQ ID NO: 161872 - DNA, 535 bp, Homo sapiens
  misc_feature: GYAE6OF02I1I4N.48.25.C03.1.454.CMB.1.raw
  modified_base (529)..(529): a, c, t, g, unknown or other
  misc_feature (529)..(529): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagccctcccaggctccctcactttatgatacatccaccagggccacgtggtcgtcccagccaggttcacgtggcggtgggtctgggacagtagttcactctcacatcagcagcctgctagtctagaagtattttacattttattactgtacagctagtatcgtaagtcggacttcgtacgtttgaccaagggaccaagggtggagtacgaaacgacgtggtagtactgacacgatctgtcttcgattccttccgctacgtctagattatacgtattacnttacgg

SEQ ID NO: 161873 - DNA, 627 bp, Homo sapiens
  misc_feature: GYAE6OF02HOUI5.48.25.C03.1.454.CMB.1.raw
  modified_base (181)..(181): a, c, t, g, unknown or other
  misc_feature (181)..(181): n is a, c, g, or t
  modified_base (209)..(209): a, c, t, g, unknown or other
  misc_feature (209)..(209): n is a, c, g, or t
  modified_base (275)..(275): a, c, t, g, unknown or other
  misc_feature (275)..(275): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagngtcaccctctcctgcagggccagtgagngtcttgacagctccttagcctggtaccaaacaaggcctggccagcctcccaggcctcctcatttangatacatccaccgaggccacgtggtcgcccagccgaggttcacgtggcggtggtctgggacagtagttcactctcaccatcgagtcagcctgcagtctaggaatacttttacatttttactacttgtacagtactagttagtacggttaagtcggtaaccgttcccggtaggtttcggaccgaaagggtaccgtaagggttacggaaacgttaaccgaaaacggtacgttaggtacgggtactcgggaccaaccgtagttccgttggtttaccctttacgacgtttcccttaccccggaccttagttccgttagtacttaagtttcggttaaactttaccggtccttagggg

SEQ ID NO: 161874 - DNA, 668 bp, Homo sapiens
  misc_feature: GYAE6OF02GBYP4.48.25.C03.1.454.CMB.1.raw
  modified_base (180)..(180): a, c, t, g, unknown or other
  misc_feature (180)..(180): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaaccaacaaaggcctggccagccctccgaggcctcctnatttangatacatccaccagggccactgggtcgtcccagcctaggttcacgtgggcgggttgggtctggggaccaggacgttcacttcgtacaccattcaacgcacgccttaggcctagttcacggtaaagtactttttaactatttttattactgttacagtactagttactacggttaagtggtaaccttccggtaggttttacgggacccgtaaacggggacccgtaaaggggttcggtaaaacgttaccgaaaaccggtaaacgttgggtacgggttacctggaaccctaaccgtaatttccgtacttaccgtttactaacgtttcccgttaacccccggtcttaacgttccgttacgtaatttaacgttcgttaaactttcctaggtacggg

SEQ ID NO: 161875 - DNA, 632 bp, Homo sapiens
  misc_feature: GYAE6OF02F1E8O.48.25.C03.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (258)..(258): a, c, t, g, unknown or other
  misc_feature (258)..(258): n is a, c, g, or t
  modified_base (293)..(293): a, c, t, g, unknown or other
  misc_feature (293)..(293): n is a, c, g, or t
  modified_base (392)..(392): a, c, t, g, unknown or other
  misc_feature (392)..(392): n is a, c, g, or t
  modified_base (399)..(399): a, c, t, g, unknown or other
  misc_feature (399)..(399): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaangtcaccctctcctgcagggccagtgagagtctgacngctcttagcctggtaccaanaaggcctggccagcctcccaggcctcctcatttangatacattcccaccaggggccctacgtgggtcgtccccagtccctagggtttcacgttggggccggttgggtctggggaacaggtagtttccacttccnccaaccntccagccagccctgctagtcgtagaagttattttaactattttactacttagtacgtatactagttatacggttaagtcggtacttccggtaacggtttcggaccgtaaggggtaccgtaagggtacggtaaacgtaaccgtaaacggtaacgttgggtacggaccggttcgaccgtaccctagttccgttcgttaccttacgtaccgttccgtttccccgacctacttaccg

SEQ ID NO: 161876 - DNA, 627 bp, Homo sapiens
  misc_feature: GYAE6OF02F281I.48.25.C03.1.454.CMB.1.raw
  modified_base (180)..(180): a, c, t, g, unknown or other
  misc_feature (180)..(180): n is a, c, g, or t
  modified_base (276)..(276): a, c, t, g, unknown or other
  misc_feature (276)..(276): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaaccaacgaaggcctggccagccctccaggcctcctcatttangatacatccacaggccatggtctcccagccaggttcacgtggcggtgggtctgggacagtagttcactctcaccatcagcacgctgcagtctagtaagtattttactattttatactgtactagctagtatacgtaagtcggtaccttccggtacggtttcggaccgtaaaggggtacccgtaaagggtacggtaaacgtaaccgtaaaaccggtaacgttaggtacgggtactacgaccgtaacctacgttccgttacggttcctttaccgtacctttaccccgttaccccgtacccttaacgttccgtaggttaactttaacgttacgttaacttaccgttgtaacggg

SEQ ID NO: 161877 - DNA, 628 bp, Homo sapiens
  misc_feature: GYAE6OF02JRGDU.48.25.C03.1.454.CMB.1.raw
  modified_base (181)..(181): a, c, t, g, unknown or other
  misc_feature (181)..(181): n is a, c, g, or t
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (343)..(343): a, c, t, g, unknown or other
  misc_feature (343)..(343): n is a, c, g, or t
  modified_base (565)..(565): a, c, t, g, unknown or other
  misc_feature (565)..(565): n is a, c, g, or t
tcagagtatacatacacgaccggtgctcgatttagtagtgtagatttgggtttgggggagacggaaccatggaagccccagcgcagcttctcttcctcctgctactctggctcccagattccactggacaaatagtgatgacgcagtccccagccaccctgtctgtgtctccgaggggaancgtcacctctctgcagggcagtgagngtctgacagctccttagcctggtaaccaanaaggcctggccagccctccgaggtctccctnactttancgattacactccgaccgagggcctactcgggtctccccgagccaggttccacgtcgggcggtggtcgngggacaggtacgtccactctcaacgctcgagtcgacgtcctgacctaggtctagaacgttactttactacgttttatactgtcagtctattagtacgttaagtcggtacttcgtacggtttcggaccgtaaacgggtacgtaagggtacggtaaacgttaccggaaacggtaacgttggtacgggaccgttagacccgtacgtacgtacttgttacccgttntaacccgttccttacccgcttaacgtcgttacgtcttacggttatttaccggtacttgtacgg

SEQ ID NO: 161878 - DNA, 286 bp, Homo sapiens
  misc_feature: GYAE6OF02I86PQ.48.25.C03.1.454.CMB.1.raw
  modified_base (226)..(228): a, c, t, g, unknown or other
  misc_feature (226)..(228): n is a, c, g, or t
  modified_base (230)..(286): a, c, t, g, unknown or other
  misc_feature (230)..(286): n is a, c, g, or t
tcagagtatacatacacgaccggtgctcgatttagtagtgtagatttgggtttggggggagtcagggacctcctcagttcaccttctcacaatgaggctccctgctcagctccgtggggcctgctaatgctctgggtcccaggactgtggctgcaccatctgtctcatctcccgcatctgatatgtatacctctgaggcgggctggcgaaggccgctattaggcannngnnnnnnnnnnnnnnnnnnnnnnnnnnnnnnnnnnnnnnnnnnnnnnnnnnnnnnnnn

SEQ ID NO: 161879 - DNA, 575 bp, Homo sapiens
  misc_feature: GYAE6OF02HCWWI.48.25.C03.1.454.CMB.1.raw
  modified_base (275)..(275): a, c, t, g, unknown or other
  misc_feature (275)..(275): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaaccaacaaggcctggccagccctccaggcctcctcatttangatacatcccaccgagggcccacgtggtcgtcccagcctaggttccacgtgggcggtgggtctgggacagngttcactcncacatcagcagctgcagtctagaatattttacattttatactgtcagtctagtatcgtaagtcgacttcggtagtttcggaccgaagggacctaagggtcggaaacgtaccgaaacggtacgtggtacggctacggaccaacgtgttcgtgttccttacgaccttcccgttcccgactacgttccgtagtaacttacttagttaactaccgttcgtcggg

SEQ ID NO: 161880 - DNA, 598 bp, Homo sapiens
  misc_feature: GYAE6OF02FH9XE.48.25.C03.1.454.CMB.1.raw
  modified_base (274)..(274): a, c, t, g, unknown or other
  misc_feature (274)..(274): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctccaggcctcctcatttancgatacatccacagggccacgttggtcgtcccagccaggttccacgtggcggtggtctgggacagtagttcactctcacatcagcagcctgctagtctagaagtattttactattttatacttgtactagctagttactacgtaagtggtacttccgtacggtttggaccgtaaaggggtacctaagggtacggaacgtacgaaacgtacgttaggtcggtacctcggactaccgtattaccgtcgttaccttacgtaacttcccgttaccccggtcctacgttccgtagtaacttagtttacggtaacttacgtaccgtacgg

SEQ ID NO: 161881 - DNA, 510 bp, Homo sapiens
  misc_feature: GYAE6OF02G80KV.48.25.C03.1.454.CMB.1.raw
  modified_base (299)..(299): a, c, t, g, unknown or other
  misc_feature (299)..(299): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtcccccagccaccctgtctgtgtctccagggggaaagagtcaccctctcctgcagggccagtgagagtcttgacagctccttagcctggtaccaacaaaggcctggccagcctcccaggctcctcatttangatacatccaccagggccactggtctcccagccaggttcacgtgggcggtggtctggggacagagttcactctcacatcagcagcctgcagtctagaagtatttactattttatactgtcagtcagtatcgtaagtgactcgtacgtttgccaagggaccaaggtgaagtcaacgactgtgctgcacatctgtctcactctcccgctatcg

SEQ ID NO: 161882 - DNA, 617 bp, Homo sapiens
  misc_feature: GYAE6OF02IDUWU.48.25.C03.1.454.CMB.1.raw
  modified_base (203)..(203): a, c, t, g, unknown or other
  misc_feature (203)..(203): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtcctcgaggggaangtccacctctcctgcagggccagtgagagtcttagacagtctccttagcctggtaaccaacgaaacggcctggccacgcctcccgaggctcctctatttatgatacactcccacgcggccacgtcggtcgtcccgagcccgtaggttcacgtcgggtcggtcgggtcgtgggacaggtacgttcacgtctccaccatcgagcacgtcctgctacgtctacgtaagttcttttaactatttacttacgtgttactacgtcttagttacttacggtaagtcggacgttaccgttacggttggacccgaaagggtaccgtaaggtacgggtaaagtaccgaaagtacgttgtacggtacgtacgacctacgtacttacgtgttacctactccgttacccgtcccgtactacgttacg

SEQ ID NO: 161883 - DNA, 588 bp, Homo sapiens
  misc_feature: GYAE6OF02HOEF2.48.25.C03.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggaacaaatagtgatgacgcagtccccagccaccctgtctgtgtctccaggggaaangtcaccctctcctgcagggccagtgagngtcttgacagctcctagcctggtaaccaacaaaggctggccagcctccaggctcctnatttangatacnctccaccgaggccactggtctcccagccaggttcagtggcgtggtctgggacaggtagttcactctacacctatccagcagcctgctagtctagtaagttattttacattttgtaacttgtacactacgaagttactacgtaaggtcgtacgttccggtagtttggacccgtaagggaacctagggtacggaaataccgtaaagaccttggtaccggacttacggactaacccgtaagttccgtagttaccttctaccgttacccgttccccggacttacgtacccg

SEQ ID NO: 161884 - DNA, 690 bp, Homo sapiens
  misc_feature: GYAE6OF02IK9XB.48.25.C03.1.454.CMB.1.raw
  modified_base (203)..(203): a, c, t, g, unknown or other
  misc_feature (203)..(203): n is a, c, g, or t
  modified_base (338)..(338): a, c, t, g, unknown or other
  misc_feature (338)..(338): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaanagtccaccctctcctgcagggccagtgagagtcttgacagtcctccttagcctaggtaaccaaacgaaaggcctggaccagccctcccaggcctcctctatttatgatacactccaccgagggcctacgtggtcnccacgcctaggttcacgtggccggtggtctggggacaggtacgtttcactctacaacctatcagccacgtcctgctagtctagtaattattttactattttaacttacgtcgttacgagtacgtaaggttacttacggttaaaggcggtaaccgtttacccggttaacggttttaccgggaacccggtaaacggggtaacccgtaaaggggttacgggtaaaacgttaacccgtaaaaaccgggtcgttacggggttacggtaccggttaacggtaccccgtaacctaaccgttcgttaaccgtttaccctttaccgttaccttccccggtttcccccgtacctacgttacc

SEQ ID NO: 161885 - DNA, 524 bp, Homo sapiens
  misc_feature: GYAE6OF02GM1KL.48.25.C03.1.454.CMB.1.raw
  modified_base (274)..(274): a, c, t, g, unknown or other
  misc_feature (274)..(274): n is a, c, g, or t
  modified_base (508)..(508): a, c, t, g, unknown or other
  misc_feature (508)..(508): n is a, c, g, or t
  modified_base (521)..(521): a, c, t, g, unknown or other
  misc_feature (521)..(521): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttangatacatccaccagggccacgtggtcgtccccagcccaggttccacgtggcggtgggtctgggacaggagttcactctcaccatcagcagcctgcagtctgaatattttactattttattactgtctagctagtatcgtaagtggacttccgtacgtttggaccgtaagggaccaagggtgaagtacgaaacgactgtggctgcacatctgtcttcattcctcccgcctatctnatctgtactactntag

SEQ ID NO: 161886 - DNA, 609 bp, Homo sapiens
  misc_feature: GYAE6OF02GPZ3A.48.25.C03.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaagngtcaccctntcctgcagggccagtgagagtcttgacagctccttagcctggtaccaacaaggcctggccagcctccagctcctcatttatgatacactccaccagggccactggtcgtcccagccaggttcacgtggcggtggtcgtgggacaggtacgttcgactctcaccatcacgcacgcctgcagtctagtaagtattttacgtaattttacttactcgtctagtactagttactacggttaagtacggtaccttccggttacggtttccgggaccgtaaacggggtaccgtaacgggttagggaaacgtaacgtaaacgacgttggtacggcgtacggacctaccgtacgttccgtacgttccgttacgtaccgtttccccgttcccggtacctagttccg

SEQ ID NO: 161887 - DNA, 522 bp, Homo sapiens
  misc_feature: GYAE6OF02GLR6Z.48.25.C03.1.454.CMB.1.raw
  modified_base (180)..(180): a, c, t, g, unknown or other
  misc_feature (180)..(180): n is a, c, g, or t
  modified_base (272)..(272): a, c, t, g, unknown or other
  misc_feature (272)..(272): n is a, c, g, or t
  modified_base (510)..(510): a, c, t, g, unknown or other
  misc_feature (510)..(510): n is a, c, g, or t
  modified_base (517)..(517): a, c, t, g, unknown or other
  misc_feature (517)..(517): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctggtaccaacaaggcctggccagcctccaggctcctcatttangatacatccaccagggccactggtcgtcccagccaggttcactggcggtgggtctgggacagagttcactctcacatcagcagcctgcagtctagaagattttactattttattactgtcagctagtatcgtaagtggacttccgtacgtttggccaagggaccaagggtaggaagtacgaaacgaacttgaggtctgcacatctgtcttcgattccttccgcctatcctgtactatntatactntacgg

SEQ ID NO: 161888 - DNA, 584 bp, Homo sapiens
  misc_feature: GYAE6OF02JB4P0.48.25.C03.1.454.CMB.1.raw
  modified_base (339)..(339): a, c, t, g, unknown or other
  misc_feature (339)..(339): n is a, c, g, or t
  modified_base (354)..(354): a, c, t, g, unknown or other
  misc_feature (354)..(354): n is a, c, g, or t
  modified_base (403)..(403): a, c, t, g, unknown or other
  misc_feature (403)..(403): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctcttagcctggtaccaacaaggcctggccagcctcccaggctcctcatttatgatacatcccaccagggccacgtgggtctcccagccaggttcactgggcggttgggtctgggacagngttcactctcacctntcacgcacgcctgccagtctagaatacttttacattttatactgtcagntagtatacgtaagtggtactccgtacggtttgaccgtaaggggacctaagggtcgtaacgtacgtaaacggtacgtaggtcgactggaccctaactagttctcgttcttaccgtacgtttcccttaccccggtctaactttcgtacgtacttacgttagtaaccttacgttcgttaacggg

SEQ ID NO: 161889 - DNA, 704 bp, Homo sapiens
  misc_feature: GYAE6OF02J0FJV.48.25.C03.1.454.CMB.1.raw
  modified_base (203)..(203): a, c, t, g, unknown or other
  misc_feature (203)..(203): n is a, c, g, or t
  modified_base (680)..(680): a, c, t, g, unknown or other
  misc_feature (680)..(680): n is a, c, g, or t
  modified_base (683)..(683): a, c, t, g, unknown or other
  misc_feature (683)..(683): n is a, c, g, or t
tcagagtatacatacacgaccggtgctcgatttagtagtgtagatttgggtttgggtgaggaactgctcagttaggacccagacggaaccatggaagccccagcgcagcttctcttcctcctgctactctgctccagattccactggacaaatagtgatgacgcagtccccagccaccctgtctgtgtctccgaggggaaacngtccgacccttcgtcctggcacggggccaggttggacgtagtccttggaccagtccctccttaagcccttagggtaaccaaagaacggcctgggcccaacggtccctccccgtaggtcctcccttacgtacttttagcgaacttaccgtaaccgtccaaccggcggggtaccctaccggttggtacccgtaccccgaagtccccgtacgggtttaccaaccggttcggggtccgggttcggggtccgtacgggggaacctaagggtacgtttccgaaccgtttccgtacaaccggtaccttcgaaaccgggtcctaggacccttgaccgttagtccgtaaggtaacgttattttaaccttaagttttactacgtcgttactgacgttaatctacggtagtacggtcgttaccggtacgttcggaccgtaacggtcgaacggtcggaagtacgtaacaggtgtacggctggactacgntcncgttcaccttcgtcctccatc

SEQ ID NO: 161890 - DNA, 630 bp, Homo sapiens
  misc_feature: GYAE6OF02GTEWR.48.25.C03.1.454.CMB.1.raw
  modified_base (181)..(181): a, c, t, g, unknown or other
  misc_feature (181)..(181): n is a, c, g, or t
  modified_base (276)..(276): a, c, t, g, unknown or other
  misc_feature (276)..(276): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaangtcaccctctcctgcagggccagtgagagtcttgacagctccttagcctggtaaccaacaaggcctggccagcctcccgaggcctcctcatttangatacatccacgagggccacgtggtcgtcccagccgaggttcacgtgggcggtgggtctgggacaggtacgttcactctcaccatcaagcacgcctgctagtctagaattattttactattttacttactgtacagtactagtacgtacgtaagtcggtaccttaccggtacggtttcgggaaccgtaacggggtaaccgtaaggggtacggtaaacggtaaccgtaaacggtacgttggtacggtacgtacgaccgtaaccgtagttccgttacgttacctttacgtacgttacccgttcccgtaccttacgttccgtagtacgttacgttacgttaacgttaccgtgtacgg

SEQ ID NO: 161891 - DNA, 220 bp, Homo sapiens
  misc_feature: GYAE6OF02JHSFA.48.25.C03.1.454.CMB.1.raw
  modified_base (203)..(203): a, c, t, g, unknown or other
  misc_feature (203)..(203): n is a, c, g, or t
  modified_base (209)..(220): a, c, t, g, unknown or other
  misc_feature (209)..(220): n is a, c, g, or t
tcagagtatacatacacgaccggtgctcgatttagtagtgtagatttgggtttggggagtcgaggactcctcagttcaccttctcacatgaggctccctgctcagctcctgggctgctaatgctctgggtccaggactgtggctgcacatctgtcttcattcttccgccatctgatatgtatactctgagcggctggcaggcncatagnnnnnnnnnnnn

SEQ ID NO: 161892 - DNA, 547 bp, Homo sapiens
  misc_feature: GYAE6OF02GGWC7.48.25.C03.1.454.CMB.1.raw
  modified_base (206)..(206): a, c, t, g, unknown or other
  misc_feature (206)..(206): n is a, c, g, or t
  modified_base (299)..(299): a, c, t, g, unknown or other
  misc_feature (299)..(299): n is a, c, g, or t
  modified_base (436)..(436): a, c, t, g, unknown or other
  misc_feature (436)..(436): n is a, c, g, or t
  modified_base (512)..(512): a, c, t, g, unknown or other
  misc_feature (512)..(512): n is a, c, g, or t
  modified_base (518)..(518): a, c, t, g, unknown or other
  misc_feature (518)..(518): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccaccctgtctgtgtctccgaaggggaaangtcaccctctcctgcagggccagtgagagtcttgacagctccttagcctggtaccaacaaaggcctggccagcctccaggctcctctatttangatacatccacgaggccatggtctcccagcctaggttcacgtggcggttggctggggacagagttcactctcacctatcagcagcctgactagtctagtaaacgtattttacgattttactacgtgtacagctagtntacggtagtggactccgtagttcgaccgtaagggctaaggtggaactacgaaacgcgtagtggactggacctacgnttcgtntccttcgtacttcccgtaccctctactcg

SEQ ID NO: 161893 - DNA, 740 bp, Homo sapiens
  misc_feature: GYAE6OF02IWDE2.48.25.C03.1.454.CMB.1.raw
  modified_base (157)..(157): a, c, t, g, unknown or other
  misc_feature (157)..(157): n is a, c, g, or t
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
  modified_base (367)..(367): a, c, t, g, unknown or other
  misc_feature (367)..(367): n is a, c, g, or t
  modified_base (451)..(451): a, c, t, g, unknown or other
  misc_feature (451)..(451): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaatgtnatgacgcagtccccagccaccctgtctgtcgtctaccgaggggaaangtccaccctctcctcgcgacggccagtgagtacgtctaggacngtcctccttagcctaggtaccaaacgtaacggcctcggccacgccctcccaggtcctaccgtacgtatttacgtcgaattaccacttcccgaacgtacgggccctagtcggtccgacccncgtcccgaggtttcccagtcgggtcggtcggtcgacgggtaccagttagttccacttctccgaactatcgacgtccgacgttcncgacgttacgtgtaacgggtaaacttttacgtttaactttacgttttaacgtacgtcggtttaaacctcggtaacgtttacggtacgttaacggtaaacgtcgggttaacccgtttacgggttaaccggttttacccgggaaacccggttaaaggggtttaaccgaaaacggggtttcgaaacggttaaacccgtaaaggtccgtttagggaccggttcgtacggtaacctaacgttcgttacgttacgttaacctttcgaaccgtttccctaccggtatccgtttacg

SEQ ID NO: 161894 - DNA, 647 bp, Homo sapiens
  misc_feature: GYAE6OF02GSNCV.48.25.C03.1.454.CMB.1.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaangtcaccctctcctgcagggccagtgagagtcttgacagcttcctagcctaggtaccaacaaaggcctggccagcctccaggctcctcatttangatacgatccaaccagggccacgtggtcgtcccagaccagggttccaacgtcgggcggttggtcgtggggaccagtacggtttcactctaccacatcagcagcctgcagttcagtaaagtattttacgaatttttaatacgtgtacacgtctaagttattacgtaaaggtcggtacctaccgggttaacgttttcgggaaccctaaaggggaacccgtaaaggggttacggaaacgttaaccgaaaaccggtaacgtttcggacgggtaccgtcgaacccgtaaccgttagttcctttacggttactttaccggtaacttccccgtttaccccgtacttacgttaaccgg

SEQ ID NO: 161895 - DNA, 721 bp, Homo sapiens
  misc_feature: GYAE6OF02HG04I.48.25.C03.1.454.CMB.1.raw
  modified_base (203)..(203): a, c, t, g, unknown or other
  misc_feature (203)..(203): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaangtccaccctctcctgcagggccagtgagagtcttgacagcctaccttagcctaggtaaccaacgaacggcctggccacgccctccgaggtcctcctctatttactgtactacactcccaccgacgggtccctacggttcggtaccgtccccacgtccgtacggtttccacggttcggggtaccggggttcgggttccgtacgggggactacggtacggtttcccaaccgttcctaccgaaccgtactaccggacgtaccgaccgtccgtacgacgtacggtaccgttaaggtaaagttttacttttacgttaatttttactacgttgttacagtacttaagttacgttacggtaaggtcggtaccgttccggttacggtttcggaaccgtaacgggtaaccgtaagggttacggaaacgtaaccgtaaacgtacgttgggtacgtaccgtaacgacctaaccgttacttccggttattaccttccgtaccgtttccccgttacccgacttacgttacg

SEQ ID NO: 161896 - DNA, 604 bp, Homo sapiens
  misc_feature: GYAE6OF02GGMMR.48.25.C03.1.454.CMB.1.raw
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
  modified_base (297)..(297): a, c, t, g, unknown or other
  misc_feature (297)..(297): n is a, c, g, or t
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccaccctgtctgtgtctccgaggggaaangtcaccctctcctgcagggccagtgagagtcttgacngctccttagcctggaccaacaaggcctggccagcctccgaggcctcctcatttangactacatccaccgaggccacgtggtcgtcccagcctaggttccacgtggcggttggtcgtgggaacngtacgttcacttcncacatcgagacgagccctgactagtcagtaagtattttactattttatactgtacagtctaagttatcgtaagtcggacttaccggtaggtttcggaaccgaacgggtaccgtaaagggtacggaaacggttacaaaccggtagtgggtacggaccgttcggaacctaaccggtacttcgttcggttaccttcgtaccgttccccttacccggtacctattaccg

SEQ ID NO: 161897 - DNA, 627 bp, Homo sapiens
  misc_feature: GYAE6OF02I4GWG.48.25.C03.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaanagtcaccctctcctgcagggccagtgagagtcttgacagctcctagcctggtaccaacgaaggcctggaccagccctccgaggcctcctacatttangactacactccctaaccgagggccctacgtggtaccgtcccaagcctacggttcacggtggtccgggtggtctaggggacagagttcactctacacctatcgagcagccgtgctagtctagaagttactttagtatttatacgtgtcacgtctaagtatacgtaaggtcgtacgttaccggtacgtttacggaccgtaagggaccgtaaggggtacggtaaacgtaccgtaaaccggtacgttggtacgtacgttcggacctaacgtaacgttacgtcggtttaccgtacgtaccgtttcccgtaccccgtacgttaccttaaccg

SEQ ID NO: 161898 - DNA, 673 bp, Homo sapiens
  misc_feature: GYAE6OF02GFSQC.48.25.C03.1.454.CMB.1.raw
  modified_base (204)..(204): a, c, t, g, unknown or other
  misc_feature (204)..(204): n is a, c, g, or t
  modified_base (240)..(240): a, c, t, g, unknown or other
  misc_feature (240)..(240): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagacttccactggacaaatgtgatgacgcagtccccagcccacctgtctgtgtctccgaaggggaangtcaccctctcctgcagggccagtgagagtctgacngctcgttagctgtaaccaacgaaggcctaggcctagcctccgaggcctcctcatttacgtgaataccacgtcccgacgtacggccacgttcggtccgtccccagtcccgtaaggttcccaggttcgggcggttcggtcgtcgggacgtaacggtacgttcaaccgtttctcgaaaccgacttcgacgtccaacgtccctacgctacgttcgtaggtaaacgttacttttaaacgtacgtttttaataaccgttgtaacgtacgaacgttagttacgttacgtaaggttacggaccttaccgggtacggtttaccggaaccgaaaggggtaccaaaggggttacggaaactaaccggaaacgtacgtagtacggtacgttcgaacctacctaagtccttagtccttactacgtcccgttaccgtcctaagttcg

SEQ ID NO: 161899 - DNA, 826 bp, Homo sapiens
  misc_feature: GYAE6OF02J3BFR.48.25.C03.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtcccagccacctgtctgtgtctaccgaggggaancgtcacccttctcctgcgacgggccagtgagagttcttgacncgcttccttagccgttacggtaccaaagtaacggcctcggaccaggccccttaccccgaggtcccttacctctaacttttactacgactacctaacgtccccaacggacgggtccctaacttcgggttcccgacccgtaaggccccgttaacggtttccgaacggttcggggtccgggggttcgggtcggtacgggggtaaccgtacggttaccggtttacccgacctttacccgttaccgaacccctaagttaacccggcggtttaacccgacggttacccgtcgggtaccctacgggttttacccgaaaggtttaaacggtttaacttttttaacgtttaacttttaacgggttactaccgtttacgagttaaccggttaagttaccggttaacgttaacggggtttccgtaaacccgtttaccgggttacggtttaccggaaccgtaaaggggtaaccgttaaggggtacgttaaacgaaaccgtaaccgaagtttcggagttcgaaaccggtccaaccttataccggttttaacctccgtttcgtaaccggtttcccggttaaccaccgtactttagg

SEQ ID NO: 161900 - DNA, 569 bp, Homo sapiens
  misc_feature: GYAE6OF02FTDRM.48.25.C03.1.454.CMB.1.raw
  modified_base (209)..(209): a, c, t, g, unknown or other
  misc_feature (209)..(209): n is a, c, g, or t
  modified_base (309)..(309): a, c, t, g, unknown or other
  misc_feature (309)..(309): n is a, c, g, or t
  modified_base (392)..(392): a, c, t, g, unknown or other
  misc_feature (392)..(392): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccaccctgtctgtgtcctccgaagggggaaagngtcaccctctcctgcagggccagtgagagtcttgacagtctccttagcctggtaaccaacaaaggccctggcccagccctcccgaggcctcctcatttanacgatacactccaccgaggccacgtggtctcccagcctaggttcacgtgggcggtggtctggggacagtagtcactctcaccntcagcagcctgctagtcagatatttactatttatactgttcagctagtatacgtagtcgtactccgtagttcggaccgaaggacctaagggtacgaaagtaccaaacgtagtgggtacggctacggacaacccgtagttcttcggttacttcacgtttcccgtaccgtactgttacc

SEQ ID NO: 161901 - DNA, 663 bp, Homo sapiens
  misc_feature: GYAE6OF02HM7QB.48.25.C03.1.454.CMB.1.raw
  modified_base (206)..(206): a, c, t, g, unknown or other
  misc_feature (206)..(206): n is a, c, g, or t
  modified_base (306)..(306): a, c, t, g, unknown or other
  misc_feature (306)..(306): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccaccctgtctgtgtctccgaggggaaagngtccaccctctcctgcagggccagtgagagttcttgacagctccttagcctggtaccaacaaaggcctaggccagccctcccgaggcctcctctatttangtaactacactcccaccgtaacgggccctacgtggtcgtacccaagccgtaaggttcctacgtgggtaccgggtgggttccgtaggggacctaggtaacggtttcccacgtcctcaacctagtccagcacgtcctgctgtctagaagttatttactattttatactgtcagtcagttagtacgttaagtcgtaccgttaccggtacggtttcggaccgtaagggtaacctaagggtaacggtaaacgtaacgtaaaaccgtacgtacggtacggtaccgtggtaccctaaccgtacttaccgttacgttacctttaccgtactttaccccgtttcccggtacccgtcgtttaaccgg

SEQ ID NO: 161902 - DNA, 872 bp, Homo sapiens
  misc_feature: GYAE6OF02J21SD.48.25.C03.1.454.CMB.1.raw
  modified_base (178)..(178): a, c, t, g, unknown or other
  misc_feature (178)..(178): n is a, c, g, or t
tcagagtatacatacacgaccggtgctcgatttagtagtgtagatttgggtttgggagacggaaccatggaagcccagcgcagcttctcttcctcctgctactctggctcccagattccactggacaaatagtgatgacgcagtcccagccacctgtctgtcgtctccgaagggaaangtccaccctctcctgcacgggcctaggtgaggagttcttagacacgtcctaccttacgccgttacggtaaccaaacgtaaacgggtccctagggacccctacggtccccttacccgaacggttccctacccgtactaagtttttacacgtaaccttaccgacctccccgaaccggacgggtaccctacggtcggttaccacccggtacgtaccggtaacggtttcaccgggttgggtccgggttagggtaccgtacggggacctaaacggttccggtttcctaacggttcccacccttaacctaacggttaccgacgggaccctaacgggtcccctttaggaccgttacgtttacgtaaacgggtaaacgtttttactttttaaaccttaagttttttaaccgttaccgtacggttacctaacggtaaccgttaacgttaacgttacgggttaacggtacggtaacccgttaccggtttaaccgggttacggtaaccccggtaaagggtaaaccggttaacgggtaaacgggtaaccgtaaaccgtaaacggttaaccgttacggttaacggtcccgttaacgaccctaaccgtttaagtcccgtttagtacccgtttacggtaaccctttccgtacccgtaccgttacttcggtacttacgtacgtttaacgtacgttaccgtgttaaccggg

SEQ ID NO: 161903 - DNA, 655 bp, Homo sapiens
  misc_feature: GYAE6OF02HG70U.48.25.C03.1.454.CMB.1.raw
  modified_base (181)..(181): a, c, t, g, unknown or other
  misc_feature (181)..(181): n is a, c, g, or t
  modified_base (191)..(191): a, c, t, g, unknown or other
  misc_feature (191)..(191): n is a, c, g, or t
  modified_base (282)..(282): a, c, t, g, unknown or other
  misc_feature (282)..(282): n is a, c, g, or t
  modified_base (647)..(647): a, c, t, g, unknown or other
  misc_feature (647)..(647): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaangtccaccctntcctgcagggccaggtgagagtcttgacagctccttagcctaggtaaccaaacgaaggcctggaccagcctcccaggcctcctacatttancgaattacactccaacgacgggccacgtggtccgtacccagccgaggttcacgtgggcggtggtctagggacagtagttcactcgtacacatcagcagtccgtggactagttcgtaagtaagtttacttttaacgtaattttttaagtaccgttagtactacgtacgtaaggttaatacggttaaaggtcggtaaccgttccgggtaacgtttacgggaaccggaaacgggtaaccaaggggttaacgaagggtaaccaaaaggtacttggtacgctcggaaccaacttacgtcgttcgttacttacgtacttacccttcccgaaccttataccgttagaaccgtttagtaacgtaactttacgngtaacggg

SEQ ID NO: 161904 - DNA, 710 bp, Homo sapiens
  misc_feature: GYAE6OF02JVYVQ.48.25.C03.1.454.CMB.1.raw
  modified_base (182)..(182): a, c, t, g, unknown or other
  misc_feature (182)..(182): n is a, c, g, or t
  modified_base (274)..(274): a, c, t, g, unknown or other
  misc_feature (274)..(274): n is a, c, g, or t
  modified_base (502)..(502): a, c, t, g, unknown or other
  misc_feature (502)..(502): n is a, c, g, or t
tcagagtatacatacacgaccggtgctcgatttagtagtgtagatttgggtttggggtaggacggaaccatggaagcccagcgcagcttctcttcctcctgctactctggctcccagattccactggacaaatagtgatgacgcagtccccagccaccctgtctgtgtctccgaggggaaanagtcaccctctcctgcagggccagtgagagtcttgacacgctccttagccctgggtaaccaacgaaacggccgtacggccacgccctaccgnggccttacctactatttatcgaacttacactccctaccggacgggccctacgtcgggttacctacccgacgtccgtaacggttccgacgggttggggtccgggttcgggtcgtacgggaactaggtcgttccgtactccgtacaccgtattaccgaggtccaacggtcctcgtaactcgtacgtacggtaactttactttttaacttacttttaataccgttacgtanacgtactagttacgttggtaaacgttggtacccgttacggttacggttacggaccggtaagggtaaacggtaggtacggtaaagtaacggtaaccggtacggtgggtacgtaccgatacccggtactacttccggtacgttctaccggtcgttaccccgtcggaaccttggaccttaagtcttacgttcgttaactccggtgtacggg

SEQ ID NO: 161905 - DNA, 691 bp, Homo sapiens
  misc_feature: GYAE6OF02JWITM.48.25.C03.1.454.CMB.1.raw
  modified_base (300)..(300): a, c, t, g, unknown or other
  misc_feature (300)..(300): n is a, c, g, or t
  modified_base (442)..(442): a, c, t, g, unknown or other
  misc_feature (442)..(442): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaagagtccaccctctcctgcgagggccagtgagatcgttgacagccttccgttacgcctggtaacccaacgaaacgggccctcggaccctagccctacccgacggtcctcctactattttangaactacactcccaccggtaacggccctacgtcgggtctacccagccctaaggttccgaccgttgggcgggttacggggtctacggggaactcggtaactttccaaccgttccgtctaacccagtccgaacgtcgaccgtcnggtaccctagtaccgttagtaaacgtttaattttaccgtacttttaacttaccgtgtactaacgtgtaacgttatacggttaagtcggcttacgtacgttacggccgtaacgggactagggtagtaacgacggtaactacgtgtcggtactcggaactaccgtagtccgtacgtcgttacgtacctttcgtacccctacgttaccgttcgtacgtacgtaaacgtttgtaaccgtttcctgggtaacgg

SEQ ID NO: 161906 - DNA, 546 bp, Homo sapiens
  misc_feature: GYAE6OF02FIWMY.48.25.C03.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
  modified_base (289)..(289): a, c, t, g, unknown or other
  misc_feature (289)..(289): n is a, c, g, or t
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaanagtcaccctntcctgcagggccagtgagagtcttgacngctccttagcctggtaccaacaagcctggccagcctcccaggctcctnatttatgactacatccaccgaggccacgtggtcgtcccagccaggttccacgtgggcggtcggtctggggacaggtgttcnctctcaccatcagcagcctgcngtcngtaagtntttactatttatactgtcagtctagtatcgtaagtcgtactcgtagttgaccgaagggacctagggtcgaagtaccaaacgacgttgacggcgtagccactcttacgtgttaccttacgacgttcctttacccgactacttcg

SEQ ID NO: 161907 - DNA, 632 bp, Homo sapiens
  misc_feature: GYAE6OF02G9VTF.48.25.C03.1.454.CMB.1.raw
  modified_base (206)..(206): a, c, t, g, unknown or other
  misc_feature (206)..(206): n is a, c, g, or t
  modified_base (315)..(315): a, c, t, g, unknown or other
  misc_feature (315)..(315): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccaccctgtctgtgtctccgaggggaaagngtccaccctctcctgcgagggccagtgagtagtcttgacagtccttccgttagcctggtaaccaacgaaacggcctggccacgccctcccgaggcctcctctatttacngtactacactccaccgacgggccacgtcggtcgtacccgagccgtacggttcacgtgggcggtggtcgtgggacagtagttcactcgtcaccntcngctgccgtgcagtccgtagtaaagttacttttactaattttacttacgtgtctagtactagttacgtaacggtacgtcggaccttaccggttacgtttacggaaccggtaagggtaaccgtaagggttacgggaaacgtaacgaaacgtacgttcggtggtccgtacgacctacgtacttcgttacgttccttacgtacctccgtttccccgactcttacg

SEQ ID NO: 161908 - DNA, 897 bp, Homo sapiens
  misc_feature: GYAE6OF02HQRW9.48.25.C03.1.454.CMB.1.raw
  modified_base (183)..(183): a, c, t, g, unknown or other
  misc_feature (183)..(183): n is a, c, g, or t
  modified_base (222)..(222): a, c, t, g, unknown or other
  misc_feature (222)..(222): n is a, c, g, or t
  modified_base (288)..(288): a, c, t, g, unknown or other
  misc_feature (288)..(288): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagcccaccctgtctgtgtctccgaggggaaagngtccaccctctcctgcgagggccagtgagagtcttgacngctccttagccgtggtaaccaaacgaaacggcctggaccacgccctcccgaggcctcctcatttangtactaccgatcccgaaccgagggccctaacgtcgggtactaccgacgccgtagggttccacggttgggcggggttcgggttcgtacggggaactaggtacggtttaccaaccgttccgtaccgtaaaccctacgtaccgaacgggtcctaaccgggtcccgttaggaacccgtaacgggttttacgttaacggttaaaacgtttttacgtttttttaaaactttaacgtttttttttaaaccgtttaccgttttaccgtcggttaaacggtacgtttaaacgggttaacgtttaacgggtttaaacgggtttaccggggttaacccgtttaacccggggttttaaaccgggtttaaccggggttaaacccgggaaaacgggggtaaaccccggtaaaagggggtttaacgggtaaaaaccgggttaaacccgtaaaaacccggtaagggttaccggttacggtacccggtttaacggaccctaaaacccgttccggtttaacccgttcggtttaaccgtttacccggttaacccttccccgtttacccccgaaccttacgttccgttaagtaacgttagtttacgtaactttccggtaccgttacggg

SEQ ID NO: 161909 - DNA, 746 bp, Homo sapiens
  misc_feature: GYAE6OF02FWZHU.48.25.C03.1.454.CMB.1.raw
  modified_base (206)..(206): a, c, t, g, unknown or other
  misc_feature (206)..(206): n is a, c, g, or t
  modified_base (307)..(307): a, c, t, g, unknown or other
  misc_feature (307)..(307): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtcccccagcccaccctgtctgtgtctccgaggggaaanagtccaccctctcctgcagggccagtgagagttctgacagccttccttagcctggtaccaacaaggcctggcccagccctccgaggcctcctctatttacngactacatcccaacgacgggcccacgttgggtctccccaagtccctaaggttcacgtgggccgggtggtcgtggggactaggtacgtttccacgttcctacaacctatccgaacgtccgacgtcccgtcgccgtacggttcctaggtaaacgttaactttttaacttaatttttaactttaccgttacggttacctacgtacgtaaggggtttaactacggtttaacggtacggttaccgttacccggttaccgggttttacgggaacccggtaacggggtaacccggtaaggggttaacgggtaaacggttaaccgtaaaaccggtaaccggttacgggtacggtaccggtcggtacccgtaaccgtacgtttccgtttacggtttacctttaccgttacccgtttaccccgttaccccggttacccttacttacccg

SEQ ID NO: 161910 - DNA, 751 bp, Homo sapiens
  misc_feature: GYAE6OF02HC251.48.25.C03.1.454.CMB.1.raw
  modified_base (203)..(203): a, c, t, g, unknown or other
  misc_feature (203)..(203): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcacgtccccagccaccctgtctgtgtctcgaggggaangtccaccctctcctgcgagggccagtgagagtctagactgctaccttagcctggtaaccaaacgaaggtcctcggccacgccctaccgaggccttccctactatttagtgaacttaccacttccaccgagggtcccacgtggtcgtacccagcctaggttcacgtgggtcggttcggtcgtaggggactaggtacgttaccgacttccgtaccaacccgtatcgacgtaccgaacgtccgtacggactaggttacctaaggtaaacgtttaacttttttaacgtaattttttaacgtaccttacgtacgtaacggtccttaagggtttacgtaaacgggttacggttaccggaaccgtttcccgggttaagggttttacccggggacccggtaaaacgggtacccggtaaaggggttacggtaaaaccgttaaaccggaaacccggttacgtgggtacccggtacttcggaaccccgttaactggttaccccgttagtttccccgtttaagtcccctttacccggttacccgtaccttaccgttccgg

SEQ ID NO: 161911 - DNA, 679 bp, Homo sapiens
  misc_feature: GYAE6OF02G6DFV.48.25.C03.1.454.CMB.1.raw
  modified_base (206)..(206): a, c, t, g, unknown or other
  misc_feature (206)..(206): n is a, c, g, or t
  modified_base (412)..(412): a, c, t, g, unknown or other
  misc_feature (412)..(412): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtcccccagcccaccctgtctgtgtctccgaggggaaangtccaccctctcctgccagggccagtgagagtcttgacagctccttagcctaggtaccaacgaaggcctggccagccctaccaggcctccctctatttatgaactacactcccaaccgtacggggcctacgtggtcgtacccagcccgtagttccacgtcgggtcggttgggtcgtggggacaggtagttccacgttctacacctntcgacgcagccctgcctagtctagaagttattttactaattttacttaaccgtgtactacgattaacggttagttacggttaagttcggacccgtttaccgggttaacgggtttcggaccggtaaacggggttaaccgtaaggggttaacggaaacggttaaccgtaaaacggttaccgtagggttacggacccgtttaggaaccctaaccgtagttaccgtttgttccttacgtaccgtttccccttcccgtacccgttattccgg

SEQ ID NO: 161912 - DNA, 848 bp, Homo sapiens
  misc_feature: GYAE6OF02F1XH7.48.25.C03.1.454.CMB.1.raw
  modified_base (212)..(212): a, c, t, g, unknown or other
  misc_feature (212)..(212): n is a, c, g, or t
  modified_base (264)..(264): a, c, t, g, unknown or other
  misc_feature (264)..(264): n is a, c, g, or t
tcagagtatacatacacgaccggtgctcgatttagtagtgtagatttgggtttgggggagggaactggctcagttaggacccagacggaaccatgggaagccccagcgcaggcttcgtcttcctcctgcttacctctcggctcccagattccgactggacaaatggtcgatgacgcagtccccagccacctgtctgtgtctccgaggggaangtccaccctctacctgaccgagggcctaggtgagaacgttcgttacgaacgngtaccttcttacggccgttaacgggtaaaccctaaaacgtaaacgggtcccttagggacccctaacggtaccccccttaacccgacgggtacccttaccccgttacgtaaacttttaacgtaccggaaacttaaccgacttaccccgtaaaccggtacggggacccctaggtttacggtaccgtaccccgtaacgggtccccgtaacggttttaccgaaccggttcggggtaccggggttacgggttccgtaacgggggtaaccgtacggttaaccggttttccgaaccgttttccgtaacccgaaccgttaacgttcccgacgtaccgtacggttacctcggtacgtacggttacgtacggttaaacgttacgttttaacttaagttttacgtacgttgtacgtacgtacttaggttaacgtcgtaacggttcggtacgttacggtacggtttacggaaccggtaaggtaccgtaaggttaaccggaacgttacgaaaccgttaggttcggtaccggtacttcggaacctacgtaccgttcgttacgttccgttactaccgttcccgtacccacgtcttacgg

SEQ ID NO: 161913 - DNA, 828 bp, Homo sapiens
  misc_feature: GYAE6OF02HJMNB.48.25.C03.1.454.CMB.1.raw
  modified_base (477)..(477): a, c, t, g, unknown or other
  misc_feature (477)..(477): n is a, c, g, or t
tcagagtatacatacacgaccggtgctcgatttagtagtgtagatttggggtttggggagacggaaccatggaagccccagcgcagcttctcttcctcctgctactctggctcccagcagccacggacaaattgtgctgacacagtctccgacgccacccgttgtccttgtacctccaggggcaaacggacgtcctccctctccgtgccgacggggccaggtcagccagtgttaacgcctaaccgttacttacgccttacgggaaccctaaacgaaaacgccgtaggacccttaacggcctacccgtacggtaccttaccctatactacttaatacgtatacggtccgttaccaacccgaggggtacccctacggttccgggaccggtacccgggcggtaacgggtttccaagggtccgccgttaagggttcgggtctggggaaccgtacggtaccttaccactccgtacctacgtntaacgacgaccacggtttaaccaacggaccgtacccggtaaagttttcgttttaccggttcggttttaaactttccgacggtttaccgagtacccgacgggtccgttacggacccgaacggttcggtaccctttacgccggttaacgggttcccggggaaacgggttacggggaacgacggggttaacgaaccttaacgtaaacccggtaaaggttaaaccggtggtaccggtacgttacccgctacccgttacgtaccgtttccgtaccgttaacccgttacccgtttaacccggttccccaacgtttacccgtgtttaaaccctaaccggtttctttaccgggttaacc

SEQ ID NO: 161914 - DNA, 834 bp, Homo sapiens
  misc_feature: GYAE6OF02GEJT8.48.25.C03.1.454.CMB.1.raw
tcagagtatacatacacgaccggtgctcgatttagtagtgtagatttgggtttggggtaggacggaaccatggaagccccagcgcagcttctcttcctcctgctactctggctcccagacttcccactggacaaatagtcgatgacgcagtccccagccacccgtgtctgtgtctccgaggggaaagacgtccaccctcctcctgcgagggccagtgagagtcttagcagtcctccgttagcccttggtacccaacgaacggtcccgtcggcccagtccctaccccgaagggccgtccctccgtaattttaacgtgtaacgttaacgacttcccgaacccgagggaccctacgttcggggtcgtacccccaaggtacccgtaacgggtttccgaaccggttcgggccggggttaacggggttccgttacgggggacctacggtaacggtttacctaaccgttcctacccgaaaccgtacgttaccgacgacgaacgtccccgttaggaccttaacgtaccgtaggtaaacgttactttttaaaccgtattttttaacgtaaccgttcggtaactacggtaccgtaagttacgttaaccggttaaacggttcgggtaccttccggtaacgggtttacggaccggtaaacggggtaaccctaaggggtaacggttacgtaaaccgtaaaacggtaacgttcgggttacggtacgtacggtaccctaacctacgttccgtacggtttccttaaccggtaccttcccggtttaccccgacgttaaccgttccgttacggtaactttaaccgttacgtaacctttaccgttcgtaccgg

SEQ ID NO: 161915 - DNA, 725 bp, Homo sapiens
  misc_feature: GYAE6OF02H5YPK.48.25.C03.1.454.CMB.1.raw
  modified_base (206)..(206): a, c, t, g, unknown or other
  misc_feature (206)..(206): n is a, c, g, or t
  modified_base (247)..(247): a, c, t, g, unknown or other
  misc_feature (247)..(247): n is a, c, g, or t
  modified_base (456)..(456): a, c, t, g, unknown or other
  misc_feature (456)..(456): n is a, c, g, or t
tcagagtatacatacacgaccggtgctcgatttagtagtgtagatttgggtttgggggaggaactgctcagttaggaccagacggaaccatggaagccccagcgcagcttctcttcctcctgctactctggctccagtattccatggactaaataggtgatgacgcacgtccccagccaccctgtctgtgtctccgaaggggaagngtccaccctctcctgcgagggccagtggagtgtcttggacngtcttccgttagcctggtaaccgaacaaacggcctacggccacgcccctccgacggtcctccctctatttactacgtactaaccactacccgaccggacgggtcctacggtcggtaccgtcccgaggaccgtaggttccacggtgggccgggttacgggtcttgggggactaggtacgtcctactctaccactatcgacgcaacgtccngtctacgtcgtacgtaaagtttaacttttaacttaagttttactacgttacgtacgtacgttacgtaagttacgttaacggttaacggccggttaaccgtttccggtaacgggtttccggaaccggtaacggggtaaccgtaagggtacggtaaacgtacgaaaaccggtacgttacgggacgtacggtacggtacctaacgtaccgtttacgtacggtttcctttaaccgtaccgttccccggtttacccgtacccttagttacccgg

SEQ ID NO: 161916 - DNA, 804 bp, Homo sapiens
  misc_feature: GYAE6OF02FJI1O.48.25.C03.1.454.CMB.1.raw
tcagagtatacatacacgaccggtgctcgatttagtagtgtagatttgggtttgggggtaggggaactgctccagttaggacccagacggaaccatggaagccccagcgcgacgcttctcttcctcctggctacctctggctcccagattccacctggaccaaatagtgatgacgcagttccccagccaccctgtctcgtcgtctccaggggaacagtccacctcgtcctgcagggcccagtgagacgttcgttcggaccagcccttaccgttacgccttacggtaacccaaacgtaaaacggtcccttagggcccctaaggtcccctccccgagggccttacccgtacgacgttttaacacgtacctaccaactcccgtaaccgtaggggtcccaacgtttgggtccgtaccccgaagtccccgtaagggtttcccaacggtacggggtaccggggtttcggggttaccctagggggtaccctaaggtacgtttaccgacgttcctacgacccgtaatcgtacgaccgtaagccctagtacctacgttcctaaggaaacgtttactttaaactaacgtttttaactaaccgtcgttacacgtacgttacggttacgtaacggtaagttccggttaaccttaccggttaacggtttacggaccgtaaacggggaaccttaagggggtaaccgtaaggtaaccgtaaaccgtacgttgggtaccggtacgtaaccgaccggtaaccctaaggttaccgtacgttacccggttactacttcccgtttaccccgacctacgttaccg

SEQ ID NO: 161917 - DNA, 667 bp, Homo sapiens
  misc_feature: GYAE6OF02IGG95.48.25.C03.1.454.CMB.1.raw
  modified_base (625)..(625): a, c, t, g, unknown or other
  misc_feature (625)..(625): n is a, c, g, or t
tcagagtatacatacacgaccggtgctcgatttagtagtgtagatttgggtttggggtagacggaaccgatggaagccccagcgcagcttctcttcctcctgctactctggctcccagattccactggacaaatagtgatgacgcagtccccagccaccctgtctgtgtctccagggaaagagtcaccctctcctgcaggccagtcagatgttaagagccactccttacgcctaggtaccacgacaaaaaccgtggaccaacgcctacccgaggcccttacctcaacttctaacgtggtgccgttacccaccgacggggccctacgtcggaccactccccgaagacgtacggtcctaggcgggtccaggtcgggttaccgaggggaacacggtacttaccgactcttaccgactactccgaacacggtacgtacgaacgtcccgtataacgtagttaacgtttgaccgtttaagtttcgtttttcgtcgttacgtagtcgtaagttacgtaggtacttaccgactacgtactacgtttcgaccggtacgggaacgaacgggtacgtaaaacgtaccgaaacgtagtcgtaacggtgaccgacacgtagtctacggttaccttacnctttacccgtaccgctacgtcgttacgtattactattaaccg

SEQ ID NO: 161918 - DNA, 750 bp, Homo sapiens
  misc_feature: GYAE6OF02HJYA5.48.25.C03.1.454.CMB.1.raw
  modified_base (179)..(179): a, c, t, g, unknown or other
  misc_feature (179)..(179): n is a, c, g, or t
  modified_base (280)..(280): a, c, t, g, unknown or other
  misc_feature (280)..(280): n is a, c, g, or t
tcagagtatacatacacgaccggtgctcgatttagtagtgtagatttgggtttggggagacggaaccatggaagccccagcgcagcttctcttcctcctgctactctggctccagattccactggacaaatagtgatgacgcagtccccagccaccctgtctgtgtctcgaggggaaanagtcacctctcctgcagggccagtgagagtcttgacagctccttagcctaggtaaccaaacgaaaggcctggccacgccctccgagccttcctctatttangactacatcccaccgacgggccctagtgggtcgtcccgacgtcctaggttccacgttgggcgggttagggtcctaggggacaggtacgttcacgttctaccgaccatcgacgccacgtccgtagcgtacgttctaggtaaacgtttactttttaaacttatttttaactttacgtttacgttacgtaacgtacgttaaggttaagttacgggttaacggtacggttaaccgttacccgggttacgggttttacgggaacccgtaaacggggtaaaccgtaaaggggttacgggtaaaaccggtaccgtaaaacggtacggttacggttaccggttaccgtacggtacccgtaacccgttaacgttccgttacgttaccgtttacccttacgtttaccccgttcccggtacccttaactttccgttacgttaacgttacgtttacggttaaccttacggttcgttaacggg

SEQ ID NO: 161919 - DNA, 812 bp, Homo sapiens
  misc_feature: GYAE6OF02GXVOR.48.25.C03.1.454.CMB.1.raw
  modified_base (179)..(179): a, c, t, g, unknown or other
  misc_feature (179)..(179): n is a, c, g, or t
tcagagtatacatacacgaccggtgctcgatttagtagtgtagatttgggtttggggagacggaaccatggaagcccagcgcagcttctcttcctcctgctactctggctcccagattccactggacaaatagtgatgacgcacgtcccagccacctgtctgtgtctaccgaggggaancgtcaccctctcctgcgagggtccagtgagagtccttagacagtcttccgttagccgttacggtaacccaaacgaaacggtccgtcgggacccacggtcccctacccgacgggtcccttacctactaacttttacgcgtaaacttaaccacttacccgaaccggtaacggggtaccctacggtttcgggtaccgttaccccgacggtacccgttaacgggtttccgaaccggttcggggtaccggggtttacggggttacccggtagggggtaaacccgtaagggtttaccggtttaccaaccgtttccgttaccgaacccgttattccggaaacgtcccgtaacggtcccgtagtaccgtacggttaaccgtaggttaaaacttttacgttttaactttagttttaacgtttactacgtactaacgtcgttaagtacgtaacggttagtacggtaccttacggtacgttacggaccgtaaggaccggtaagtacggtaacgaacgtaacgtacgttcggtacgtactaccgactaccgtattcgttacgttactaccgttaccgttaccgtacccgttctaacgttcgttaacgttacttaattaccggtttacgttaccgtacggtaccgg

SEQ ID NO: 161920 - DNA, 773 bp, Homo sapiens
  misc_feature: GYAE6OF02HLU9I.48.25.C03.1.454.CMB.1.raw
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcacgtccccagccaccctgtctgtntctcgaggggaangtccaccctctcctgcagggccagtgagagtcttagacagtcctcttagcctaggtaaccaaacgaaacggccttaggaccctacgtcccctacccgaggcccttccnctaattttaancgtataccacttccgaacccgtacgggccctaaccgttcggtccgttaccccgaaggtcccgtacggtttaccgtacgtcggggtacgggttcgggttccggtaggggtaaccctaggttaacggtttcccaaccgtttacccgttacaaccccgttaacgttaccgacggtaccgccggtctacgacgtacgttccgtaaggtaaacttttacgttttaacttaagttttttacttaacgttgttaccgtagtacgtaacggttacttacggttaaggttccggaccgtttaccgggttacgggttttaccggaccggtaaacggggtaaccctaagggttacggtaaacggtaaccgaaaggttaccgtggtacggtcgtaccgtaccgtaactacgtttccgtacgttaccttccgacccgtttcccgtacccttacctagtttaccg

SEQ ID NO: 161921 - DNA, 783 bp, Homo sapiens
  misc_feature: GYAE6OF02FFQZ9.48.25.C03.1.454.CMB.1.raw
tcagagtatacatacacgaccggtgctcgatttagtagtgtagatttgggtttgggggaggaactgctcagttaggacccagacggaaccatggaacgccccagcgcagcttctcttcctcctgctactctggctcccagacttccactggacaaatagtgatgacgcacgtccccagcccaccctgtctgtcgtctaccggaaggggaacgtcgtccacccgttctccgtggccgacgggcctaggtcggagtacgttcttacgactcggtaccttccgttacgcccgttacggtaacccaaacgtaaacggcccgtcggaccccacgtccccttacccgacggtcccttacctacgttatttactacgtaactaacctaccgtacccgtaaccggaccggtaccctacgggttccggttacccgacccgacggtacccggttacggttaccgacggttcgggggtcggtcgggtcgtacgggactacggtactactacctcgtaccaacgtactacgaccgccgacgtaccgtacgtacgtacgttacgtaaggtttaaacttttaacttttaactttaacgttttaacgtacgtacggttacgtacggtacgttaagttaccggttacgggttacggtaccggtaccgttaccgggttacggttaccgggaaccggtaaacgggtaacggtaacgggtaacgaacgttaaccggaacgtgtacgacgcgtacgacctacgtacttcgtacttactcctaccgtcctaccgtattcgtacg

SEQ ID NO: 161922 - DNA, 643 bp, Homo sapiens
  misc_feature: GYAE6OF02GUFB6.48.25.C03.1.454.CMB.1.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccacctgtctgtgtctccgaaggggaaanagtccaccctctcctgcgacgggccaggtgagagtctgacngctccttagcctggtaccaagaaggcctggccagccctaccgaggtcctcctactatttactcgatacactaccaccgacgggccacgtgggtcgcccacgcctacggttcacgtggtacgggtggtcgtacggggacaggtagttccactctacaccatcgagcacgccgtgacgtacgtctaacggaagttattttaacttattttaactaccgttcgtacgatcgtaagttacttacggtaagtacggtaccgttacggtaacggtttcggaaccgtaacgggaacgtaagggtacggaaacgttaaccgaaacggtagtcggtacggtacgttacgaccgtaacgtacgttacgttacgttaccgttcttacgttaccctcccgacctcttacg

SEQ ID NO: 161923 - DNA, 724 bp, Homo sapiens
  misc_feature: GYAE6OF02GJECB.48.25.C03.1.454.CMB.1.raw
  modified_base (282)..(282): a, c, t, g, unknown or other
  misc_feature (282)..(282): n is a, c, g, or t
tcagagtatacatacacgaccggtgctcgatttagtagtgtagatttgggtttggggagacggaaccgagtggaagccccagcgcagcttctcttcctcctgcctactctggctcccagattccactggacaaatagtgatgacgcagtccccagccaccctgtctgtgtctccaggggaaagagtccaccctctcctgcagggccagtgagagtcttgacagcctcttagctggtaaccaacaacggcctggccagcctccgaggcctacctctatttagngtactaccatcccaaccgagggccctaacgtggtcgtccccagtcccgtaggttccacgttgggccggttgggtactcggggaacaggtacttcgaccttcgtacgaaccgtatccgaacggtccgacggtccctagaccgtaacggttccgtaaggtaaacggtttaactttttacgttaattttttaacgttacgtttacgttacgtacgtactaaggttaacgttacggttaaggttcggtaccgttaccggttacggttttacgggaccgtaaacgggtaccgtaagggttacggaacgtaacgtaaaccggtacgttcggtacggacgtacggaccgaactacgttacgttcgtaccgttacgtaaccttcccgttacccggaccttacgtccgttacgtaccgtttagttaccgtacttaccgttacggtaccggg

SEQ ID NO: 161924 - DNA, 624 bp, Homo sapiens
  misc_feature: GYAE6OF02I72H8.48.25.C03.1.454.CMB.1.raw
  modified_base (157)..(157): a, c, t, g, unknown or other
  misc_feature (157)..(157): n is a, c, g, or t
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
  modified_base (300)..(301): a, c, t, g, unknown or other
  misc_feature (300)..(301): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (327)..(327): a, c, t, g, unknown or other
  misc_feature (327)..(327): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (569)..(569): a, c, t, g, unknown or other
  misc_feature (569)..(569): n is a, c, g, or t
  modified_base (575)..(575): a, c, t, g, unknown or other
  misc_feature (575)..(575): n is a, c, g, or t
  modified_base (617)..(617): a, c, t, g, unknown or other
  misc_feature (617)..(617): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatgngatgaccgcacgtccccagccaccctgtctgtgtctccgaggggaaangtccaccctctcctgcagggccagtgagagtctgacngtctccttagcctggaaccaagaaggcctggccagccctccgaggcctcctcatttannactacntccaacnggccacgtggtcnccgagccgtaggttccacgtcgggtcggtcggtcgngggacgnggtacgtttcacttccgtaccactaacgtcccgagtaccgacgtccctaggaccgtagttcctaaggtaacgtttaacttttactagttttaactacgtcgtacgaagtcgtaagtacgtacgttaaggcgtaaccgttcgtaggttccggaaccgacgggtacgtaagggtcgtaaacgtacgtaaaccgtgttcggnggtacncgaccgactagtccgtcgtttactaccgacttccccgtaccncgtatcg

SEQ ID NO: 161925 - DNA, 628 bp, Homo sapiens
  misc_feature: GYAE6OF02GCR12.48.25.C03.1.454.CMB.1.raw
  modified_base (304)..(304): a, c, t, g, unknown or other
  misc_feature (304)..(304): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccacctgtctgtgtctccgaggggaaagagtccaccctctcctgcagggccagtgagagtcttgacagctccttagcctggtaaccaacaaggcctggcccagtccctcccaggtcctcctcatttangaactacatcccaacgagggccacgtggtctcccagcctaggttcacgtgggcggtggtctgggacagtagttcacgtcncacctntcagcagtcctgcagtctagaacgttatttactattttagtactagtcctagcttagtatacgtaagtcggtactccggtacgtttacggccgtaaacgggtaccgtaaggggttacggaaacggttaccgaaaaccggtacgttagggtcgtacgtccggtaaccctaacccggtagttccgttacgttacctttccgtaaccgtttccccgtttacccggtacttacggttacccg

SEQ ID NO: 161926 - DNA, 684 bp, Homo sapiens
  misc_feature: GYAE6OF02I9OLK.48.25.C03.1.454.CMB.1.raw
  modified_base (180)..(180): a, c, t, g, unknown or other
  misc_feature (180)..(180): n is a, c, g, or t
tcagagtatacatacacgaccggtgctcgatttagtagtgtagatttgggtttggggagacggaatcatggaagccccagcgcagcttctcttcctcctgctactctggctcccagattccactggacaaatagtgatgacgcagtccccagccaccctgtctgtgtctccgaggggaanagtcaccctctcctgcgacgggccagtgagagttcttgacagtcctccgttagccgtaggtaaccaacgtaaacggcctaggccagcccctacccgaggtcctcctactagtttatgataccactccaccgacgggcctacggtcggtccgtcccgaggtacccgtaggttcacggtcggggtccgggttagggttccgtaggggactaggtacttcaccttcgacctacctatcgagcgtacgccgtgaccgtacgttctacggtaaactttattttaacttaattttttaacgttacgttcgtacgtagtacttaaggtacgttaggtaacggttcggtaaccgttaccggttaacggttccggaaccggaacgggtaacgtaagggtaacggaacgtaacgaaacgtacggtagtacggtctacgtaccacgtacttctcggttacttcctacgttccctaccgtactacttcgtacgttacttgtacgttacttcgtacg

SEQ ID NO: 161927 - DNA, 577 bp, Homo sapiens
  misc_feature: GYAE6OF02HPWQH.48.25.C03.1.454.CMB.1.raw
  modified_base (180)..(180): a, c, t, g, unknown or other
  misc_feature (180)..(180): n is a, c, g, or t
  modified_base (189)..(189): a, c, t, g, unknown or other
  misc_feature (189)..(189): n is a, c, g, or t
  modified_base (273)..(273): a, c, t, g, unknown or other
  misc_feature (273)..(273): n is a, c, g, or t
  modified_base (373)..(373): a, c, t, g, unknown or other
  misc_feature (373)..(373): n is a, c, g, or t
tcagagtatacatacacgaccggtgctcgatttagtagtgtagatttgggtttgggggagacggaaccatggaagccccagcgcagcttctcttcctcctgctactctggctcccagattccactggacaaatagtgatgacgcagtccccagccacctgtctgtgtctccgaggggaangtcaccctntcctgcagggccagtgagagtcttgacagctccttagcctggtaccaacaaggcctggccagccctccaggcctcctcatttangactacatcccaccagggccacgtggtcgtcccagccgaggttccacgtggcggtgggtctgggacaggtagttcatctcacatcagcagcctgcagtcnggaattattttactattttattactgtacagtcagttatggttaagtcggtacgttccggtacgtttcggacgtaaagggcgtaaagggtcggaaaggtacaaacggtacgtaggttcggactcggacaacctgtacttgttaccttactacgttcccttcccgactacgtctacggtactagttactaactttcgtcttacgg

SEQ ID NO: 161928 - DNA, 684 bp, Homo sapiens
  misc_feature: GYAE6OF02GRAK8.48.25.C03.1.454.CMB.1.raw
  modified_base (201)..(201): a, c, t, g, unknown or other
  misc_feature (201)..(201): n is a, c, g, or t
  modified_base (467)..(467): a, c, t, g, unknown or other
  misc_feature (467)..(467): n is a, c, g, or t
  modified_base (500)..(500): a, c, t, g, unknown or other
  misc_feature (500)..(500): n is a, c, g, or t
tcagagtatacatacacgaccggtgctcgatttagtagtgtagatttgggttgggggaggaactgctcagttaggacccagacggaaccatggaagccccagcgcagcttctcttcctctgctactctggctccagattccactggaacaaatgtgatgacgcacgtcccagccaccctgtctgtgtctccgaaggggaangtcacctctcctgcgaggcctagtgagagtcttagacagtccttcttagcctacggaaccaaagaacgggtcctagggcccaacggtcccctcccgaaggtccttacccgttacgtaattttatcggaaactaccgtaccgttacccgaaccccggtagggtaccctaacgttcgggtccgtaacccctacgggacccgtttaacggtaccaccggttggggccgggttcgggtctacggggtacaggtaacgtttccgacctttnactaccctatccgagcaaccgtctcgatacgtnaagttaacttactttaattactttaactacgttcgtactagtgtagttacgtacgtaagtccggtaccttcggttacggtacgaccgtaaggtaccgaagtcggaaacgttacgaaagtcgtggtacgtacgtacgtccacgtattcggtagttctacgaccgttccgtacccgtatccgtacg

SEQ ID NO: 161929 - DNA, 910 bp, Homo sapiens
  misc_feature: GYAE6OF02J2KM7.48.25.C03.1.454.CMB.1.raw
  modified_base (185)..(185): a, c, t, g, unknown or other
  misc_feature (185)..(185): n is a, c, g, or t
  modified_base (235)..(235): a, c, t, g, unknown or other
  misc_feature (235)..(235): n is a, c, g, or t
tcagagtatacatacacgaccggtgctcgatttagtagtgtagatttgggtttggggagacggaaccatggaagccccagcgcagcttctcttcctcctgctactctggctcccagattccacgtggacaaatagtgatgacgcacgtccccagccacctgtctgtcgtcgtaccgagggaaacncgtcctaccctctccgtgccgacggtccgagtgacgtacgttcgtcgacncgtctccgttacgtaccgtacgtaaccaacgaaccgtccgtcggcccacggtcccctccgacgtcccgttacctacttaaccgtttagtaccgtaactaccgtacccgtaccccgaaccgggaaccgggtcccttaccggtcggtacccgtacccggtaccgtaccggttaccggttaccgtccggggttacggggttccggggttacgggtacggtaccgggtaacgtaccggttaccgtacgtaccctacccgtaccgtaaccgtaccgtccgaaccggtaccgtttcccgacggttacgtaccgttaaccggttaccgtaaacgtttaaacgttttaaccttttacgttttaaaccttttagcccgtttaccggtaactacggttaacggtaaagtttaccgggtaacgtttaaccgggaaccgttccgttaaacccggggtttacggaaccgggaaaccggtaaaccggttacgggtaaacggttaccggtaaaacccgtaacgtaaacgttaaccgggtcggtactaccggttaaccacccgtaaacgtttgttaccccttacggtttcccttaaaacccgtcccgttccccggtaactattttaacccggtggttaaaaccgtttcgttaaccggttacctttacggtccccgtaggggttaacccggg

SEQ ID NO: 161930 - DNA, 918 bp, Homo sapiens
  misc_feature: GYAE6OF02FN2TS.48.25.C03.1.454.CMB.1.raw
tcagagtatacatacacgaccggtgctcgatttagtagtgtagatttgggtttggggtaggacggaaccatggaagccccagacgcagcttctcttcctcctgctacctctggctcccagattccactggacaaatgtgatgacgcagtccccagtccacccgtgtctgtgtctccaggggaaagtacgtccaccctcgtccgtgcgacgggtccaggtgagtacgtcgtttgacagtccttccgttaaggacccttcgggtaacccaaacgaaacggccgttagggcccaacgtccccttacccgaagggtccttccccgttactaacgtttttaacacggtaacttaaccctagttaccccgaaccggtacggggtaccccaacggtttcggggttaccggttaccccccgtaagggtcccccggtaaggggttttacccaacgggtttccggggccgggggtttacgggggttacccgttcggggggaaaccccttaaggggtaacggttttcccgaacggtttcccgttaaccgaacccgttagttacccgaacggaccttaacgggccctagggtcccgtaacgggttcccgttaaggtaaaacggttttacttttttaaccgttaagtttttttaacgtttaaccggtttacggttacgtaacggttacgttaacgtttaaccgttacgggttaaacggttacgggtaacccgttaccggttacggtttaccggaacccgtaaacggggtaacccgtaagggtacggtaaacggttaaccgaaacggtacgttagggtacgggtacgtacgactaaccgtacgtttaccgtacgttaccttaccgtacttacccgtttcccgtactaccgttcgtacggtacttaaccgtggttaacttacgttgtaacggg

SEQ ID NO: 161931 - DNA, 789 bp, Homo sapiens
  misc_feature: GYAE6OF02H6KM7.48.25.C03.1.454.CMB.1.raw
  modified_base (783)..(783): a, c, t, g, unknown or other
  misc_feature (783)..(783): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagcccaccctgtctgtgtctccgaggggaagcgtccaccctctcctgcgagggccagtgagagtcttagacagtcttaccgttagcccgttacggtaacccaaacgtaaaacggtcccgtagggaccctaacggtccccttaccccgaagggtcccttaccccgttacctaagtttttaacgtacggtaacttaaccgtaccttaccccgaaacccggtacggggacccctaaccggtttcggggtacccgttaccccgaacggtcccgttaacgggttccctaaacggtcggggtacgggttacgggtccgtaggggacgtaggtacgtttcaaccgttctccaaccctagtctacgactacgtcccgtgacgtacgttacgtagtaaacgttactttttaaagtatttttaacgttaacgttgttaccgtagtacgttaagttacgttaacggtaggttacggtaccgtttaaccgggttaaccggttttcggaaccggtaaaggggtaacccgttaaagggtacggtaaacgtaaccgaaacggtagttacggtacgtacgtcgaccataccttcgttacgtacttcgtacttcccgtaccgtcctnttaccg

SEQ ID NO: 161932 - DNA, 797 bp, Homo sapiens
  misc_feature: GYAE6OF02IRSB1.48.25.C03.1.454.CMB.1.raw
  modified_base (202)..(202): a, c, t, g, unknown or other
  misc_feature (202)..(202): n is a, c, g, or t
  modified_base (791)..(791): a, c, t, g, unknown or other
  misc_feature (791)..(791): n is a, c, g, or t
tcagagtatacatacacgaccggtgctcgatttagtagtgtagatttgggtttgggggaggaactgctcagttaggacccagacggaaccatggaagcccccagcgcagcttctcttcctcctgctactctggctcccagattccactggacaaatgtgatgacgcagtccccagccaccctgtctgtgtctcgaggggaangtcaccctctcctgcagggccaggtgagagtcttgacaggccttccgttacgcccgtacggtaacccaaacgtaaacgggccctcgggcccgaacggtccccctacccgacgggtcccttccttaccgtacttttagtgtaactacctactaccccgaccggtacggggcccaacggttcgggttaccgccccgtaacggcccgttacggttaccaccggttcgggtccggggttacgggtcgtacgggggaaccgtaggtacgtttccgtaaccgttcctaccctaacccagtccgaacgacccgtacggtcccgtaggccgtaagtttccgaaagggttaaactttagtttttaacctttaatttttaacgtttaccgttagttaccgtaagtaccttaaggttacgttacgggttaaggttaccggacccgttttccgggtaaccgggtttccgggaaaccgggtaacgggtaaccggtaaggggttaaccggtaaacgtaacgtaaaccgtacgttagggtacggaccgttggtaacccaacttcgttacgttcgttaccttacgtcttcccgttcccgaccttntaccgg

SEQ ID NO: 161933 - DNA, 696 bp, Homo sapiens
  misc_feature: GYAE6OF02HONVQ.48.25.C03.1.454.CMB.1.raw
  modified_base (184)..(184): a, c, t, g, unknown or other
  misc_feature (184)..(184): n is a, c, g, or t
  modified_base (298)..(298): a, c, t, g, unknown or other
  misc_feature (298)..(298): n is a, c, g, or t
  modified_base (651)..(651): a, c, t, g, unknown or other
  misc_feature (651)..(651): n is a, c, g, or t
tcagagtatacatacacgaccggtgctcgatttagtagtgtagatttgggtttgggggagacggaaccatggaagccccagcgcagcttctcttcctcctgctactctggctcccagattccactggacaaatagtgatgacgcagtccccagccaccctgtctgtcgtctccgaggggaaagngtcaccctctcctgcgagggccagtcgagagtcttgacagctccttagcctggtaaccaacgaaacggcctggaccacgtcccgtacccgagggccttcccgtactaattttanagactaccacttcccgaaccgagggacccacgttgggtcgtacccgagccgtaggtttccacggtgggtcgggtgggtcgtggggactaggtacgttcactctacgaccatcgacgacgtacgccgtagcctagttacgaggtaaacttaagttttttaactaagttttttaactttactacgttacacgtactaggttacgttacggttaagtggtaccttacccgggtaagtttccgggaacggtaacgggtaaccgtaagggtacggtaagtaaccgtaaaacggcgttaggtacggtcgtaccgacgtaacctacgttctacggttacttcgtaccttccggttacccncgtacgtgttacctagttacgtttacgtacgttacgtctacgggg

SEQ ID NO: 161934 - DNA, 749 bp, Homo sapiens
  misc_feature: GYAE6OF02JIBPF.48.25.C03.1.454.CMB.1.raw
  modified_base (180)..(180): a, c, t, g, unknown or other
  misc_feature (180)..(180): n is a, c, g, or t
  modified_base (631)..(631): a, c, t, g, unknown or other
  misc_feature (631)..(631): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaangtcaccctctcctgcgacgggccagtgagagtcttggacagccgtccttaggccttaggtaacccaaacgaaacggcccgtggacccaggccccttacccgagggtcccttcccttacctaattttacgtgtaaccttaccacgttaccccgaaccggtacggggtacccctacggtttcggggtacccgttcccccgaaggtacccccgtaagggtttccctaaccggtcggggtccgggttcggggttaccgttacggggaccagggttaccgttcgtactccgtacgacctagtcacggcacgcgtacgcgtaacgttcgtaggtaatttacttttacgtaagttttcttactggtaccagttactaagtagttacgttaacgtcggtaacttccggttaaggttcgaccgaaagggtccaagggttccggaagtaacccaaacggtnttaggtcggtacctaggaccctaaacggtgttcccgtcgtttaccgttacgtcccgtttccttcccgaacctgtttagccggttaacgtttacaacggtttcccttagtgtaccgggg

SEQ ID NO: 161935 - DNA, 886 bp, Homo sapiens
  misc_feature: GYAE6OF02I7G2O.48.25.C03.1.454.CMB.1.raw
  modified_base (183)..(183): a, c, t, g, unknown or other
  misc_feature (183)..(183): n is a, c, g, or t
tcagagtatacatacacgaccggtgctcgatttagtagtgtagatttgggtttggggagacggaaccatggaagccccagcgcagcttctcttcctcctgctactctggcctcccagtacttccacgtggaacaaatagtgatgacgcacgtcccagccacctgtctgtgtctcgaggggaangtccacctctcctgcgacggaccagtgagtacgtcttacgacacgtccttaccgttacgccgttacggtaaccaaacgaacggtcccgtacggaccacgtcccctacccgaggtcccttaccacttaagttttacacgtaactaacctaccgtaccccgaacggaccgggtccctaacgtttcggggtaccctaccccgaaggtaccccgtagggttacccacggtccgggggtcgggttcggggtacggtaacggggaaccgtagggtttacgttacccctaaccggttccgtaacccttaacccgacttaccgggactaccgggtaccggtcccgttaaggtaccgtaccggttaccgttaaaggtttaatttttaaccttttttaacgttttaaactttttaaacgttcgtttaacggttacccgtaggttaaccgttaaggttaccgttaacgggtttacgggtaccggtttaacccggttacccgggttttaacgggttttccgggaaaaccccgggtaaacgggggtttaaaccgaaacgggggtttaaccggtaaaacgtaacccgtaaaacggttaccggttagggtacccgttacgtacgtaccaccgttattccgttacgttactacgttccttacccgtcccgtattaccgtgtttaacgtacttacggttgtaacttcggtccggtaacgg

SEQ ID NO: 161936 - DNA, 629 bp, Homo sapiens
  misc_feature: GYAE6OF02GLR19.48.25.C03.1.454.CMB.1.raw
  modified_base (273)..(273): a, c, t, g, unknown or other
  misc_feature (273)..(273): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcattangatacatccacagggcactgtgtccagccaggttcactggcggtgggtctgggacagagttcacgtctcaccatcagcagctagcagtctagaagattttacgattttactaactgttacagcaagtactacggtaagtcggtaacttccgtaacgttttcggaccaaaaggggtacccgaaaagggttcgggaaaagttaccaaaaaacgggtaaccgttacggttgggaccttaggacccgtaacctaacttccgttggtaccttttaccgaagtttcccttttacccccggccttaaacgttccgttacggtaacttaacgttggtttaaacctttacggtaccctttaaggg

SEQ ID NO: 161937 - DNA, 726 bp, Homo sapiens
  misc_feature: GYAE6OF02GMJK9.48.25.C03.1.454.CMB.1.raw
  modified_base (165)..(165): a, c, t, g, unknown or other
  misc_feature (165)..(165): n is a, c, g, or t
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (631)..(631): a, c, t, g, unknown or other
  misc_feature (631)..(631): n is a, c, g, or t
tcagagtatacatacacgaccggtgctcgatttagtagtgtagatttgggtttgggggaggaactgctcagttaggacccagacggaaccatggaagccccagcgcagctctcttcctcctgctactctggcctcccagattccactggacaaatagtgatgacncacgtccccagcccaccctgtctgtgtctacgaagggaaagtcgtccacctntacctgcacggcagtgagntctgacagctcgtagcctggtaaccaaacgtaaggcctcggacctaagcccctaccgaggtcctccgtaccttaattactcgaacttacctacgaccccgaccggtaacggccctacggtttggacccgttaccgaaccgtcccggtaagttaccgtcggtcgggtaccgggttgggtaacttcgggggaaacacgggttacgtttaccacccggtttcaacccggtaacccagtaccggacgtcctacggctacgacgtacgttacgtagtaacgttaatttactacgttttactaacgtcgttactacgactagttacgtacgtaagttcggaacgttccgtacggttacgaccggtaacggaacgtaaggtaagaccgtaaacgaacgttanacgggttgaccctaacgggtacccacgtaaccgtttacgtacccggttacctttcccgacgtttaccccgttaccccggtacctacggtttacgg

SEQ ID NO: 161938 - DNA, 785 bp, Homo sapiens
  misc_feature: GYAE6OF02FQMSI.48.25.C03.1.454.CMB.1.raw
  modified_base (199)..(199): a, c, t, g, unknown or other
  misc_feature (199)..(199): n is a, c, g, or t
  modified_base (305)..(305): a, c, t, g, unknown or other
  misc_feature (305)..(305): n is a, c, g, or t
tcagagtatacatacacgaccggtgctcgatttagtagtgtagatttgggtttgggggaggacggaaccatggaagccccagcgcagcttctcttcctcctgctacgtctggctcccagattcccactggacaaatgtgatgacgcagtccccagccaccctgtctgtgtctaccgaaggggaaagtcgtccacccctntccgtggcgacgggcctaggtgagaggtcttgacacgtcctccgtagcctacggtaaccaacgaaggcctcggaccagtccctaccgaggtcctaccttatacttntagaatacacgtccaaccgcgggaccctaacgttcgggtaccgtacccgagtacccggttacggttccgtaccggttgggtccgggggttgggtaccggtacgggaacttacgggtacgtttaccgaccgttcgtacccaacctcttaccgagtcctacgccttagccgttacggtaccgtacggtaaacgttttacttttaacttaactttttacgtacgttacggtacgtacgtacgtaagttaacgtacggttaacggtcgttaaccgttaccggttacggtttacggtaccggtaaacgggtacgtaaacgggtacgggttaaacgtaaccgtaaacggtacgttacggtacggttccgtcgtaacccgtaacgtacgttaccgtacgttacttacccgtctttcccgttaccccggtccttaacgtaccggttacgttacgttacgttacgttaccgtaccgttggtaacccggg

SEQ ID NO: 161939 - DNA, 649 bp, Homo sapiens
  misc_feature: GYAE6OF02G7D3A.48.25.C03.1.454.CMB.1.raw
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (349)..(349): a, c, t, g, unknown or other
  misc_feature (349)..(349): n is a, c, g, or t
  modified_base (368)..(368): a, c, t, g, unknown or other
  misc_feature (368)..(368): n is a, c, g, or t
tcagagtatacatacacgaccggtgctcgatttagtagtgtagatttgggtttgggggagacggaaccatggaagccccagcgcagcttctcttcctcctgctactctggctcccagattccactggacaaatagtgatgacgcagtccccagccaccctgtctgtgtctccgaggggaaagagtccaccctctcctgcagggccagtgagagtcttgacagctccttagcctggtaccaacaaacggcctggccagcctcccaggcctcctnatttangactacatccaccgagggccacgtggtctcccgagccgtaggttcacgtgggcggtgggtctgggacagngttcactctcaccatcganaccacgtcctgcgtagttcgtaggtaacgtttactttttaactttatttttaacttacgttacgtacgtaagtacgtaagttacgttacggttaacggttacggtaccgttaccggttaccggttttacggacccggtaacgggaccgtaaggggtaggtaacggtaacgtaaacgtacgtaggtacggactcggacctacgtacttcgttacgttcttacctcgttacccttcccgtacctacgttacgtacgtagttacttagtacttacgtagtacgg

SEQ ID NO: 161940 - DNA, 762 bp, Homo sapiens
  misc_feature: GYAE6OF02I4Y95.48.25.C03.1.454.CMB.1.raw
  modified_base (182)..(182): a, c, t, g, unknown or other
  misc_feature (182)..(182): n is a, c, g, or t
  modified_base (291)..(291): a, c, t, g, unknown or other
  misc_feature (291)..(291): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaaggggaaanagtccaccctctcctgcgagggccagtgagagtcttgacagcttcgttacgcctaggtaaccaaacgaacggtcctggccagccctccgaggcctcctactatttacgngactacactacccacgacggcctacgtggtcgtccagcctaggttcacgtgggtcggtacgggtctagggacaggtacgttccacgttctaccgaactagtcgaacgccgtacgccgttagacgtacgttcgtaaggtaactttaactttttacgttaactttttacgttacgttacggtactacggtacgttagtaacgttacggttaacggtacggttaccgttaccggttaccggttttacggaacccggtaaacgggttaaccgaaagggttaacgggtaaaccgttaaaccgaaaccggttacgttacggtacggtacgtaacgacccgtaaacgtacgtttacgttcgttttaaccgttaccgtaacgttttccccgttaacccggttaccgttaaccgtttacggtaacgtttaaccgtttaacgttaacggtttaacctttacccggttcggttaacccgggg

SEQ ID NO: 161941 - DNA, 815 bp, Homo sapiens
  misc_feature: GYAE6OF02GPRFF.48.25.C03.1.454.CMB.1.raw
tcagagtatacatacacgaccggtgctcgatttagtagtgtagatttgggtttgggggagggaactgctcgagttaggacccagacggaaccatggaagccccagcgcaggcttcgtcttcctccgtgctactctcggcctccagacttccacgtggacaaagtgtgactgacgcgacgtcccagccacctgtctgtcgtctaccgagggaacacgtccgacctctccgtgcgacgggcctagtcgagagtccgtagacacgctccgttagccgtggtaccaacgaaacgtccgtacggccagtcccctaccgtaggccctccgtactaacgttttaatcggtaacttaaccacgtacccccgaacccggaaaccgggtccttacggttaacgggttccgaccccgttaacggtaccccgtttaacgggttaccgtaacccgggtttggggtaccccggggtttcggggtttaccgtacgggggtaccgaacgggttaccggttttacccgtaaccgtttccggttaacccaacccgtaaagtccccgtaccggaccgacccgtaccgtccgtaccgtaacgttaccgttaaggtaaacgtttaacgttttaaactaacgttttacgttactaggttacctaacgtacttaacggttacgttacgggtacgtcggtaccttaccgggttacgtttacggaaccgtaaacgggtaacgtaacgggtacgtaacgtaacgaactaggtcgtcgacgtagacctacgtacttacggttcgtaccgttacggtccttacccgtccggtaccacgttccg

SEQ ID NO: 161942 - DNA, 685 bp, Homo sapiens
  misc_feature: GYAE6OF02IHKBW.48.25.C03.1.454.CMB.1.raw
  modified_base (288)..(288): a, c, t, g, unknown or other
  misc_feature (288)..(288): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaaggggaaagagtcaccctctcctgcagggccagtgagtagtcttgacagtctaccttagcctggtaaccaaacgaaacggcctaggccacgccctccgaggcctccgtcatttangatacatcccaacgagggccctaacgtcggtactcccgaagtccgtaaggttccaacgtgggcgggttgggtcgtggggactaagtgttcaacctctaccacactcacgacgaacgtcctcggactacgtccgttagaaacgtttactttttaactaacttttttatttaacgtgttacgaatcgtaagttatacggttaaggtgttaacctacggttacggtttacggaccgtaaacgggtacgtaaaggtacgggtaaacgtaaacgtaaaaccgagttcgggttaaggacctcggacctaacgtacgttacgtcgtttaccttacgtaaacctttcccgttaaccccggaacttacgtccttaagtagttacttaggtacttacggtatacggg

SEQ ID NO: 161943 - DNA, 560 bp, Homo sapiens
  misc_feature: GYAE6OF02FKEE3.48.25.C03.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
  modified_base (421)..(421): a, c, t, g, unknown or other
  misc_feature (421)..(421): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagngtcaccctctcctgcagggccagtgagagtcttgacagctccttagcctggtaccaacaaggcctggccagcctcccaggctcctcatttangatacatcccaccaggccacgtggtctcccagccaggttccactgggcggtgggtcgtgggacagagttcactctcacatcagcagcctgcagtctgaagtatttactattttattactgtctanctagttatcgtaaggtagtacctccgtacgtttcggaccgaacgggaccgtaagggtggaacgtacgaaacggtactggtggtacgtcggtaccaccgtagttcttcgttcttccgtattcccttacccgcctattccg

SEQ ID NO: 161944 - DNA, 646 bp, Homo sapiens
  misc_feature: GYAE6OF02IPP2U.48.25.C03.1.454.CMB.1.raw
  modified_base (181)..(181): a, c, t, g, unknown or other
  misc_feature (181)..(181): n is a, c, g, or t
  modified_base (279)..(279): a, c, t, g, unknown or other
  misc_feature (279)..(279): n is a, c, g, or t
  modified_base (430)..(430): a, c, t, g, unknown or other
  misc_feature (430)..(430): n is a, c, g, or t
tcagagtatacatacacgaccggtgctcgatttagtagtgtagatttgggtttgggggagacggaaccatggaagccccagcgcagcttctcttcctcctgctactctggctcccagattccactggacaaatagtgatgacgcagtccccagccaccctgtctgtgtctccaggggaaanagtcaccctctcctgcagggccagtgagagtcttgacagctccttagcctaggtaccaacaaaggcctggccagccctccgaggcctcctctatttangatacatccacgacgggcctacgtggtctcccagccgaggttcacgtgggtcggtgggtcgtgggacagtacgttcacttctacacctatcagtcacgccgtagctagtctagtaagtttacttttactattttaatacgtgttacgagtntacgttatacggttaagttggtaccgttacggtacggtttacggaccggtaagggtaccgtaagggtacggtaaacggtacaaaccggtacgttggtcgggtacctacggactaccgtagttaccgttgttcctttacccgactttccccgttacccggaccttacgtttaccgttacgtacgtttacgttacgtttaacttccgtggttaacggg

SEQ ID NO: 161945 - DNA, 732 bp, Homo sapiens
  misc_feature: GYAE6OF02IF3FS.48.25.C03.1.454.CMB.1.raw
  modified_base (139)..(139): a, c, t, g, unknown or other
  misc_feature (139)..(139): n is a, c, g, or t
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
tcagagtatacatacacgaccggtgctcgatttagtagtgtagatttgggtttgggggaggaactgctcagttaggacccagacggaaccatggaagccccagcgcagcttctcttcctctgctactctggctcccagnttccactggacaaatagtgatgacgcacgtccccagcccaccctgtctgtgtctccgaggggaanagtccaccctntcctgcgagggccaggtgagagttcttgacagcctccttagcctggaaccaacgaaacggccgtggccacgcctacccgaggcctccctntatttagngtactacctactaccccgacgtacgggcctacgtcggttccgtcccgacgtaccgtaggttccaacggtgggcgggttcggtcgtaggggactaaggtacgttccgaactcctaccgaactacgtccgtaacggactaccggtccgttggactacggttactaacggtaaatttaacgtttttaaccgtaatttttaaccgttaccgtttcgtaacgtacgtacctaaaggttacgttacggtaaggtacgggtaccgttaccggttaacgggttttcggaaacccggtaacggggtaacgtaaacggggttaggtaaacgtaacgtaaacgtcgtacgggttcgtacggtacgaccgtaacctacttccgttagttcccttaacgtaccttcccggtttacccgtaccctagttccgg

SEQ ID NO: 161946 - DNA, 891 bp, Homo sapiens
  misc_feature: GYAE6OF02HCQ6E.48.25.C03.1.454.CMB.1.raw
  modified_base (204)..(204): a, c, t, g, unknown or other
  misc_feature (204)..(204): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccacccttgtctgtgtctccgaggggaangtcaccctctcctgcgagggccagtgagagtcttgacagctcgttacgcctcggtaaccaacaaacggcctggaccacggccctacccacgggccttcccgtactaacttttagtaggtaacttaacctaacgttacccgtaacccgaccggggtaccctaacggtttcgggtaccggtaccccacggtaccccgtacgggttttaccgtacggttccggggccgggggtttcggggtttaccgggtacgggggtaaccgtaacgggtaacgggtttacccgtactttaccccgttaccgtaacccctacgttacccgaacgggtaccgtaacgtccccgttaggtcccgtacgggtttaaccgtaacgggttaaacggttttaaccttttttaaaacgtttacgttttttaaacgtttaaccgtttaggttaccgtaaacggttacttaaacggtttacgttacggtttaaacgggttaccgggttaaccttacccggggtttaaccggtttccgggaacccgggtaaacggggttaaacccgtaaaggggttaacggaaaccgttaaccggtaaaaccggtacggttacggtacggttaccgtacgggtaccctaacgtcttaaccggtttcgtacccttttacgtaccgttttaccccgttcccggtaccttaccgtttaccgg

SEQ ID NO: 161947 - DNA, 730 bp, Homo sapiens
  misc_feature: GYAE6OF02HWCCJ.48.25.C03.1.454.CMB.1.raw
  modified_base (182)..(182): a, c, t, g, unknown or other
  misc_feature (182)..(182): n is a, c, g, or t
  modified_base (300)..(300): a, c, t, g, unknown or other
  misc_feature (300)..(300): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagccaccctgtctgtgtctccgaggggaaagngtcaccctctcctgcgacgggccagtgaggacgttcttgactagccttccttacgcccttaggtaaccaaacgaaacggcctcggccacgccctcccgaggcctcctactatttacgngaactaccactcccaaccgtacgggccctacgttcgggttccgtaccccgtaggcccgttagggttcctaccggtcggggtcggggttcgggtccgtaggggacctagggtacgttccacgttcctaccgaaccgtatccgacggtacctacggtcccgtgacctacggttcgtaaggtaagtttacttttaacttaatttttacttacgttagtacgagtacgtagttaacgttacggttaagtccggtaccgttaccggttacggtttccggaaccggtaaacgggtaccgtaagggtacggtaaacgtaccgtaaacggtacgtggtacggtactcgacctaccgtattcgttcgttaccttacgcctttcccgttaccgaccttacgttacgtacgtaacttacgttacgtaacttcgtgtacggg

SEQ ID NO: 161948 - DNA, 852 bp, Homo sapiens
  misc_feature: GYAE6OF02IJV8K.48.25.C03.1.454.CMB.1.raw
  modified_base (203)..(203): a, c, t, g, unknown or other
  misc_feature (203)..(203): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccgtgtctgtcgtctcgagggaagngtcacccgtctccgtgcgacgggccagtcgagacgtcttacgactacgccttaccgttacgcctacggaaccctaaacgaacggtccgtaccggacccgtaccgtccccgtaccccgtagggtccccttacccttacttaaagttttaccgagtaacccgttacctaaccgtccctaacccggacgggtaccctacggttcgggttacccgttacccgaccggtaccgtaccggttaccgtaccggtggggtccgggttcgggttcgggtacggggtaccggtaggttaccgttacccgtaaccttccctaccgtacccgtaacgttccgaaccggtaccgacgtaccgtaccggtacgtaacggtttcggtaacggttaaacggtttactttttaacgttaacgttttaaccgttacgtacgtttacgacgttacgtacgtttaaccgttacggtttaacggtacgggttaccgttaccgggtttacggttaccgggtaccggtaaaccgggtaacgttaacgggttaacgggtaacgttaacccggtaagtaccggttcggtacggtaccgtacggtacccgtaacgtcggttccgtttaacgtctttaccgtacccgtttacccggacccgttattaccgttacgg

SEQ ID NO: 161949 - DNA, 818 bp, Homo sapiens
  misc_feature: GYAE6OF02HMT30.48.25.C03.1.454.CMB.1.raw
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagcccaccctgtctgtgtctccgaggggaaagacgtccaccctctcctgcagggccaggtgagtagtcttgacagccttcttagcctaggtaaccaaacgaaacggcctagggccacgtcccgtacccgacgggtacctcccttactaagttttactacgacttaccacgtccccgaaccgacggggtaccctacggtgggtaccgttcccgaacggtacccgtacggggtttccacgggtcggggtccggggtttacggggtcgttacggggaacctagggttccgtttacctaccgtcccttacccgaaccctacgttaccgacggtaccgaccggtacccgtacgggccgttaacgttaccgttaaaggttaacgttttaacgtttttaactttaagtttttaacgtttaccgttcgttacgtacgtacgttacgtttagttacgtaacggttcggttaaccgttccgggtttacgttcgggaccgtaaagggacccggtaagggtacggtaaacgttaacgaaacggttacgttacggtaccgtcgttacgaccaacgtacttaccgttcgttaccttaccgttaacttcccccggtttacccgaccgttaacgttccgtaacggttgttaactttacggtaactttaccggtacgttaacggg

SEQ ID NO: 161950 - DNA, 766 bp, Homo sapiens
  misc_feature: GYAE6OF02H1B8H.48.25.C03.1.454.CMB.1.raw
  modified_base (129)..(129): a, c, t, g, unknown or other
  misc_feature (129)..(129): n is a, c, g, or t
  modified_base (186)..(186): a, c, t, g, unknown or other
  misc_feature (186)..(186): n is a, c, g, or t
  modified_base (199)..(199): a, c, t, g, unknown or other
  misc_feature (199)..(199): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactntggctccagattcactggacaaatagtgatgacgcagtccccagccacctgtctgtntctcgagggaaangtcacctctctagctaggccagtgagagttctgacagtccttccttagcctaggtaaccaaacgtaaacggcctacggtaccaacggtccccttaccgaagggtcctaccttacgtaacttttagacgtacgtaacctaacgttaccccggaaccgtacggggtaccctaacgggtttacgggttacccggttaaccccaacgggtaccgttaacggggttaccgaaccggttcgggggtaccgggttacgggttcgtacgggggaccgtaggttaacggttccctacctttacgcccgtaactacgtcgtaacgacgtaccgccttcgacctaagtctaacgtaaacgttcttttaacttaagtttacttaccggtattcggtagtaccgttattagtaccgtaaggtacgtacgttaccggttacggttcgtaaccggaaacgggaactaacggggttaacgaaggttaaccgaaattaccggtaagttcggactccggttaccaacgtcggtttaacctcgttacttacccgtaacgtttcccacccccggttattactaccgg

SEQ ID NO: 161951 - DNA, 635 bp, Homo sapiens
  misc_feature: GYAE6OF02FLFZ5.48.25.C03.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccacctgtctgtgtctccgaggggaaangtcacctctcctgcagggccagtgagagtctagacagtctcttagcctaggtaccaacgaacgcctggaccagccctccgaggcctcctctatttangactacacgtccaccgaggcctacgtcggtacgtacccaggtccgtacggtttacacgttgggcgggttcgggtcgtaggggacaggtacgttcgtacttctacgtaacctagtaccaggtacctacgccgtgactaggttcagtaagttacttttataacgttttactcgtagttacagtactagtagttacgtaaggtcgtaccgttcggtacgtttacggacgtaaacgggacgtaagggttcggaaataccgaaacgtacgttacggtacgtacgtcggactaacctagttcgttacgttccttacggttacttcccgtacccacttatcg

SEQ ID NO: 161952 - DNA, 626 bp, Homo sapiens
  misc_feature: GYAE6OF02JBBFY.48.25.C03.1.454.CMB.1.raw
  modified_base (181)..(181): a, c, t, g, unknown or other
  misc_feature (181)..(181): n is a, c, g, or t
  modified_base (383)..(383): a, c, t, g, unknown or other
  misc_feature (383)..(383): n is a, c, g, or t
  modified_base (415)..(415): a, c, t, g, unknown or other
  misc_feature (415)..(415): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
  modified_base (548)..(548): a, c, t, g, unknown or other
  misc_feature (548)..(548): n is a, c, g, or t
  modified_base (562)..(562): a, c, t, g, unknown or other
  misc_feature (562)..(562): n is a, c, g, or t
  modified_base (608)..(608): a, c, t, g, unknown or other
  misc_feature (608)..(608): n is a, c, g, or t
  modified_base (620)..(620): a, c, t, g, unknown or other
  misc_feature (620)..(620): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcagtccccagcccaccctgtctgtgtctccgaggggaangtcaccctctcctgcagggccagtgagtagtcttagacagccttccttagccttggaaccaaacgtaacggcctaggccacgtccctcccgaggtcctcctctattttactgacttaccactccccgaaccgacgggaccctacgttggggttcctaccccggagacccgtaggttccacggtcgggtcgggtcgggttcgnggggacaggtcgttacacgttctaccaacgtntacacgtcaaccgtctgacctagtctaggtaactttatttacttagttttactagtnttanacgtactagttactgtaagtcgtacttcgtgtacggacaagggaccaggtacgactanaacgtntggtcgtnacgctacgacgttncttagtcctaccttccgtaccgacttcgttacgtctaattacgttntaccttacgttnaacggg

SEQ ID NO: 161953 - DNA, 781 bp, Homo sapiens
  misc_feature: GYAE6OF02H3QG7.48.25.C03.1.454.CMB.1.raw
  modified_base (176)..(176): a, c, t, g, unknown or other
  misc_feature (176)..(176): n is a, c, g, or t
tcagagtatacatacacgaccggtgctcgatttagtagtgtagatttgggtttgggagacggaaccatggaagccccagcgcagcttctcttcctcctgctactctggctcccagatttccactggacaaatagtgatgacgcagtcccagccacctgtctgtgtctccagggaancgtcaccctctcctgcaggccagtgagatcttagacagtaccttccttagcctacggtaccaaagaaacggcctaggaccacgtccctccacggtcctccgttactatttagtgtactaaccgtataccgaccgagggaccctagtacggttcgtacccgacggtccgtacggttacctaccggtcgggtcggttaggggttccttacggggacctacgtacggttacctacgtacctccggtaacctacgtaccgaccgaacgtacgtacccgtttgaacccgttggttaacgttacggtaaacgtttaagttttttaaccgtttaaagttttttaaaccgttttaaccgtttacgttacccttaacggtaacgtaacggtttaacgttaaccggttaagggttaccgtaaccgtttacccggttaaccggtttacggacccgtaaacgggtaccggtaaagggtcggtaaaaggttaacgtaaacccgtagttaaggacgttaccgtacgaaccgtacgtacgttacttacgttacttaccgtacgttacctacccgtactacttcgacgttacgtaccttacgtacttaccgtacgttacgg

SEQ ID NO: 161954 - DNA, 860 bp, Homo sapiens
  misc_feature: GYAE6OF02GCIO6.48.25.C03.1.454.CMB.1.raw
  modified_base (308)..(308): a, c, t, g, unknown or other
  misc_feature (308)..(308): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaagagtccaccctctcctgcgagggccagtgagagtctgacagctcctagcctggtaccaacaaggcctggccagccctccgcggcctcctctatttatcgatactntcccaaccgacgggacccacggtcggtccgtacccaggtacccgtacggttcgacggtacgggtccggggttggggttccgttacgggggaaccagggttaccgtttacgaccgttcctaaccctaacccgtacttaccggacgacccgtaacggtacccgttggaccgttacgtaccgtttaagggtaaacgttttaacttttttaaacctttaacgtttttaaaccgtttccgttacggttacgtaaacgttaccttaaagggtttaaccggttaccggttaaagggtttcccggttaaccccggtttaaccgggtttaacccgggttttaccgggggaaacccggttaaacgggggttaaacccgggtaaacgggggtttaaccgggtaaaaccggttaaaccggtaaaaccccgggttaacggttacggggttaccgggtacccgttaacggttaaccccgtaaccgttaaccgtttccgtttaacggtttaccctttaaccggttcccgttttaacccccgttaccccgtacgttacccggttaacc

SEQ ID NO: 161955 - DNA, 782 bp, Homo sapiens
  misc_feature: GYAE6OF02HRKMZ.48.25.C03.1.454.CMB.1.raw
  modified_base (228)..(228): a, c, t, g, unknown or other
  misc_feature (228)..(228): n is a, c, g, or t
tcagagtatacatacacgaccggtgctcgatttagtagtgtagatttgggtttgggggtagggaactgctacagttaggaccgagacgggaaccatggaagcccagcgcagcttcctcgttcctcctgtctactctggctccagattccactggacaagtaggtgatgacgcacgtcccagccacccgtgtctgtgtctcgaagggtaagacgtcgacctcgtcgtcncgaggccagtgagattctagacgcgtcttacgttacgcgtacggtaaccaacgtaaaacggtcctaacggtaaccacgtaccgtcccgtaacggtcctaccgtactaacttacgtacgaactacgtactaccgaaccgacggtcctaacgttcggtacgttcccgagaccgtacggtcgacggtcgggtcggacggttccgtaacggacgtaggtactcgacgtacggtctaacgtacgacgtacgaccgtcgtaccgttcgaacttacggtaaccgttagtaaaccggttattttaacgttaacgtttagtttaccggacgtttacgacgtttaacgtaggttttacgaacggtttaccgtacggtaaccgttacggttacggtttacggaaacggttaaccgggtaactaaggggttaacgtaaacgttaaccggtaaacgttacgtttaccggggtactacccggttaaccggaacgtaacccgttaggtacgtttaccggtacctttaaccggtaccttttaccccgggttactaacccgtgttaacccg

SEQ ID NO: 161956 - DNA, 746 bp, Homo sapiens
  misc_feature: GYAE6OF02HO3KR.48.25.C03.1.454.CMB.1.raw
  modified_base (183)..(183): a, c, t, g, unknown or other
  misc_feature (183)..(183): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacgcacgtccccagccacctgtctgtcgtctccgaaggggaagngtaccaccctctcctgcgacgggcctaggtgagtagtcttacggacagtccttaccgttacgtccgttacggtaaaccaaacgaaacggtccgtacgggaccaccgtacccgtacccgtacggtcccttccgtacttaagtttactacgtactaaccgtactacccgaccggacggtaccctacggttcggtaccgtaccgtacggtaccgtaacggttctaccggtcggggtcgggttcgggtcggtacgggtaacgtacggtacgttccgacttcctaccgaacctactacgacgccgtacgcgtacgcgtacgttacgtagtaattttaacgtttactttattttacgttactcgtactagtacgttaagtagtcggttaaggtacgtccgttacggttacggttacggaccgtaacgggtacgacgggttaacgaacgttaacgtaaaccgtcggtaggtacgtccgtacgtaccgtacttagttacgtccttacgtccgtaacttcccgtaccgctacgttagtcgttaacgttattacgtacgttacgtggtaacgg

SEQ ID NO: 161957 - DNA, 1027 bp, Homo sapiens
  misc_feature: GYAE6OF02GN42X.48.25.C03.1.454.CMB.1.raw
  modified_base (165)..(165): a, c, t, g, unknown or other
  misc_feature (165)..(165): n is a, c, g, or t
  modified_base (179)..(179): a, c, t, g, unknown or other
  misc_feature (179)..(179): n is a, c, g, or t
  modified_base (191)..(191): a, c, t, g, unknown or other
  misc_feature (191)..(191): n is a, c, g, or t
  modified_base (325)..(325): a, c, t, g, unknown or other
  misc_feature (325)..(325): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatgtgatgacgcagtccccagccaccctgtctgtntctcgaggggaaangtcacctctccngcagggccagtgagagttcttgacagtccttaccttacgccgttacggtaacccaaacgaaaacggtcccgtacgggaccctaacgtcccccgttacccgacggggtccttccccgttacgttaactttttaancggtaactttaacctaactacccccgtaaccggacgggggtacccctacgtttacgggggttacccggttacccccaaggtaccccgtttaacgggggtttcctaaccggtttcgggggtccggggttttcgggggttacggttaccggggtaaaccggtacggtttaaccggttaacccgtacctttacccgtaaccgtaacccgagttaaccgaaccggtacccgaccggttacccgttacggggaccgtaaccggtttacccgttaaagggtaaaccttttttaaaacgtttttttaaccggttaaacttttttttaaacgtttacccggtttccgggttaactttaccgggtaaccgtttaaaacgggtttaaccggtttaaccgggtttaaaccggggttaccggtttaccccggtttaaccgggttttaacccgggttttacccggggaaccgggtaaaaccggggttaacccgggtaaagggggttacgggtaaaaccgttaaaaccggaaaaccgggtttagtaccgggttagggtacgttacccgggaaccttaacccgtttacgtacgttttacccgtttactttaaccggtaccccgttttacgttaccccccggtacgttaaccgtttaccgttaaggtttaccgttaccgtttaacggtttaccgtttcccgtttaacggttaccgggg

SEQ ID NO: 161958 - DNA, 853 bp, Homo sapiens
  misc_feature: GYAE6OF02JHDQN.48.25.C03.1.454.CMB.1.raw
  modified_base (192)..(192): a, c, t, g, unknown or other
  misc_feature (192)..(192): n is a, c, g, or t
tcagagtatacatacacgaccggtgctcgatttagtagtgtagatttgggtttgggggaggaactgctcagttaggacccagacggaaccatggaagccccagcgcagcttctcttcctcctgctactctggctcccagacttccactggacaaatagtgatgacgcagtccccagccacctgtctgtgtcnccgaaggggaagcgtccacccttctcctgaccagggcccaaggtcgagtacgttcttacggacacgccttcgttagccgtacgtaaccaaacgtaaaccggaccgtcggaaccacggtcccctaccccgtaaagggcccttaccgttacctaagttttaacgacgtaactaaccgttacttaccccgaaccgaaggggtaccctaccgttacgggttacctaccccgaacgggttccgtaaaccggtttccgtaaacggtttcgggggaccgggtttacgggtccggttacgggggttaaacccagggttaaccgttttacggaaccctttccggtaaaccgaccccgtaattacccgacggacaccggttacccgtcgtaccgtacgttacgttacgaacgttaacttttaacttaatttaacttacgttacgttacgttacgtacttaacgttacttacggttaaagttacgggtaacttaccgggttaaccggttaccgggtaaccggttaaacggtaaccgtaaaccgggttacggtaaacggtaaccgtaaacggtaacggtaggttacggtacgtaccgtaaccgtaaccgttaacgttacgttaccgttacgttaccgttaccttacctttaccccggtacctaaccgttaccg

SEQ ID NO: 161959 - DNA, 833 bp, Homo sapiens
  misc_feature: GYAE6OF02JDEZD.48.25.C03.1.454.CMB.1.raw
  modified_base (145)..(145): a, c, t, g, unknown or other
  misc_feature (145)..(145): n is a, c, g, or t
  modified_base (551)..(551): a, c, t, g, unknown or other
  misc_feature (551)..(551): n is a, c, g, or t
  modified_base (692)..(692): a, c, t, g, unknown or other
  misc_feature (692)..(692): n is a, c, g, or t
  modified_base (761)..(761): a, c, t, g, unknown or other
  misc_feature (761)..(761): n is a, c, g, or t
  modified_base (823)..(823): a, c, t, g, unknown or other
  misc_feature (823)..(823): n is a, c, g, or t
tcagagtatacatacacgaccggtgctcgatttagtagtgtagatttgggtttggggagacggaaccatggaagccccagcgcagcttctcttcctcctgctactctcggctcccagtacttccactggacaaatgtcgatgacncacgtccccagccacctgtcctgtcgtctaccgaaggggaaactcgtcctacccttctccgtaggaccgacgggtccctaaggtcggtacgtacgttcctttgaaccgtacggttcctaccgtttacggcccgttaggtaaaccccaaaacgaacgggtcccttcgggacccttacgtcccctacccgtagggtacccttacccgtacgtacttttaacgtaggaaccttacgtaacttaccccacggtaccggtaccaaccggttgggttacctacccctacggacccgtacggttacccgacgttacggggtccggttcggggttaccttacgggggacctacggttacgttaccgacccttacgtacccaacccgtagttccaacggtcctacgacccgttanaccgtcgtaccttaaggtaacctttaacgtttttaccggtttaatttttaacgttacgtttacgtaccgaggttcccgtaagttaccgttacggtaacgtaccgggttcgtacccggttacggttacgtaccgaaacggtntaacgggtacggtaactaagaaccgttacgtaggtaccgttacgtggtaaccctagttacgtaccgttnttaccttacctacggttccctccgtcctaacgttccctaagactttactccgtaacttaccncggttaccgg

SEQ ID NO: 161960 - DNA, 892 bp, Homo sapiens
  misc_feature: GYAE6OF02IA8UZ.48.25.C03.1.454.CMB.1.raw
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
  modified_base (341)..(341): a, c, t, g, unknown or other
  misc_feature (341)..(341): n is a, c, g, or t
tcagagtatacatacacgaccggtgctcgatttagtagtgtagatttgggtttgggggaggaactgctcagttaggacccagacggaaccatggaagccccagcgcagcttctcttcctctgctactctggctcccagattccactgacaaatgtgatgacgcacgtcccccagcccaccctgtcctgtagtcctccgaagggggaaagacgtaccacccctctccctggacacgggccagtgagngttctgacngtcttcctagccgtacgtaaccaacgaaacggtctacggaccacgcctacccgaggtccttacctacttatttagacgtactaacncgtacccgaaccggacggacctacggtcggtacgtacccgacggtcccgtaacggtttccgacggttcggggtaccggggttaccgggttcggttacgggggtaaaccgtacggttacggtttacccgtaaccgttaccgtaacccggtaaaaccctacggttaccgaacgggtacctaaacccgggtcctttagggaaccctttaacgggttaacggttaccggtttaaaagtttaacgtttttttaaacttaacttttttaaccgttacgtttaagttacccggtaaagtttaccgtaaacggtttaagttaaaccgggtaacggtttaacggttaacccggtttacccgggttttaaacgggttccgtaaaacccgggaaaccggggttaaccgttaaaacggggttaagggtaaaaccggtaaacggtaaaaccgggttacgggttaccggttaacgggtaccgtaacggttacccgtaaccggtaaactttcggttacgtttacgttaccttacccggttccgtttaccccgtaccctagttaacg

SEQ ID NO: 161961 - DNA, 783 bp, Homo sapiens
  misc_feature: GYAE6OF02IGS5Q.48.25.C03.1.454.CMB.1.raw
tcagagtatacatacacgaccggtgctcgatttagtagtgtagatttgggtttggggggaggaactgctcagttaggacccagacggaaccatggaagccccagcgcagcttctcttcctcctgctactctggctcccagattccactggacaaatagtgatgacgcagtccccagcccacctgtctgtgtctcgaaggggaagtcgtccacccgtctcctgcgaggccagtcgagtagttcttagacgacgtcttccttagccgtaggtaaccaaacgaaacggtcctaggcccacggtcccctccgaacgggtccctaccgttactaagtttttactagtaacttaaccgtacgtacccaccggaacggggtccctaacgtttcgggtaccgtacccctaaggcccgtaacgggtttaccaccggttgggccggggtttggtcggtacggggtactaagggtaccgttttacgacgttccctacgtaaccgtaactccgtaagtacccgacgtaccgttacggtcgtaacgtttaccgtaaggtaaacgtttttaacgtttttaaaccttaatttttaaccgtacctttcggtaacctagtaccgttaagttaacgttacggttaacgtggtaccgtttaccgggtaacggtttcggaaccgtaacggggtactaacgggtaggaaacctacgtaaacgtacgtaggttcggacttcgaaccgttacgacgtttacgtaccgttccgttacgtactttcccgtacccgacctaggttaccg

SEQ ID NO: 161962 - DNA, 902 bp, Homo sapiens
  misc_feature: GYAE6OF02FQ0QS.48.25.C03.1.454.CMB.1.raw
  modified_base (154)..(154): a, c, t, g, unknown or other
  misc_feature (154)..(154): n is a, c, g, or t
  modified_base (183)..(183): a, c, t, g, unknown or other
  misc_feature (183)..(183): n is a, c, g, or t
  modified_base (222)..(222): a, c, t, g, unknown or other
  misc_feature (222)..(222): n is a, c, g, or t
  modified_base (321)..(321): a, c, t, g, unknown or other
  misc_feature (321)..(321): n is a, c, g, or t
tcagagtatacatacacgaccggtgctcgatttagtagtgtagatttgggtttgggggagacggaaccatggaagccccagcgcagcttctcttcctcctgctactctggctcccagattccactggacaaatagtgatgacgcgaggtcccanccacctgtctgtgtcctccgaaggggaanacgtccacccttcttccgtcgcgacgggcctagtcgagngttctacgacgcgcttccgttagccgttacggtaacccaaacgaacggccgttacgggcccacggcccgttaacccgaggcctcccgtactactttacncggttaactaccacgtcccaccgacggtccaacgttcggtatcccgacggcctacggttcaccgggtggacgggttcgggttacgaggggtacgtaaggtcgtttaccgccgttcctaccgtaaccttaactaccgttaacgaccggtacggtacccttaccggggtaccgtacgggttttacctaaagggtaaacgttttaacctttttttaccggtttaaactttttttaaccggtttaacgttttaaccgggtttacgttcgggtaaaccgtttacgtttaaagggttaccggtttaaagggttcgggttaaacccttttacggtttcggtttttaaaccgggaaccggggttaaacggttaaccggggtaacgggtttaacgggtttaaaccgaaaccgggtaaaccggtttaaaccgggtttccggttaaacgggttacccgtaccgtaaccgtaaaccttcggtttaccggttcttaaccggttactaacccggttccccggttacccgtaaccgttacccgttaccgttacgtacttaaccgttaccgttaacggttacgtaccgttaaccggg

SEQ ID NO: 161963 - DNA, 814 bp, Homo sapiens
  misc_feature: GYAE6OF02ICZTG.48.25.C03.1.454.CMB.1.raw
  modified_base (187)..(187): a, c, t, g, unknown or other
  misc_feature (187)..(187): n is a, c, g, or t
  modified_base (229)..(230): a, c, t, g, unknown or other
  misc_feature (229)..(230): n is a, c, g, or t
  modified_base (755)..(755): a, c, t, g, unknown or other
  misc_feature (755)..(755): n is a, c, g, or t
  modified_base (782)..(782): a, c, t, g, unknown or other
  misc_feature (782)..(782): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgaacgcacgtccccagcccaccctgtctgtgtcctccgaaggggaaagngtccaccctctcctgcgagggcctaggtgagtgtcttagacnncttccgttacgccgtacggtaaccaaacgtaaacggccgtaggaccacggtcccgtacccgaggtccctccgttaacttaacttttaagtacgtaaacttaaccgtaacgttaccccgaaccggaacggggacccttaacggttcgggttaccgtacccccgtacggtacccgttaacgggtttacccaccgggttcgggggtacccggggttttaggggtacccgggttaacggggtaaaccgttaacggggttaccgttttaccgtaaaccgttaccgtaccctaaaccgtaccttacggaactacggaccgtacccgtcgacgttacggtacgttaaggtaacttttaacgtttttaacttagtttttaacgttacgttaggtactagtacgttagtaacgttacggtaacggtcgttaaccgttccgggtttaaggttacggaaccgtaaggggtaaccgtagggtaacgtaaacgtaacgaacgtacgttacggtcggtactcgaactaccgtagttccncgttacctcgtaccttactccctagtncgttaactagacgttcgtaacttggtgtacgg

SEQ ID NO: 161964 - DNA, 739 bp, Homo sapiens
  misc_feature: GYAE6OF02IBYQ5.48.25.C03.1.454.CMB.1.raw
  modified_base (142)..(142): a, c, t, g, unknown or other
  misc_feature (142)..(142): n is a, c, g, or t
  modified_base (181)..(181): a, c, t, g, unknown or other
  misc_feature (181)..(181): n is a, c, g, or t
  modified_base (548)..(548): a, c, t, g, unknown or other
  misc_feature (548)..(548): n is a, c, g, or t
  modified_base (690)..(690): a, c, t, g, unknown or other
  misc_feature (690)..(690): n is a, c, g, or t
tcagagtatacatacacgaccggtgctcgatttagtagtgtagatttgggtttggggagacggaaccatggaagccccagcgcagcttctcttcctcctgctactctggctcccagattccactggacaaatagtgatgacncagtccccagccaccctgtctgtgtctccgaggggaaanacgtcaccctctcctgcagggtccagtgagacgtcttagacagctccttagcctaggtaccaacgaacggcctacggccacgcctccgaggcctacctcgtaatttacgtacgtaactaccactaccccgtaaccggaacggggtaccctaagttccgggttaccgtaacccgtacggtcccggtaacggtttaccgtaccgttcggggcccggggtttacggggttaccgttacgggggaacctaggggttaaccgttccgtaccgttacctacccgtaactacgtaccgaacgtccgtacggtccttggactagttcccgtaaggtaacgttttaacttttactttaacttttagtttaaccgtnttacgaacgtagtaacgtagttacggtaacggttacgtaaccgttaccgttaccggtttacggaccgtaacggtaccggtaaggtacggtaaaccgtacgaacgtacgtagtcgcgtacgacacgtatcttagtactttacnccttcctacccgctacgttacgtctactcgttacgtattccgtgtacgg

SEQ ID NO: 161965 - DNA, 910 bp, Homo sapiens
  misc_feature: GYAE6OF02GJ1U6.48.25.C03.1.454.CMB.1.raw
  modified_base (225)..(225): a, c, t, g, unknown or other
  misc_feature (225)..(225): n is a, c, g, or t
  modified_base (849)..(849): a, c, t, g, unknown or other
  misc_feature (849)..(849): n is a, c, g, or t
tcagagtatacatacacgaccggtgctcgatttagtagtgtagatttgggtttgggggaggaactgctcagttaggacccagacggaaccatggaagccccagcgcagcttctcttcctccgtgctactctcggcctcccagtacttccacgtggaacaaatagtgagtgacgacacgtcccagcccacccgttgtccgtgtcgtccgtaccggaaggggtaaanacgtccctacccttctccgtcgacggacgggtccagggtcgaacggtacgttcgttacggacctacggtccttaccgttacgcccgttaacggttaacccaaaaccggtaaacggtccccgtacgggtacccgtaaccgtccccgttacccccgtaacgggccccttaccccgttaacgttaactttttaacgtacgggtaaccttaacctaccgttaaccccgaaccccggtaccggggaaccccttaccgggtttccgggtttaccccgttaccccgaacggtaccccgtttaacgggttaccccgtaaccgggttccggggtaccggggttcggggtttcgggtaaccggggaacgtacgggttacggttttaccccgtaccgttaacctaacccgaaccgttaacgtacgaaccggtaccgtaaccggtccgtacggtacccgttaaggttaccgtaaaggttaaacgttttaaacgtttttacttaacgtttttaacttacgtagttaccgagtacttacgttaacgttacggttacggtacgtaccgttccggttacgttccggtaaaccggtagggaacccagggttagtaaccgtaagtaacgtacgtcggtacgngtaccgtactaacgtcttccgtagttacctacttacccgaccgttccgtacgtacttacgg

SEQ ID NO: 161966 - DNA, 714 bp, Homo sapiens
  misc_feature: GYAE6OF02IM6OY.48.25.C03.1.454.CMB.1.raw
  modified_base (181)..(181): a, c, t, g, unknown or other
  misc_feature (181)..(181): n is a, c, g, or t
  modified_base (220)..(220): a, c, t, g, unknown or other
  misc_feature (220)..(220): n is a, c, g, or t
  modified_base (264)..(264): a, c, t, g, unknown or other
  misc_feature (264)..(264): n is a, c, g, or t
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
tcagagtatacatacacgaccggtgctcgatttagtagtgtagatttgggtttggggagacggaaccatggaagccccagcgcagcttctcttcctcctgctactctggctcccagacaccaccggagaaattgtgttgacgcagtctccaggccaccctgtctttgtctccaggggaaancgccaccctctcctgtaggccaagtcaagactagttaanagcctacttcttagcctcggtaccagacaaaacgtgccacgccnccgacgcctcctacactctagtggtcgtcgacccaccggnggtacccagtcgaccactcccgaagtacgtacggtttacgnggtacggtcagggttcggtcgagggactagtactcacctcgaccacactaccgacgacgtacgtcggacgtcgtataagttcgttacttttagaacgttttcgttttcgtttttacggacgttaccgtaggtcccgtaaggtttacgtaacgggtaacctttaccgaaccgttcggttaccgtaacggttcccgggtaccgggaaacgggtaacccggtaaagggttaacgtaaaccgaacggttaaaccgtacgttagggtacgaccgtagaaccgtacctagttactccgttaacgttcctaccctttacccggcctaaccgcgtttaacgacttaagttaccgtcgttaacgtccgtaaggtccgg

SEQ ID NO: 161967 - DNA, 800 bp, Homo sapiens
  misc_feature: GYAE6OF02GGHQN.48.25.C03.1.454.CMB.1.raw
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
  modified_base (526)..(526): a, c, t, g, unknown or other
  misc_feature (526)..(526): n is a, c, g, or t
tcagagtatacatacacgaccggtgctcgatttagtagtgtagatttgggtttgggggaggaactgctcagttaggacccagacggaaccatggaagccccagcgcagcttctcttcctctgcttactcgtggctcccagattccactggacaaatagtgatgacgcagtccccagcctacctgtctgtacgtctcgagggaangttccacctctccgngacgtaggcctagtcgagtacgttcgtagacgtacggtctaccgttacgccgttacggtaaccgaacgtaaacgggtcccttacgggacccgtaaccggtcccccttacccgaacgggttcctacccccgtttagtaaccgtttttaaggtacgttaacctaactcccgttaaaccccgaccggttaccggggacccttacggtcgggttaccccttaccgaaccgtacccggtacggtttacctaacggggtccgggggtacgttccggggttacgtacggggtacaaacggttcgttttaacccnccgtttataccccgtactagtacccaggtccgtaacggtccctcggtaactcggtacgtacgtaagttacgtttaactttacgtttacttacgttacgtactagtaccgttagtacgttgtaccgttcggtacgttaccggtacgttcggtaccgaacggtaaccggtaagtaccggtaagtaaccgaaacggttcgtacgggtacgacgtccggtaatacgttaccttcgttaccgtcgtttactacccggttccctaccgtactacttacgg

SEQ ID NO: 161968 - DNA, 130 bp, Homo sapiens
  misc_feature: GYAE6OF01DFMDT.35.25.C03.1.454.CMB.1.raw
  modified_base (130)..(130): a, c, t, g, unknown or other
  misc_feature (130)..(130): n is a, c, g, or t
tcagtacagatcgtcacgaccggtgctcgatttagtagtgtagatttgggtttgggcacagcggccctgggctgcctggtcaaggactacttccacgatctgtactgagcgggctggcaaggcgcatagn

SEQ ID NO: 161969 - DNA, 144 bp, Homo sapiens
  misc_feature: GYAE6OF01DYX44.35.25.C03.1.454.CMB.1.raw
  modified_base (129)..(144): a, c, t, g, unknown or other
  misc_feature (129)..(144): n is a, c, g, or t
tcagtacagatcgtcacgaccggtgctcgatttagtagtgtagatttgggttgggcacagcggccctgggctgcctggtcaaggactacttccacgatctgtactgagcgggctggcaaggcgcatagnnnnnnnnnnnnnnnn

SEQ ID NO: 161970 - DNA, 174 bp, Homo sapiens
  misc_feature: GYAE6OF01BCAGB.35.25.C03.1.454.CMB.1.raw
  modified_base (173)..(174): a, c, t, g, unknown or other
  misc_feature (173)..(174): n is a, c, g, or t
tcagtacagatcgtcacgaccggtgctcgatttagtagtgtagatttgggtttgggggaagaggaagactgacggtcccccaggagttcaggtgctgggcacagcggccctgggctgcttggtcaaggactacttccacgatctgtactgagcgggctggcaaggcgcatagnn

SEQ ID NO: 161971 - DNA, 193 bp, Homo sapiens
  misc_feature: GYAE6OF01DT9ML.35.25.C03.1.454.CMB.1.raw
  modified_base (174)..(193): a, c, t, g, unknown or other
  misc_feature (174)..(193): n is a, c, g, or t
tcagtacagatcgtcacgaccggtgctcgatttagtagtgtagatttgggtttgggggaaggaggaagactgacggtcccccaggagttcaggtgctgggcacagccggccctgggctgcctggtcaaggctacttccacgatctgtactgagcgggctggcaaggcgcatagnnnnnnnnnnnnnnnnnnnn

SEQ ID NO: 161972 - DNA, 177 bp, Homo sapiens
  misc_feature: GYAE6OF01C1KAG.35.25.C03.1.454.CMB.1.raw
  modified_base (173)..(177): a, c, t, g, unknown or other
  misc_feature (173)..(177): n is a, c, g, or t
tcagtacagatcgtcacgaccggtgctcgatttagtagtgtagatttgggtttgggggaagaggaagactgacggtcccccaggagttcaggtgctgggcacagcggccctgggctgcctggtcaaggactacttccacgatctgtactgagcgggctggcaaggcgcatagnnnnn

SEQ ID NO: 161973 - DNA, 173 bp, Homo sapiens
  misc_feature: GYAE6OF01B1DHO.35.25.C03.1.454.CMB.1.raw
  modified_base (173)..(173): a, c, t, g, unknown or other
  misc_feature (173)..(173): n is a, c, g, or t
tcagtacagatcgtcacgaccggtgctcgatttagtagtgtagatttgggtttgggggaagaggaagactgacggtcccccaggagttcaggtgctgggcacagcggccctgggctgcctggtcaaggactacttccacgatctgtactgagcgggctggcaaggcgcatagn

SEQ ID NO: 161974 - DNA, 133 bp, Homo sapiens
  misc_feature: GYAE6OF01A3Z4S.35.25.C03.1.454.CMB.1.raw
  modified_base (130)..(133): a, c, t, g, unknown or other
  misc_feature (130)..(133): n is a, c, g, or t
tcagtacagatcgtcacgaccggtgctcgatttagtagtgtagatttgggtttgggcacagcggccctgggctgcctggtcaaggactacttccacgatctgtactgagcgggctggcaaggcgcatagnnnn

SEQ ID NO: 161975 - DNA, 500 bp, Homo sapiens
  misc_feature: GYAE6OF01ENAGH.35.25.C03.1.454.CMB.1.raw
  modified_base (173)..(173): a, c, t, g, unknown or other
  misc_feature (173)..(173): n is a, c, g, or t
  modified_base (251)..(251): a, c, t, g, unknown or other
  misc_feature (251)..(251): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
tcagtacagatcgtcacgaccggtgctcgatttagtagtgtagatttgggtttgggggagaggagcccagcactagaagtcggcggtgtttccattcggtgatcagcactgaacacagaggactcaccatggagtttgggctgagcggtgttcgctaaggcgtcttaataggntcagtgtcagtgcagctggtgcagtctggggcggcgtggtccagcctgggaggtccctgagctctcctgtgaagcctntggatctcttcagacatgcatgcatggcgcnggctccagcaggcgtggngnggngngngngntntntntgagagagtaataanatagacagactacgagacgacgtactacacactctacagacgactaactacaacgaacactactctctctcacacactacgacgacgtacgtacggtacgtagacgacgacgtcgtcgtacgtacgttacgtgtgcgacgagacgtaacgtaatattagtgtgtag

SEQ ID NO: 161976 - DNA, 149 bp, Homo sapiens
  misc_feature: GYAE6OF01BQG41.35.25.C03.1.454.CMB.1.raw
  modified_base (131)..(149): a, c, t, g, unknown or other
  misc_feature (131)..(149): n is a, c, g, or t
tcagtacagatcgtcacgaccggtgctcgatttagtagtgtagatttgggtttgggcacagcggccctgggctgcctggtcaaggactacttccacgatctgtactgagcgggctggcaaggcgcaatagnnnnnnnnnnnnnnnnnnn

SEQ ID NO: 161977 - DNA, 174 bp, Homo sapiens
  misc_feature: GYAE6OF01BBA2N.35.25.C03.1.454.CMB.1.raw
  modified_base (173)..(174): a, c, t, g, unknown or other
  misc_feature (173)..(174): n is a, c, g, or t
tcagtacagatcgtcacgaccggtgctcgatttagtagtgtagatttgggtttgggggaagaggaagactgacggtcccccaggagttcaggtgctgggcacagcggccctgggctgcctggtcaaggactacttccacgatctgtactgagcgggctggcaaggcgcatagnn

SEQ ID NO: 161978 - DNA, 548 bp, Homo sapiens
  misc_feature: GYAE6OF01EYFQH.35.25.C03.1.454.CMB.1.raw
  modified_base (305)..(305): a, c, t, g, unknown or other
  misc_feature (305)..(305): n is a, c, g, or t
  modified_base (460)..(460): a, c, t, g, unknown or other
  misc_feature (460)..(460): n is a, c, g, or t
  modified_base (543)..(543): a, c, t, g, unknown or other
  misc_feature (543)..(543): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtggggggcggcgtggtccagcctgggaggtccctgagactctcctgtgaagcctctggattctccttcaagaactatggcatgcacgtcggggtccnccgaggctccgaggcaaggggctgggagtgggtgcagtgatatcatttgataggaaagtaaataaacagttacgacaagtacctccggtaggaacgggccgtaattccaacctatcctccaagacgaacaacttaccaagaacactctgtctctncaacatagaacagtcgtgggacctaggacggacacggctgtacttattacgtgtgcgagagaacgtaacgtaaattattgtgntaagg

SEQ ID NO: 161979 - DNA, 129 bp, Homo sapiens
  misc_feature: GYAE6OF01A0OFE.35.25.C03.1.454.CMB.1.raw
tcagtacagatcgtcacgaccggtgctcgatttagtagtgtagatttgggtttgggcacagcggccctgggctgcctggtcaaggactacttccacgatctgtactgagcgggctggcaaggcgcatag

SEQ ID NO: 161980 - DNA, 574 bp, Homo sapiens
  misc_feature: GYAE6OF01BTAR3.35.25.C03.1.454.CMB.1.raw
  modified_base (161)..(161): a, c, t, g, unknown or other
  misc_feature (161)..(161): n is a, c, g, or t
  modified_base (565)..(565): a, c, t, g, unknown or other
  misc_feature (565)..(565): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctggggtttttccncgttgtctcttttaagtaggtgtccagtgtcaggtggcagctggtggcagtcgtgggggcgggcgtggtccagcctgggaggtccctgagacctctcctgtgaagcctctggattctccttcaagaactatggcatgcactgggtccgccaggctccaggcaaggggctggaggtgggtggcagtgatatcatttgatggaaagtaataaacattacgcagactccgtagaagggccgattcaaccatctccagagactaacttccaagaactactcttgtcctcgtagcactatagtaacccaggttaccctggggaccctggaacgggaacctccgggtacttcggtaccttagtttaacgtgtagggccaaggtaacgattaaacgaaatttattgggtancgttaaagg

SEQ ID NO: 161981 - DNA, 174 bp, Homo sapiens
  misc_feature: GYAE6OF01DSKAK.35.25.C03.1.454.CMB.1.raw
  modified_base (174)..(174): a, c, t, g, unknown or other
  misc_feature (174)..(174): n is a, c, g, or t
tcagtacagatcgtcacgaccggtgctcgatttagtagtgtagatttgggtttgggggaagaggaagactgacggtccccccaggagttcaggtgctgggcacagcggccctgggctgcctggtcaaggactacttccacgatctgtactgagcgggctggcaaggcgcatagn

SEQ ID NO: 161982 - DNA, 633 bp, Homo sapiens
  misc_feature: GYAE6OF01B13TD.35.25.C03.1.454.CMB.1.raw
  modified_base (260)..(260): a, c, t, g, unknown or other
  misc_feature (260)..(260): n is a, c, g, or t
  modified_base (300)..(300): a, c, t, g, unknown or other
  misc_feature (300)..(300): n is a, c, g, or t
tcagtacagatcgtcacgaccggtgctcgatttagtagtgtagatttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagcctgggagtccctgagactctcctgtgaagcctntggattctccttcaagtactatggcatgcacgtgggtccnccaggcctccgaggcaaggggctgggagtgggtgctaggtgatagtctaagtttgagttaggaaagttaataaacgatttaccggcaaggtacctccggtaggaacgggtccgtacttccacccgtataccgtacccgaagtacgtaactaacttcccgaaagaacctaccttactacgtcctaccgtcgaccaactagtacgaaaccgtaggttaccgtacgggtaccctaggacggtaaccgtacggtaccttacggtaccgttaagttacgtggtacggtccgtaaggacggtaacgtaaacgtaaagttagtttcgtagtcgttaacgg

SEQ ID NO: 161983 - DNA, 743 bp, Homo sapiens
  misc_feature: GYAE6OF01A6ORG.35.25.C03.1.454.CMB.1.raw
  modified_base (178)..(178): a, c, t, g, unknown or other
  misc_feature (178)..(178): n is a, c, g, or t
tcagtacagatcgtcacgaccggtgctcgatttagtagtgtagatttgggtttgggggggtaggagggaggcccagcactagaagtcggcggtgtttccattcggtgatcagcactgaacacagaggactcaccatggagtttgggctgagctgggttttcctcgttgctctttaagnggtgtccagtgtcaggtgcagctggtgcagtcgtgggggcggcgtggtccagccgtggggacggtcccgtgacgactctcctgtcgaagcctctggtacttcctccttcaagtaactagtggcatgcacgtcgggtccgccaggcctccgaggcgaaggggctgggagtggggtcgcgaggtgactagtcgtaagtttgaagtaggaaagttaataaaacgtattacgactaagtaccgttaccggaggtaacggggcccgtaatttacccgaacccgtattaccgtacccgaaagaaccggaacctaaacttacccgaaaacggaaccctacgttaccgttaggttaccctacgttagaccctaacgtaagtaacgaaccgtaacggttcccgtaaagggttaccccgtaagggaaccgggtacccgtacgggtacccgttaggttaacccgtttaacgtttacggttacgggttacggaaccgggtaggtaaaaccgggtttaactaaaaacccgggtttaaagtttaactttttgggggtaacccgtaggttttaaaacggg

SEQ ID NO: 161984 - DNA, 657 bp, Homo sapiens
  misc_feature: GYAE6OF01DJOYV.35.25.C03.1.454.CMB.1.raw
  modified_base (177)..(177): a, c, t, g, unknown or other
  misc_feature (177)..(177): n is a, c, g, or t
  modified_base (260)..(260): a, c, t, g, unknown or other
  misc_feature (260)..(260): n is a, c, g, or t
  modified_base (284)..(284): a, c, t, g, unknown or other
  misc_feature (284)..(284): n is a, c, g, or t
  modified_base (337)..(337): a, c, t, g, unknown or other
  misc_feature (337)..(337): n is a, c, g, or t
  modified_base (371)..(371): a, c, t, g, unknown or other
  misc_feature (371)..(371): n is a, c, g, or t
tcagtacagatcgtcacgaccggtgctcgatttagtagtgtagatttggggtttgggggggagaggagcccagcactagaagtcggcggtgtttccattcggtgatcagcactgaacacagaggactcaccatggagtttgggctgagcgtggtttcgcgtagctctttaagaggtntcagtgtcaggtgcagctggtgcaggtcgtggggggcgcgttggccagccgtgggacgtcctgacgctctctgtgacgtcctntggacttctccttacaagtaactnggcatgctacgtgggccgccaggcctaccgaggcgaaggggctgggagtgggngcagtgatatctattgagtaggaaataataaacntacgcaacgcgtaccggtagaacgggtcctattaccactactcctaccgaagaacgtaactaacgttaacccaaacgtaacctacttcgttacgtaccttcgtacgacctaactaacgtacggtaaccgtacggttaccggttaaccggggacccgttaagggaaccgggtaaccgtaccgggttccttacggttaaccgttaacgtttacggtaggttacgggacgtaaacggtaagtaaacggttaaacgttaaagttagttaggttacgtacggttaaacggg

SEQ ID NO: 161985 - DNA, 550 bp, Homo sapiens
  misc_feature: GYAE6OF01CPSEY.35.25.C03.1.454.CMB.1.raw
  modified_base (272)..(272): a, c, t, g, unknown or other
  misc_feature (272)..(272): n is a, c, g, or t
  modified_base (512)..(512): a, c, t, g, unknown or other
  misc_feature (512)..(512): n is a, c, g, or t
  modified_base (543)..(543): a, c, t, g, unknown or other
  misc_feature (543)..(543): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagcgtggttttcgcgtaggctctttaagaggtgtcagtgtcaggtgcagctggtgcagtctgggggcggcgtggtccagcctggggaggtccctgagctctcctgtgagcctctggacttctccttnaagaactatggcagtgccacgtgggtccgccaggcctccgagggccaagggggctgggagtggggtgacaggtgatatctagtttgataggaataataaacgattacgctagacgtccgtagaacgggctattcacctagtctaccgagacgactaacttccaagaactactcgtcgtctctgacactgtacgaactgtcgtacgggactggacggacgacggtctacgtcttagttcgnggtacgagagagtacgtaacgtaattgtagngtctagg

SEQ ID NO: 161986 - DNA, 523 bp, Homo sapiens
  misc_feature: GYAE6OF01A3HUW.35.25.C03.1.454.CMB.1.raw
  modified_base (341)..(341): a, c, t, g, unknown or other
  misc_feature (341)..(341): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtctgggggcggcgtggtccagcctgggaggtccctgagactctcctgtgaagcctctggattctccttcaagaactatggcatgcactgggtccgccaggctccaggcaaggggctgggagtgggtggcagtgatntcatttgatggaataataaacattacgcagactcgtgaagggccgattcacatctcagagacaattaccaagaacactctagtctctgacacatagaacagtcgtgggacctggacggacacggctgtctattactgtacgacgaaagctacgttacccgtattactagtcggtcggtacgg

SEQ ID NO: 161987 - DNA, 596 bp, Homo sapiens
  misc_feature: GYAE6OF01BB45D.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagccgtgggaggtccctgagactctcctgtgaagcctctggattctccttcaagaactatggcatgcacgtgggtccgccaggctccgaggcaaggggctgggaggtgggtggcagtgatatctatttgagttaggaaagtaaataaaactattacgacagtacctaccggtaggaacgggcctaattccaacctacttacctaccgaaagagaactaaacttacccgaaagaacctacttctcgtcctcgtagaccacatagaacctacggtcgtacgggacctggacggaccgtacggtctaggttaccttagttacgtggtacggacgtaagtaagaacgttaacgaaattagttgtagtacgtaagg

SEQ ID NO: 161988 - DNA, 636 bp, Homo sapiens
  misc_feature: GYAE6OF01CKK3W.35.25.C03.1.454.CMB.1.raw
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagccgtgggaggtccctgagactctcctgtgagcctntggattctccttnaagaactatggcatgcacgtgggtccgcaggcctcgaggcaaggggctggaggtgggtggcaggtgatatcatttgattggaagtaataaacagttaacgcgtaagactccggtaggaacgggcctaattcaacccatcctaccgaagtaacgaactaaacttccaaacgaacctaccgttcgtacgttacctactcgacctactaagtacgaaaccgtacggttccgttacggggacccttagggacggaaccgtaccgggtcttacgttaccttaacgtttaccgtagggtacggacggtaaggtaacggtaaacgttaaaccggtaaaatttagtttaggttggtacgtttaaacggg

SEQ ID NO: 161989 - DNA, 624 bp, Homo sapiens
  misc_feature: GYAE6OF01AZ4NN.35.25.C03.1.454.CMB.1.raw
  modified_base (360)..(360): a, c, t, g, unknown or other
  misc_feature (360)..(360): n is a, c, g, or t
  modified_base (439)..(439): a, c, t, g, unknown or other
  misc_feature (439)..(439): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagccgtggggacggtccctgagactctcctgtgaagcctctggacttcctccttacaaagaactatggcatcgcacgtcggggtcccgccgaggcctccgaggcgaaggggctgggaggtgggtggcgagtgatntctagtttgataggaaataaataaactattacgacagtacgtccggaggaacggcctattccgacctatcctacaaganaactaactaccaagaacctactacgtcgtacctctacgacaactaagtacgaaccgtagtccgtacgggtaacctagggaacggaccgtacgggtcttacgttaccttaacgttaccgtggtacggtacggaaggtaacgtaaacgtaaacgttaaagtttacgttaggtacgtacgttaaacgg

SEQ ID NO: 161990 - DNA, 678 bp, Homo sapiens
  misc_feature: GYAE6OF01COTHA.35.25.C03.1.454.CMB.1.raw
  modified_base (256)..(256): a, c, t, g, unknown or other
  misc_feature (256)..(256): n is a, c, g, or t
  modified_base (308)..(308): a, c, t, g, unknown or other
  misc_feature (308)..(308): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagcgtgggttttcctcgttagctctttaagaggtgtccagtgtcaggtgcagctggtgcaggtcgtgggggcggcgtggtccagcctggggacgtccctgagctctcctgngagcgtctggattcattcttacaattaactatggcatgcacgtggggtcccncagggcctccgaggccaagggctgggagtggttaggctaggttgtggtggtatggtagtaggaaagtaatagattactagtcgactaacgacgaccggtagggaacgggtaccgtattaccgaaccctagttaccccgaccgtaagaaacgtaacctaacttacccgaaaaggtaacccttaaccttttacggttaccctagtaacctaaaagttcgaaacctcggacccgttaggaaccggacggacccgaacgggtaaccgaccgggacgtaaagttacgttaacgtttacgtaggtacggaacgggtaacgaaacggtcggtaagggtaccggggaccgaccccgggttaacccccggagtaccggg

SEQ ID NO: 161991 - DNA, 671 bp, Homo sapiens
  misc_feature: GYAE6OF01CRQJZ.35.25.C03.1.454.CMB.1.raw
  modified_base (261)..(261): a, c, t, g, unknown or other
  misc_feature (261)..(261): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagccgtgggagtccctgagactctcctgtgagcctntggacttctccttcaagactatggcatgcacgtgggtcccgccaggcctccgaggcgaaggggctgggagtggggtggcagtgatatctagtttgagtaggtaaattaaataaacagttaacgcaagtaccgtaccggtaggaacgggtccctaacgttccaaccctatacccgtaccaagaacgaacctaaacgttacccaaacggaaacctaccgttccgtacgttaccttcctacggaccaaccgtaacgttacgaaaccgtacggttccgtacggggtacccttagggacgggaaccgtaccgggtcttacgttaccttaacgtttaccggtggttacggtaccggaaggtaacgtaaacgttaaaccggtaaaagtttagtttacggtacgtacggttaaacggg

SEQ ID NO: 161992 - DNA, 665 bp, Homo sapiens
  misc_feature: GYAE6OF01AQKGK.35.25.C03.1.454.CMB.1.raw
  modified_base (281)..(281): a, c, t, g, unknown or other
  misc_feature (281)..(281): n is a, c, g, or t
  modified_base (352)..(352): a, c, t, g, unknown or other
  misc_feature (352)..(352): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagccgtgggaggtccctgagactctcctgtgagcctcgtgattctcttcaagactntggcatgaccacgtcgggtccgccgaggcctccgaggacgaaggggctagggaggtgggtgcagtgaactntacgtagttgaagtaggaaagtaaataaactagttacgacaagtaccgttccggtaggaacgggtccgtaacgttcccgaacctaacttccgtaaccgaaggtaaccgtaacctaacttaaccccgaaagaaccctacgtacgttacgtccttactaccgtaccaaccgtaactacggaaaccgtaggttaccgacggggtacccttagggacggaaccgtacggacgttcggtaccgttagttacgtggtacggtacggaggtaaacgtaacgttaaaccggtaaagttacgttaggtcgttacgtaacggg

SEQ ID NO: 161993 - DNA, 681 bp, Homo sapiens
  misc_feature: GYAE6OF01EXNYK.35.25.C03.1.454.CMB.1.raw
  modified_base (184)..(184): a, c, t, g, unknown or other
  misc_feature (184)..(184): n is a, c, g, or t
  modified_base (440)..(440): a, c, t, g, unknown or other
  misc_feature (440)..(440): n is a, c, g, or t
tcagtacagatcgtcacgaccggtgctcgattttagtagtgtagatttgggtttgggggggaggagggagcccaggcactagaacgtcggcggtgtttccattccggtgatcagcactgaacacagaggactcaccatggagtttgggctgaggcggtggtttcgcgtagctctttaagaggtntcagtgtcaggtgcagcgtggtggagtcgtggggggaggtcggtgggtccgaggtccgtggggacggtccctggacggtcctcgtccgtgtgaacgtcgtcgtggattccgagttccttactaaattaactatcggtacctaagtgacctacggttcggggtccccgacggtacgggccgtacccggagggaccgaaaggggtcgtgggtagttcgggttgacgtaggttggtaggtggtatcgagtagaagttanacgtataacgtgtcgacgagactacggtaggaaccgggtacctacgttaccaacgtacgttacaaccaaggaactaactaaacttccaaagttaacctcttttacggtaccagtaaccaagttcggaactacgtccgaagacgaccgaggtacggactcggtatattagtacttaggcgtaggaacgtaggaagtcggtaacggtacgggtacctacccccggaccggttgaaacggccgg

SEQ ID NO: 161994 - DNA, 600 bp, Homo sapiens
  misc_feature: GYAE6OF01B63YM.35.25.C03.1.454.CMB.1.raw
  modified_base (177)..(177): a, c, t, g, unknown or other
  misc_feature (177)..(177): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (278)..(278): a, c, t, g, unknown or other
  misc_feature (278)..(278): n is a, c, g, or t
  modified_base (301)..(301): a, c, t, g, unknown or other
  misc_feature (301)..(301): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (353)..(353): a, c, t, g, unknown or other
  misc_feature (353)..(353): n is a, c, g, or t
  modified_base (382)..(382): a, c, t, g, unknown or other
  misc_feature (382)..(382): n is a, c, g, or t
  modified_base (561)..(561): a, c, t, g, unknown or other
  misc_feature (561)..(561): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagcggtggtttcgctaggcgtcttaagaggtntcagtgtcaggtgcagctggtgcagtcgtgggggcgcgtggtccagcctgggnggtccctgganctctcctgtagagcctctggattctcctcaagaactntggctatcgctacgtcgggtccnccgaggcctccgagggcgaaggggctgggngttgggngcagttgaattcgtntagtttgagtacggtaaataactaaaccnttaccggacaggtacctcggtaggaacgggtcctattaccactatcctaccgaagtacgactaacgttaccaagaacctcgtctcgtcctctacgcctacaagtacgaactaggttccgacgggtaccctagggaacgtcctacgggtactcggttaacttcgtttacggaggtacggngtaaggagtaacgtaacgtaattagttgtcgtacgtagg

SEQ ID NO: 161995 - DNA, 781 bp, Homo sapiens
  misc_feature: GYAE6OF01D3296.35.25.C03.1.454.CMB.1.raw
tcagtacagatcgtcacgaccggtgctcgatttagtagtgtagatttgggtttgggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtgcagtcgtggggcgcgtggtccagccgtgggacggtccctgacgtactctcctgtagaacgtcctcgtggtactttcctccctttacaaagtaacttagtggcatggaccacgttcggggtcccgccagggcctaccgagggaccgaagggggctagggaggttggggtggcaggtgaatatctagtttgaagttaggaaattaaaagtaaactacgttaacgcctaaggtacccgttaccggtaggaaaccggggtccgtaacgtttcccaacccgttaacgttcccttaacccgaaggtaacgtaaacccgtaaacctttaaccccgaaaacgtaaccgttacccttaccgttacggttaccttcgtacgaccctaacgtaacttaacgggaaacctaacgggttccggttaacggggaccccgtttaaggggaaccgggtaaccggtaaccgggttccgttacggtttaacccgtttaaggtttacccggttagggttacggaacccgggtaaaggtaacggtaaacgttaaacggttaaaagtttacggttttaacggttcgtacggtttaaacggg

SEQ ID NO: 161996 - DNA, 528 bp, Homo sapiens
  misc_feature: GYAE6OF01EYV1H.35.25.C03.1.454.CMB.1.raw
  modified_base (303)..(303): a, c, t, g, unknown or other
  misc_feature (303)..(303): n is a, c, g, or t
  modified_base (372)..(372): a, c, t, g, unknown or other
  misc_feature (372)..(372): n is a, c, g, or t
  modified_base (463)..(463): a, c, t, g, unknown or other
  misc_feature (463)..(463): n is a, c, g, or t
  modified_base (524)..(524): a, c, t, g, unknown or other
  misc_feature (524)..(524): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagccgtgggaggtccctgagactctcctgtgaagcctctggattctccttcaagaactatggcatgcacgtgggtccnccgaggcctccgaggcaaggggctgggagtggggtgcagtgatatctatttgataggaagtaataaacnttacgacagtacctccggtaggaacgggcctattccacatctaccagacgactaattaccaagaaccactcgtgtctctgcacatagaacngtctgggacctggagacacggctgtcttagttcgtgtgcgagagataacgaattattgtgntagg

SEQ ID NO: 161997 - DNA, 539 bp, Homo sapiens
  misc_feature: GYAE6OF01EW421.35.25.C03.1.454.CMB.1.raw
  modified_base (261)..(261): a, c, t, g, unknown or other
  misc_feature (261)..(261): n is a, c, g, or t
  modified_base (302)..(302): a, c, t, g, unknown or other
  misc_feature (302)..(302): n is a, c, g, or t
  modified_base (373)..(373): a, c, t, g, unknown or other
  misc_feature (373)..(373): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagcctgggaggtccctgagactctcctgtgagcctntggattctccttcaagaactatggcatgcacgtcgggtccnccgaggcctccgaggcgaagggggctgggagtggggtggcaggtgatatcatttgatggaagtaataaacnttacgcagactcgtagaacggcgattccacatctacagacgacattaccaagaacacgtctgtctcgtacgcacgatacgaactgtcgtcgggtacctggacggacacggtcttgtactagttacgtgtgcggtaagagagtaacgtaaattattagtgtcgtaag

SEQ ID NO: 161998 - DNA, 613 bp, Homo sapiens
  misc_feature: GYAE6OF01BUOTY.35.25.C03.1.454.CMB.1.raw
  modified_base (377)..(377): a, c, t, g, unknown or other
  misc_feature (377)..(377): n is a, c, g, or t
  modified_base (454)..(454): a, c, t, g, unknown or other
  misc_feature (454)..(454): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtgcagtcgtgggggcggcgtggtccagcctgggaggtccctgagactctcctgtgaacgcctctggtattcctccttacaagaactatggcagtgcacgtcgggtcccgccgaggcctccgagggcgaaggggctgggaggtggggtgctagttatagtggtatggatgggaactnaaagtaaagactagtgacaagacgtccggtaggacgggcctatccaacctactctacagacgaacaacttaccaaanaaccgacgtactagttactcgagtaactaaacgtacgaacgacgtacccgtaggaacgaccggacccggaaccgaaccggtaccggtcgttacggttagttaacgttacgtggtcgacggaacgaaccgtacggtaagaagtcgtaggtacttaaacgg

SEQ ID NO: 161999 - DNA, 668 bp, Homo sapiens
  misc_feature: GYAE6OF01CWRQV.35.25.C03.1.454.CMB.1.raw
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (522)..(522): a, c, t, g, unknown or other
  misc_feature (522)..(522): n is a, c, g, or t
  modified_base (656)..(656): a, c, t, g, unknown or other
  misc_feature (656)..(656): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagtcttgggttttcctcgttgcttcttttaagaggtgtccagtgtcaggtncagcgtgggtggngtcggtgggggaggcgtggtaccagccgtgggagtccctgagactctcctgtgaagcgtactggtattcattctacaatactagtgcatgctacggtcggtccgaccacggcctaccgaggacggaaggctgggtacgtgggttgctaggtgtggtaggtagtgagtaggaagtaactaagtactatagtgacgtaacggaacgtacggtacgggaacgggtcctacttaccaacgtactacccgtaacgaagtaacgtaaaccttaacgttaacccgaaacggttaacttacgtttaccgtactacggtaanaaaccgttagaaccgacgtacctagggaacgtacggaccggtaacgacgaaccgggtataaccgttagttaaccgtagtacgggtagacgaaagggtacgacggtaggtacccgggacctaccccggtaaccgnggtaccgacggg

SEQ ID NO: 162000 - DNA, 540 bp, Homo sapiens
  misc_feature: GYAE6OF01BLQSF.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtctgggggcggcgtggtccagcctggggagtccctgagactctcctgtgaagcctctggattctccttcaagaactatggcatgcacgtggggtccgccagggctccgagggcaagggggctgggagtggggtgcagtgatatcagtttgataggaaagtaataaacattacgcagactccggtagaacgggcattcaccatctaccagacgacaacttaccaacgaacacttctcgtctctagaccactatgaacacgtacgtaggacctaggacgacgacggctgtactattcgtgtcggcgagagaagtaacgaaattattgtgtctaacgg

SEQ ID NO: 162001 - DNA, 675 bp, Homo sapiens
  misc_feature: GYAE6OF01C769J.35.25.C03.1.454.CMB.1.raw
  modified_base (177)..(177): a, c, t, g, unknown or other
  misc_feature (177)..(177): n is a, c, g, or t
  modified_base (290)..(290): a, c, t, g, unknown or other
  misc_feature (290)..(290): n is a, c, g, or t
  modified_base (329)..(329): a, c, t, g, unknown or other
  misc_feature (329)..(329): n is a, c, g, or t
  modified_base (371)..(371): a, c, t, g, unknown or other
  misc_feature (371)..(371): n is a, c, g, or t
  modified_base (413)..(413): a, c, t, g, unknown or other
  misc_feature (413)..(413): n is a, c, g, or t
  modified_base (516)..(516): a, c, t, g, unknown or other
  misc_feature (516)..(516): n is a, c, g, or t
tcagtacagatcgtcacgaccggtgctcgatttagtagtgtagatttgggtttgggggggagaggagcccagcactagaagtcggcggtgtttccattcggtgatcagcactgaacacagagactcaccatggagtttgggctgagcttgggttttcctcgttgcttcttttaaggnggtgtccagtgtcaggtgcagctggtgcaggtcgtggggggcgcgtggtcccagccgtggggacgtccctgacgcctctcctgtacgaacgccctgtggtacttcctccctanaaacgtaacttagtggctatcgcctacgtcggggtcccnccagggcctccggaggacgaagggggctagggaggttggggngactaggtgatagtctagtttgagtaggtaataaataaactntacgctagaccgtcggtaggaacggtcctattaccacctatccgtaccgaagaacaacctaaacgttacccaaagtaactaccttccgtcgttactaccgtanaccaactaagtacgtaacgtacgttaccggtacggtaccctagggaccggacgtacccgggttacttacgttaccttaacgtttaccgtggttacggaccggtaaaggtacggttaaacttaaacggttaaattggtttaacggtagtcggttaaaggg

SEQ ID NO: 162002 - DNA, 191 bp, Homo sapiens
  misc_feature: GYAE6OF01B5K3B.35.25.C03.1.454.CMB.1.raw
  modified_base (174)..(191): a, c, t, g, unknown or other
  misc_feature (174)..(191): n is a, c, g, or t
tcagtacagatcgtcacgaccggtgctcgatttagtagtgtagatttgggtttggggggaagaggaagaatgacggtcccccaggagttcaggtgctgggcacagcggccctgggctgcctggtcaaggactactccagatctgtactgagcgggtctggcaaggcgcaatagnnnnnnnnnnnnnnnnnn

SEQ ID NO: 162003 - DNA, 965 bp, Homo sapiens
  misc_feature: GYAE6OF01EFSSW.35.25.C03.1.454.CMB.1.raw
  modified_base (895)..(895): a, c, t, g, unknown or other
  misc_feature (895)..(895): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggtaggtttggctgagtcgttgggtttttcctcgtttgtcttacttttaaggaggtcgtccgagtgtcgaggtgcaggtctggtgcgtaggtcggtgggggcggtcgtcggtccgacggtccggtagggggacgttcccgtaggacgtccttccgttaccggtaggtacgtaaccggtccttacggtttacggtaaccttttcccttacccgtttaacgaaaaggttaaaccttaggttcggacctaagtccggtaccgtacggggtttccgggtccccgaccggtaacgggtccctaccggtaaaggggaccggtaaacggggggttccgttaaggggggtaacgggttcggggggtacgggtaaaccgttcggggttaactaaaggttttacgtttacggttttaaggttttaacggggaaagggttttaaagggttaaaaaaacggtttaaaaaaccttaaaaaccggttacggtttaaaacccggaacgtttaaaccccggggttaaaccggttacccggggttaaaacggggggtaaaacccgggttaccccgtttaaaccgttaacccccgtaaaccgtttaaccgtaaccccggtttaaaccggaaaacggttaaaacccgtaaacccgttttaaaaccctaaaaccccgggtaaaacttaacccttaccggttaaccgtttcgtttacccgttacgaaccgtaccaaacgttacgttaacgacgtacggtcggtacggtacgacgtacggtacgngttctcgtacttaagtcgtagcgaaggaacgtagtaacgtaaagtacttaagtttccggatacgttaagg

SEQ ID NO: 162004 - DNA, 647 bp, Homo sapiens
  misc_feature: GYAE6OF01DFLUQ.35.25.C03.1.454.CMB.1.raw
  modified_base (195)..(195): a, c, t, g, unknown or other
  misc_feature (195)..(195): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctggtgcagtcgtgggggcgcgtggtccagccgtgggagtccctgagctctctgtgagcctgtggtacttctccttacaagtaactagtggcatgcacgtgggtacccgccaggcctccgaggacgaagggggctgggagtggggtggcagtgagtatcgtagtttgaagtaggaaataaataacgtattaacgcagaccgtccggtaggaacgggtccattccacctactcctaaccaagacgaaacctaacgttaccaaacgtaacctactacgttcgtacctactcgaacctaactaacgtagtaaccgtaggttacccggtagggacccttaggggaacggaaccgtacgggtctacggttcttaacgttaaccggtggttacggaacggaaggtaacgaacgttaaaacggtaaagtttgttaacggtggtaaccgttaaaggg

SEQ ID NO: 162005 - DNA, 719 bp, Homo sapiens
  misc_feature: GYAE6OF01DF5YV.35.25.C03.1.454.CMB.1.raw
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
tcagtacagatcgtcacgaccggtgctcgatttagtagtgtagatttgggtttggggggggagaggagcccagcactagaagtcggcggtgtttccattcggtgatcagcactgaacacagaggactcaccatggagtttgggctgagcttgggttttccctcgttgctcttttaagaggtgtccagtgtcaggtgcagctggtgcagtcgtgggggcgcgtggtccagcctggggaggtccctggagaccttctcctgtgaagtcctntggattcctccttanaagaaactatggcaatgacacgttcggggtccgccgaggcctaccgaggacgaaacgggggctgggagttggggcggcaaggtgaatatactagtttggaattaggggaaatttaaaactaaaaccgtaagtttaaccgacgtaacggtaacccgttacccgggttaagggaaacgggggtcccgtaaacttttacccgaaaccctacgtttcccgacccgttaaacggaacggaaaaccttaaaacgtttaccgaaaaacgggtaaaccctaccgttacccgttacgttaccgtacttaccgacgtaacaacgttaacgacgtaacgtcggtacgggaaccttgggaacgaccgacgggtactagttaccgtaattacgttgacgcggaaaggaagtaacgttaaagaaacgtttattcggtgacgttaaacgg

SEQ ID NO: 162006 - DNA, 686 bp, Homo sapiens
  misc_feature: GYAE6OF01DFDS3.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagcttgggttttcctcgttgctcttttaagaggtgtccagtgtgaggtgcagctgttggagtcgtgggggaggcttggcacgagccgtggggggtccctgacgacctctcgtgtcgcagtcgtcgtggtacttctacccttgtaagttagttagcggactagtcgactacggtcgggtcccgaccgacggtcccgtaccgagggaccggaacggggtcgtaggggtaggttcggggtggacgtagttagtagttggtagtagtagtaggtaagtactaaagtaagacttagtcgacgaacgtcgtacggtagggaaccgggtcctattaccaccttatacccgtaacaagaaccgtaacctaaacgttaacccgaaacgaaaccgtccgtacttaaccggttactaccgttaagaaactaaacgtacgaaccgccggtaactaggaacgtaccggaccgaacggtaccgacggttctaggttacgttactacgtggaccgacggaaagtaccgaacggtaagaggtacttggcttaaacgg

SEQ ID NO: 162007 - DNA, 861 bp, Homo sapiens
  misc_feature: GYAE6OF01C5XY3.35.25.C03.1.454.CMB.1.raw
  modified_base (851)..(851): a, c, t, g, unknown or other
  misc_feature (851)..(851): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcgcgtggtccaggccgtggggacggtccctgacgactctccgtgtgacgtccctcgtggtactttccttaccttacaaaaggtaaccttagtcggctattcggaccgtaccgttcgggggtccccgacccgaggggtcccctaccgaggggacccggtaaaggggggggtccttaggggggtaaggggttcgggggggttacgggaccgtaaggggttcggaaatttaacgttccggttaaaggttttttcgggaaaagtttaagggggtaaaaacgttttaaaaactttaaaaaccggtacgttttaaaccgggaccgttaaaacgggtaacccggtttaccccggggtaaaggggtaaaacccggggtcccgtaaccttttaccccgaacccgttaacgtttcccctaacccgtaaaacgggtaacgttaaaacccgtaaaaccgtttacccgaaaacgtaaaccctaaccgtttccgtacgtttaccctaccgtacgtaccctaacgtaacgttaaccggtaaaccgtacgggttaccgtacggggtacccttagggaccggaacgtaccggtctagttactaacgtttcgtaggtacggacgtaagagtaactaaacggtaacttagtttggngtaggtaacg

SEQ ID NO: 162008 - DNA, 592 bp, Homo sapiens
  misc_feature: GYAE6OF01EQAYV.35.25.C03.1.454.CMB.1.raw
  modified_base (267)..(267): a, c, t, g, unknown or other
  misc_feature (267)..(267): n is a, c, g, or t
  modified_base (402)..(402): a, c, t, g, unknown or other
  misc_feature (402)..(402): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagccgtggggacggtccctgacgactctcctgtgaacgcctntggtattctccttacaagaactagtggcatgccacgttcggggtcccgccgacgggcctccgagggcggaacggggcgtgggaggtgggtggctaggtgatatctagtttgagtaggaaataataaacagttacncagactcggtagacgggctatccacatctcagagactaataccaagaacactctctctctcgacactatacgaacgtacggtacgtaccgggtacgtaggacggacgtaccggtactcgttaccttagttacgtggtacggacgaggtaacgtaacgtaaacgtaagttagttacggtgtacgttaacgg

SEQ ID NO: 162009 - DNA, 860 bp, Homo sapiens
  misc_feature: GYAE6OF01B4T6D.35.25.C03.1.454.CMB.1.raw
tcagtacagatcgtcacgaccggtgctcgatttagtagtgtagatttggggtttgggggggagaggagcccagcactagaagtcggcggtgtttccattcggtgatcagcactgaacacagagactcacatggtagtttgggctgagtcttgggtttcctcgttgtcttcgtttaaggaggtcgtccaggtgtcgagggtcgcgaggtcgtgggtcgccgtagggtccgggtggggggggccgggtcgggttcgggtacccgacgggtcccggttggggggtaaccggttcccgtagggaaccgtaccttccgttccgtaggtacgaacgtcccttcgtaggtacttccttaccgttacgaaaaggtaacttacgtggactagttcggcctacggttccgggggaccccaccgacgggtcctccggaagggtccgggaaggggtcggtacggggtaggggtacggggttcggcggtaaggttaggtaacttacgttacgttaaggtttaggaacggttaaagggtaaaaagttaaaacgtaaacgttaacggtaaccggaactaaaccggttaccggtaccggtaaaggggtaaccgggtaccgtaacttaccaaccgtactccgtaacgaacgtaaacgaaccttaaacgtaaccaacgtaaccacgttaccgtacgtcctaccgtgaacccttaacggaacttaaccgggaccgttacggttacccgggtacggtaccgtaacggacgggtaacccgcggttacgttcgtttaacgttaccgttaggtcggtacggaacggttaggtaaagttacgtaaacggtttaaatcgggtttaagtaccggtaagttaacggg

SEQ ID NO: 162010 - DNA, 792 bp, Homo sapiens
  misc_feature: GYAE6OF01EB43G.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagagactcaccatggagtttgggctgagtcttgggttttcctcgttgcttcttttaagaggtgtccagtgtcaggtgcagcgtggtggagtcggtggggggagcgtcggtccaggtccgtggggtacgtccctggacgccttctccgtgtagaacgtcgtcgtggtacttcattcttacaaattaactagtcggactagttcgctaccggttcgggtacccgccgagggtcctaccggagggaccgaaagggggtcctaggggtacggtcgggttaccaccgaacacgtaactaccgacgtacaaaggttaccgtcggaacctaaccgtacccctaggttaccgtaacctacggccgtaaagtaccgttcggttagggtacggtaacggggtacccgtaacgtttaccgtaaccgtttaacggtttttaacgggaaccctaaaccgggtaacccggttaacggggttaccgtacggtttacgttaacgtacgttacgaactaaagtacgtaaaccgacgtaccgtaggaacgtacgggttaacggaacggtaccggtaaccggacccgtaacgttaccttaagtttacgttacggtagtaacgtaaacggttacggttagtttacgggtaggtttcggggtacgggttacggttagggtttagggttaaccggg

SEQ ID NO: 162011 - DNA, 746 bp, Homo sapiens
  misc_feature: GYAE6OF01DZBYS.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtgcagtcgtgggggcggcgtggtccagccgtgggacgtccctgacgactctcctgtagagtcctcgtggtactttccttccttacaaagtaactagtcgggactagttgcctaccgttcggggtcccgccgagggcctaccggagggacggaacgggggtcgtggggtaggttcggggtggtacgtaaggttatatactaagttacgtaggaagttaggtaaagttaacgtaggtaacgttaactagtacgaacgtaacgtaccgttaacggtagggaaccgggtccgtaacttacccaaccgtacttaccccgtaccgaagtaacgaaccttaaccttacccgaaaagacccgtaccgtacttacgtacttactacggaactaaatacgaaacgtacggtaccgtaggaacgtaacggcggtacggaacggtaccgacggttcgttacggttaggttaactttaccggtaggtaaacggtaaccggtaaacggttaaccgtttaccccgggtttaaacctttaaggttaacgtttaaccggggg

SEQ ID NO: 162012 - DNA, 775 bp, Homo sapiens
  misc_feature: GYAE6OF01B6HII.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagcctggggacggtccctgacgactctcctggtgaacgcctcgtggactttctccttcaaagtaactatggcatgcctacgtcggggtaccccgccgaacgggcctacccggaagggtccgaaaggggggtccttaggggagggttcgggggtggacgtagggtcgtaagtagttcgtaagttttagaagttaaggggtaaaattaaacgttaaaacgtagtttaacccgactaaaccggtaaccgttacccgggttaaggaaaccgggggtcccgtaacgtttacccgaacccgttaactaccgtacccgaaggaaacgtaaacctaactttaacccgaaacgtaaacccgtaacctaccgttacgtacccttcgtacgtacccaacgtaacgtacgaaaccgtacgggttccggtaacgggtaccgtacgggaacggtaccgaccgggtaccttacgttaaccgttacgtttaccgtagggttacggcggtaacggtaactaaacggtaaccgtaaaagttaccgtttaggttacggtacctaagggg

SEQ ID NO: 162013 - DNA, 613 bp, Homo sapiens
  misc_feature: GYAE6OF01BYEJR.35.25.C03.1.454.CMB.1.raw
  modified_base (159)..(159): a, c, t, g, unknown or other
  misc_feature (159)..(159): n is a, c, g, or t
  modified_base (274)..(274): a, c, t, g, unknown or other
  misc_feature (274)..(274): n is a, c, g, or t
  modified_base (383)..(383): a, c, t, g, unknown or other
  misc_feature (383)..(383): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtgcagtctgggggcgcgtggtccagccgtgggacggtccctgagactctcctgtgaagcctgtgattctccttnaagaactatggcagtgcacgtgggtcccgcaggtcctccgaggcgaaggggctagggaggtggggtgacgaggtgatagtcatttggataggaataataaacattacgnagctccggtagaacggccgattcacctatctacgagtacgaactaacttaccaagtaacctactacgtgtcctactcgactacaatacgtaaacgtcgttaccgtcgggaaccttagggaacggacctacgggtcctacggttaccttaagtttaccgttggttacggcccgtaaaggtaacgtaacgttaaacgtaaagtttaaggtttgttacggtaccgttaaaggg

SEQ ID NO: 162014 - DNA, 574 bp, Homo sapiens
  misc_feature: GYAE6OF01D5T6F.35.25.C03.1.454.CMB.1.raw
  modified_base (336)..(336): a, c, t, g, unknown or other
  misc_feature (336)..(336): n is a, c, g, or t
  modified_base (362)..(362): a, c, t, g, unknown or other
  misc_feature (362)..(362): n is a, c, g, or t
  modified_base (453)..(453): a, c, t, g, unknown or other
  misc_feature (453)..(453): n is a, c, g, or t
  modified_base (490)..(490): a, c, t, g, unknown or other
  misc_feature (490)..(490): n is a, c, g, or t
  modified_base (519)..(519): a, c, t, g, unknown or other
  misc_feature (519)..(519): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctggattttccttggtgctattttaaaagttgtccagtgtgaggtgcacctggtggagtcgggcggaggcttcgtaagccaggagggtccctaagactctcctgtgcagttttctggattcccttcaatgtcgcctggatgaactgggtccgccaggctccagggaagggactggagtgggttgcccgnattaaaaggagaattgatgggcgganaacagactacgcttcacccgttcaagggcagacttcaaccgtctaccagacatgattccatcgagtactctagtcacttaacaaatgaacngccctagacaacgagacacgacgtccgtatacttacngtaccactcctgacctacgacctggaccnctttaccaaccgtaacgtaacgttccgtagggggacccgggaattcccgtacggg

SEQ ID NO: 162015 - DNA, 944 bp, Homo sapiens
  misc_feature: GYAE6OF01BLVXL.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagcgtgggttttcctcgttgcttcttttaagaggtgtccagtgtcaggtgcagctggtgcgagtcggtggggcgcgtggtccagccgtgggacgtccctgacgtacctctccgtggtacgacgtcctgtggtactttcctccttacgaaagtacttagtcggactagtcggacctacggtcgggtaccccgcgaggtcctaccgaggccgaaggggtcgtagggaggtcggggtcgacgtaggtacgtagtaccgttgtaagtttagaagttaaggtaaacgtaaactaaaccgtagttaccgacgtaacgtaccgttaccggtaagggaaccgggtaccctaacttaccgaaccgtacgttccctaaaccggtaaacgtaacgtaaacccgttaaaaccgtttaacccggaaaacgttaaaacccgttacccgtttaccgtttaaccggttaccctttaccggtaaccgttaaccccgtaaacgttaaaaccggtttaccgggaaaaacccggttacccggggttttaccccggttaaaccgggggaaaccccgtttaaggggaaaccccggggttaaccccgggtaaaccggggtttacccttttaaacgggtttaaaccccgttttaaagggttttacccggttacggggtttaaacccgggaaaccccgggggtttaaaagggtaaaacccgggtttaaaaacccggtttaaaaaccggggttttaaaaacgtttttaccggggtttttaacgggttaaaacccggggtttaaacccccgggttttaaaaagggg

SEQ ID NO: 162016 - DNA, 758 bp, Homo sapiens
  misc_feature: GYAE6OF01CLUUB.35.25.C03.1.454.CMB.1.raw
  modified_base (159)..(159): a, c, t, g, unknown or other
  misc_feature (159)..(159): n is a, c, g, or t
  modified_base (177)..(177): a, c, t, g, unknown or other
  misc_feature (177)..(177): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttccngttgctctttaagaggtntccagtgtcaggtgcagcgtggtgcagtcgtgggggcgcgtggtccaggccgtggggacgtccctgacgtcctctccgtggtacgacgtcctagtggtacttcctaccttacaaacggtaactagtcggactatcggcctacggtcggggtccccgacgtacggtccctaccggaggaccggaagggggtcctaggggtagggttggggtcggacgtaaggtcgaattagtcgttaagtttagggaaagttaacgggtaaaaattaaactaaacgagtttaaccggactaacggtaccgttccgggaaggaaccgggttccgtaacttaccaaccgtacgtcctaaccgaagtaacgtaactaaacgttaacccaaacgtaaccttacctacgtcgttaccgacgttacggaacctaacgtaacgtaacgtaacggtaccgttacgggtaccgggtaaccgtaacgggtacgaaaccggtccggtacgttacgttacggttaacgtttacgcgggtaacggtacggaaacggtaaagttacgtaaaacgtaaagtttagttacggacgttacgtaaacggg

SEQ ID NO: 162017 - DNA, 733 bp, Homo sapiens
  misc_feature: GYAE6OF01CUQWJ.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagagactcaccatggagtttggctgagtcgttgggttttcctcgttgtcttacgttttaagaggtgtccagtgtcgaggtgcagtcgtggtggagtcggtgggggagcggtcggtccgagccgtgggacgtcccgtgacgtacctctccgtgtcgaagtccgtcgtaggtacttctattcttaactaaacttaacgtagtggactagtcgtaccgtacgggttccgggccccgacgacggtacccgtaccggacgggaacgaacggggtacgtagggtacgggttgggtcggtggtaggttggtaggttaggtataggtagtaaggtaagtaagtagtacgtatagtagacaacggacgtacggtacggaacggtacctactaccgtaccgacgtaccgaacgtaacgtaacgtaacgtaacgtaacctaacgttaacgtttcgttacgtaccgtaataactaacgtaacgaacgtaccggtacgtaacggacggaaccggacggaacggacgaaccgtaataagtaacgttacgtaggtacgtagggaacggtaggtacggacggtacggtaccgggaacccgaccccggtaacccgtggtaaccggaacccgg

SEQ ID NO: 162018 - DNA, 750 bp, Homo sapiens
  misc_feature: GYAE6OF01CUBLQ.35.25.C03.1.454.CMB.1.raw
  modified_base (208)..(208): a, c, t, g, unknown or other
  misc_feature (208)..(208): n is a, c, g, or t
  modified_base (248)..(248): a, c, t, g, unknown or other
  misc_feature (248)..(248): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagtcttgggttttcctcgttgtcttcgttttaagaggtgtccagtgtcaggtgcagcgtggtncgagtcggtggggcggcgtgtccagccgtgggacgtcccngacgtacctctcctggtacgacgtcctgtggtacttcctaccttagaaagtactagtcggactagtcgcctacggtccgggtccgaccgtacggccgtaccggagggaccggaagggggtccttaggggagggttcggggtggtacgagtagagttatacgtaagtttacggaagtaacggtaaagttaaaactaacgtagttaacgacgtaacgtaaccggtcgtaaggaacgggtccgtaatcccgaacctcgttacaccgaagtaacgtaaactaaccttacccgaaagtaacctaccgttacgtcgttcctaccgtacaaccgtaacgtaataaccggaacgttaaccgggtccggttacgggaacccgttaacgggacggacccgtaacggttaccgttccgttaactttacggtttaccggttagggtccggtaaggtaacggtaaacgttaacgttaaaacgttaatttggttaacggacgttacggttaaacgg

SEQ ID NO: 162019 - DNA, 751 bp, Homo sapiens
  misc_feature: GYAE6OF01BNMSE.35.25.C03.1.454.CMB.1.raw
tcagtacagatcgtcacgaccggtgctcgatttagtagtgtagatttggggtttgggggggagaggagcccagcactagaagtcggcggtgtttccattcggtgatcagcactgaacacagaggactcaccagtggaggtttgggctgagtcgttgggtttttcctcgttgtcttacttttaaaggaggttgtccagttcgtcgagggtgcaggtcgtgggtgcgtaggtcgggtggggggcggtcggtcggtccgacggtccggtggggaccggttcccgtggaacgtccttccgtcgtggtacgaacgtccgttacggtgtaccttcctaccttaacgaaataacgtagtaggactagtcgccgtaccggtccgggtacccgccgtacggaccgtaccggagggtacggaaggggtcggtagggtagggacggggtggacgtaaggtgtaatacgtagttattaggaagtaacggtaaataaacgtaaagacgttacgaactacggtacccggtaggtaacggaacggtaccgtaacttaccgaacctactacctaacgaagaacgtaactaactaaccgaagtaacctcgtctacgtccacgtgaacacgtacgtaacgtaacgtccgttcggaccggaatagggaccgtaccggtaggtaccttcggttaaccttaggtcgtaacggggttaacgacgtaaggtaaactaagttaactaaagtttaggttacgagttaacggtaaag

SEQ ID NO: 162020 - DNA, 763 bp, Homo sapiens
  misc_feature: GYAE6OF01BF7Q1.35.25.C03.1.454.CMB.1.raw
  modified_base (274)..(274): a, c, t, g, unknown or other
  misc_feature (274)..(274): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctggagcgttgggttttcctcgttgcttctttttaagaggtgtccagtgtcgaggtgcagctggtgcaggtcgtgggggcggcgtggtccaggccgtgggacgtccctagagacctctctggtagacgcctntggtacttcctccttacaagtaactagtcggctagtcgcgtacgtcgggtccccgacgaggcctccgagggcggaacgggggtctaggggacggttggggtacgacgtaggtcgaattctacgttagtttagaagtaacggtaaaaggttaaactaaacgtagttaacggaccgtaacggttaccgtaccgggtaagggaaccgggttccgtaacttcccgaaccgtacgttacccgtaaccgaaacggtaaccgtaaacctaacgtaaacccgaacgtaacctacgttccgttacgtcctactcggtaacctagtacgtaacgaacgttcgggtacgtacgggtacccgtaggaaccgggtaccgtaccggtagtttaccgttaacgtttacgtacccggttagggtacggtaacgggaaacgttaaacggtaacgttaaaaccggttaaatttacgggtttagttaaccgggtacgtttaaacgggg

SEQ ID NO: 162021 - DNA, 765 bp, Homo sapiens
  misc_feature: GYAE6OF01EC6QY.35.25.C03.1.454.CMB.1.raw
  modified_base (179)..(179): a, c, t, g, unknown or other
  misc_feature (179)..(179): n is a, c, g, or t
  modified_base (215)..(215): a, c, t, g, unknown or other
  misc_feature (215)..(215): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttggctgagcgttgggttttcctcgttgtcttacttttaagnggtgtccagtgtcaggtgcagctggtgcaggtcggnggggcgcgtcgtccagccgtgggacgtccctgacgtccttcgtaccgtgtagaacgtccgtacgtggacgtccgtaaccgtttaggaacgttacgtaccttaaggtggaccgtaaggttccggaacggtcccggttaccgggggttaccccgaccggtaacggggtccccgttaacccggggacggggggtaacccggggtcggttagggtacggtttccgggttacctttaccggttttacgttaagttacggtcgtacgttagggttcggtacgtctacgacgtaacgtaccgtacgacgtacgtaccgttcggtagggtacggtaacccgggttccgtacccgaacccgttccgtacgaacggtaaccgtaacgtaaccgtaaccgaaaacgtaccgttcgttacgtcgttaccctacggtacaacctagtaacgtacgaaccgttaggtcccgtaggtaccctagggaccctacgtccggtcgtacgttcgttaactggtcgagtacgaagattaaacgtaattaacgtgttagagtacgtgtacg

SEQ ID NO: 162022 - DNA, 761 bp, Homo sapiens
  misc_feature: GYAE6OF01C5FKS.35.25.C03.1.454.CMB.1.raw
  modified_base (166)..(166): a, c, t, g, unknown or other
  misc_feature (166)..(166): n is a, c, g, or t
  modified_base (358)..(358): a, c, t, g, unknown or other
  misc_feature (358)..(358): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccagtggagtttgggctgagcttgggttttcctcgttncttcgttttaaagcggttcgtccagtgtcaggtcgcagtcgtggtgcaggtcgtggggcgcgtcggtccagccgtgggacgtcccgtagacgtctcgtcgtgtacgaacgtccctgtggtactttccgtaccttaagaaacgtaacgttgtaggactacgttggcctaccggtttcggggaccccgaccggnggtccctacggaacgggaccgggtaaggggtcgtggggaggttcggggacggacgtaggtaggtattaacgtcgttaacggtttggaaacggtaagggtaaaacttaaacttaaaccgtagtttacccgagtaacggttaaccgtccggtaagggaaaccggttccgtaacttaccgacctacgtaccgacgtagaacgtaacttaacgtaccgtaactaccgtaactcgtacgtcgttcgcgactaacgtctacggtaacgtccggttacgacggtacgtaacggacggtacctaccggttacgttacggttaccttaacgttacggtaggtacggtacggtaaacggtacgtaaacgttaacgtttaaaggttcccgtttaagggtctacgggttaaaggg

SEQ ID NO: 162023 - DNA, 723 bp, Homo sapiens
  misc_feature: GYAE6OF01B6DJ0.35.25.C03.1.454.CMB.1.raw
  modified_base (321)..(321): a, c, t, g, unknown or other
  misc_feature (321)..(321): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagccgtggggaggtccctgagactctcctggtgaacgcctgtggtacttcctccttacaaaggtaaccttagtggcattgctaccgtggggtcccnccgaggcctccgaggccaaggggctgggagtgggttggctaggttggtggtggtatggagttaggaaataagtagatactatcgacaggaccaccgggttaggaacgggtccgtattaccgacctacgttaccctaccgaaggtaaccgtaacctaaaacgtttacccaaaacggtaaacccttaaccgtttttaccgttacccgttaaggtaaccctaaaaagttacggaaaccgacggtaccccgtagggtaaccgaacgggtacccgggtaagggaacccgaccggggtaactacgttaacgttaacgtttaccgtaggttacgggaaccggtagggtaaacggacggtaaggtaccggggacctacccccgggtaaccccggagtcgggtaacccggg

SEQ ID NO: 162024 - DNA, 724 bp, Homo sapiens
  misc_feature: GYAE6OF01EX9VW.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtgcagtcgtgggggcgcgtggtccagccgtgggaggtccctgagacctctccgtgtgaacgccctcgtggatttcctaccttacaaagaacttagtcggactagtcgctaccggttcggggtccccgccgtagggtccctaccggagggccggaaggggggccttaggggtaggttcggggggtcggacctagggttgtaaattcgtacgttaagtttaggaaggttaggaaaagtttaaaataaactagttacgacgtaacgtcgtaccggtagggaaccgggtccgtaacttacctaccgactccgtaccgaagtaacgaactaaacttaccgaaacgtaacttaccgtttccgttacgtacgaacgtaaacgtacgaaacgcgtaccgtagaacggtacgtacccggaggaccgaccggtaactaagttaacttaagttacgtagttacgaggaacggaaggacgtaggtaccggggaccggtaccccgttaacccccggggatcggtaacggtcccggg

SEQ ID NO: 162025 - DNA, 715 bp, Homo sapiens
  misc_feature: GYAE6OF01DY5P5.35.25.C03.1.454.CMB.1.raw
  modified_base (242)..(242): a, c, t, g, unknown or other
  misc_feature (242)..(242): n is a, c, g, or t
  modified_base (283)..(283): a, c, t, g, unknown or other
  misc_feature (283)..(283): n is a, c, g, or t
  modified_base (328)..(328): a, c, t, g, unknown or other
  misc_feature (328)..(328): n is a, c, g, or t
  modified_base (513)..(513): a, c, t, g, unknown or other
  misc_feature (513)..(513): n is a, c, g, or t
  modified_base (644)..(644): a, c, t, g, unknown or other
  misc_feature (644)..(644): n is a, c, g, or t
tcagtacagatcgtcacgaccggtgctcgatttagtagtgtagatttgggtttgggggggagaggagcccagcactagaagtcggcggtgtttccattcggtgatcagcactgaacacagagactcaccatggagtttgggctgagcttggttttcctcgttgcttcttttaagaggttgtccagtgtcgaggtgcagctggtgcagtcgtgggggcgcgtgtccagccgtgggacgtcccngagtctctctgtagacgtcctgtaggtatttccttccttanaacgtaaacttgtggactcgtgcccgtacggttcgggggtacccnccggacgggtccctaccggacgggtaccggtaagggggccttaggggtagggttgggtcggacctaggttagattagtcttagtttgaggtaacgtaaagtttaaataaacgtagttccgaacgtagtaccgttacggaggtaacgggccttaacttccgaaacctagtccgtacgaacggtaanaaacttaacttaacccgaaacgtaaacctccgtttacgttgtcctttacgaacgtccaacttacgtaacgaaccgtacgggttcgtaacgggaacccttagggacgttaacccggtaggttctaccgtttnttaaacgtttcgttagggagtaccggaagtaaacttacggtaaagtaactttagtgtttacgaggttaacg

SEQ ID NO: 162026 - DNA, 795 bp, Homo sapiens
  misc_feature: GYAE6OF01CR70W.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagaggactcacatggagtttgggctgagtcgttgggtttttcctcgttgtcttcgtttttaagaggtgtcctaggttgtcgagggtgcaggcgtgggtgcgaggtcggtgggggcgcggtcggtccaggtccgtgggacggtccctgacgtaccttctccgtgtagaacgtccgtagtcggtactttccgttacccttaacgaaaacgtaaaccgttacgtcggtactaagtccgtccgtaccggttcggggtccccgaccgtaacggcccgtaccggacggaccggtaaggggcgtaggggtacggttggggtaggaccgtaggtgtaattacgttacgttaaggttttaggaaaggttaaaggtaaaaacgtttaaaaacgtaaaacgtaacgttaaccgacgtaaacgtaccgtaacgggtaacgggaaccgggtaccgtaacttaccgaaccctacgtacctacgaacgtaaacgaacttaaacgtaccgtaaacgaaccttccttccgtaccttaccgtcttaaccgactaaacgtaacgtaacgtaaccgtgtacggttaccggacgtaacgggtacgaccgtaccgttagtccggttacttaacggttagtcggaggtaaacgaaggtaaacgtaacgttaaagttaacttaggttacgtgtaacgtaag

SEQ ID NO: 162027 - DNA, 911 bp, Homo sapiens
  misc_feature: GYAE6OF01CXINQ.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtgcaggtcgtgggggcggcgtggtccagccgtggggacgtccctgacgacctctcctgtgacgtcctgtggtacttctccctttacaaaggtaaccttagtcggaccagttacggcctaaccgttcgggggtacccccgacccgtaagggccccttacccggaaaggggacccggtaaagggggggtcccgttaggggggtaacggggtttcggggggtacgggtaaccgtaacggggtttacggtaaatttaaccgttaccgttaaggttttttagggaaaggtttaaacgggtaaaaaaggtttaaaaacgttaaaaaccgtaacgtttaaacccggacgttaaaaccggtacccggtttacccggtaaagggtaaaccgggggtccccgttaacgtttaaccccgaaccttaaccgttaccctaaccggtaaacggtaaaccgtaaaccttaaaaccggtttaacccgaaaacggtaaaccttaacccgttaccgttaccggtttaaccgtccgtttaacgaaccgtaaccttaacgtaacggttaaaccgttaacgggttcccggttaaccggggtaaccttacgggaacggtaaccggtaccggttcgttaccggttacttaaggttccgtaggttacggaacggtaaggtaacgtaacgtaaacggttaaacttagggtttacgtacgtacgtttaaacggg

SEQ ID NO: 162028 - DNA, 795 bp, Homo sapiens
  misc_feature: GYAE6OF01A8T78.35.25.C03.1.454.CMB.1.raw
  modified_base (316)..(316): a, c, t, g, unknown or other
  misc_feature (316)..(316): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtgcagtcgtggggcgcgtgtccagccgtgggagtccctgagtactctcctgtgaagcctagtggtacttcgtccttacgaagaacttatcggcagtcgcctacgtcgggtacccnccgagggtcctcccgagggccgaagggggtctagggaggtggggtcggcgtaggtcgattatacgttagtttggaacgttagggtaaaattaaaacgtaaaacgtacgtttacccggactaaacggtaccgttacccgggaagggtaacccgggtacccgtaacttacccgtaaccctaacgttccgtacccgaaggaaacgtaaccctaaacgttaacccgaaacggtaaaccctaaccgttaccgttaccggttccttaccgttaccgaccgtaaccgtaacgtaaccggtaaccgtaaccgggttccggtaaccggggttacccggtaacgggtaacccggtaaccgggaccggtaacgttccggttaaccgtttaccgttttaacggtacggtttggaaccgggtaacggtaaagttaaacgttaaacccggttaaaattttacgtttacggttaacggtttacggttaaacggg

SEQ ID NO: 162029 - DNA, 723 bp, Homo sapiens
  misc_feature: GYAE6OF01B02CU.35.25.C03.1.454.CMB.1.raw
  modified_base (117)..(117): a, c, t, g, unknown or other
  misc_feature (117)..(117): n is a, c, g, or t
  modified_base (188)..(188): a, c, t, g, unknown or other
  misc_feature (188)..(188): n is a, c, g, or t
  modified_base (217)..(217): a, c, t, g, unknown or other
  misc_feature (217)..(217): n is a, c, g, or t
  modified_base (395)..(395): a, c, t, g, unknown or other
  misc_feature (395)..(395): n is a, c, g, or t
  modified_base (430)..(430): a, c, t, g, unknown or other
  misc_feature (430)..(430): n is a, c, g, or t
  modified_base (532)..(532): a, c, t, g, unknown or other
  misc_feature (532)..(532): n is a, c, g, or t
tcagtacagatcgtcacgaccggtgctcgatttagtagtgtagatttgggttgggggggagaggagcccagcactagaagtcggcggtgtttccattcggtgatcagcactgaacanagagactcacagtggtaggtttgggctgagtcgttcgggttttcctcgtttagtcctttagttttaaaggngggttcgtaccgaggttgtcgaagggtcncgagtcgtggtcgacgtgggtccgggtgggggccgtcgtcgtaccgacgtcggtagggaccgtcctaggacgtcttctacgtgacgacgtcgtcgtagtcttccgtaccttagaaaacgtcttacggaggctacgttcggaccgtacgggtccgggtacccgcggacgtccgaacggnggtaacgggacgggtcgtagggagggtcgggtacngtaaggactagtacctgtaaggttagaacgtaaaggtaataaaacgtaacgtgtaacgcgtaaacgtaccgtaggaaggtacccgctacgtaccacgttacnccgaacgtacgaactaacgtactaaccgaagtaccgtcttacgtcgtactcgacgactaacgagtacgaacgtcgtacgggtaacgtaccgtagggacctacgggtacttacgtacgttacgttacgtgttacggacgtaacgtaataaccttaagttaaacgtagtttacggtaagtcggactttaaggg

SEQ ID NO: 162030 - DNA, 806 bp, Homo sapiens
  misc_feature: GYAE6OF01B2EJH.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagagactcaccatggagtttgggctgagtcttgggtttttcctgttgcttacgtttttaagaggttcgtcctaggttgtcgagggttcgcaggtcgtgggtgaccgtaggttcgggtggggggccggtcgttcggtccgaggccggtggggacgttcccgtaggacgtcctcctccgtggtacgacgtccttgttgggtactttccttaccttacgaaagtaaaccttgtacggctaagtcggtcccgtacgggttccggggtaccccgccgtaacgggtcccttacccggagggaccgggtaagggggtccgttagggggacgggttgggggtcgtaacggtaggttaccggtaagttacgttcttaaggtttagaggtaaacggtaaaagtaaacgtaaacgttagttaccggactaacggtacgttccgggtaaggaaccggtacctacttacgaacctacgtacccgtagaacgtaacgtaaccttaactaacccgtaaagtaaccctacgttccttacggttaccctagtcgaactacgtaacgaacgttaaccgacgtttaccgggtaccggtaacgtaccgggaacgtccgaccggttgtacgtttaacgtacgttcgtaggtcggtaaaggcggttaaagaacgtttaaacgaatttaggtacggtgttaacgtaacggg

SEQ ID NO: 162031 - DNA, 757 bp, Homo sapiens
  misc_feature: GYAE6OF01BASWZ.35.25.C03.1.454.CMB.1.raw
  modified_base (162)..(162): a, c, t, g, unknown or other
  misc_feature (162)..(162): n is a, c, g, or t
  modified_base (746)..(746): a, c, t, g, unknown or other
  misc_feature (746)..(746): n is a, c, g, or t
tcagtacagatcgtcacgaccggtgctcgatttagtagtgtagatttggggtttgggggggagaggagcccagcactagaagtcggcggtgtttccattcggtcgatcagcactggaacacagaggactcaccatggagtttgggctgagctgggttttccncgttgctcttttaagaggtgtccagtgtcaggtgcagctggtgcaggtcgtggggggcgcgtggtccagccgttggggacggtccctaggacgacgtccttacctcgtgaacgtccgtacgtggtacttcctacccttcgaaacggtaacctatcgggacacttcggacctacgttcggggtaccccgccgacgggtcctaccgagggccgaaaggggggtccttagggaggtggggtacggccgtaggtcgaattagtccgtaagttttggatagggtaagtaaaagtaaacacggtttagacctaggtaacccttccggtaggaacgggtacccgtagttaccacctacgtcctacccgaaggtaacgaacctaaacgttacccgaaacgtaacctacgttaccttacgttccgttcgtaaccgtcaaacgtactaaggtaaaccccgaggttacccggtaccggggtaacctttaggaacccgggacgtacccgggtacttaccggttaagttaccgtttacggtggttaacggtcgggaacgtaaggtaacttaaacggtaacgttagtttggttaccgnggttaaccggg

SEQ ID NO: 162032 - DNA, 823 bp, Homo sapiens
  misc_feature: GYAE6OF01CM6WX.35.25.C03.1.454.CMB.1.raw
  modified_base (104)..(104): a, c, t, g, unknown or other
  misc_feature (104)..(104): n is a, c, g, or t
  modified_base (222)..(222): a, c, t, g, unknown or other
  misc_feature (222)..(222): n is a, c, g, or t
  modified_base (769)..(769): a, c, t, g, unknown or other
  misc_feature (769)..(769): n is a, c, g, or t
tcagtacagatcgtcacgaccggtgctcgatttagtagtgtagatttggggtttgggggggagaggagcccagcactagaagtcggcggtgtttccattcggtnatcagcactgaacacagaggactcacatggaggtttgggctgagtcgttgggttttcctcgttgtcttcttttaaaggacggtgtccagtgtcgagggtgcgagtcgtgggtgaccgnggtcggtggggggccgggtcgtggtccgagccggtggggccggtccctggaacgtcctccgttcccgtgggtagtaacgtccggttaccgtaggtacttttaccatttacctttaactaaaattaaaaccgttagtgggaacctaagttcggaaccgtaccgggtttcccgggggggtaacccctacccgaacggggtcccccttaccggaaacggggtacccgggaaaaagggggttaaccggtgggggttaaaggggttttcggggggtttaaccgggcggtttaggggtttttaagggttggggttaaggttaggtaggggttaaaagggttaaaggggtttaaaaagaaagtttaagttaaccgttaacgtttaagacggtaaccgaaaagggtaacccgtaccggggtagggaacgggtaccgtaacttaccgaaccgtactaccgtaacaaggtaactaataaccgtaacaaacgtactttactcgtactagaacaatacgacgtacgtacgagaggacgtacgacggatgacctattaanacgttagtaggagtacggagaacggtgaagacggtaaccgaccgccggtgacgg

SEQ ID NO: 162033 - DNA, 716 bp, Homo sapiens
  misc_feature: GYAE6OF01B8HTI.35.25.C03.1.454.CMB.1.raw
  modified_base (178)..(178): a, c, t, g, unknown or other
  misc_feature (178)..(178): n is a, c, g, or t
tcagtacagatcgtcacgaccggtgctcgatttagtagtgtagatttgggtttgggggggagaggagcccagcactagaagtcggcggtgtttccatccggtgatcagcactgaacacagaggactcaccatggagtttgggctgagcgttgggttttcctgttgcttcttttaaggnggtgtccagtgtcaggtgcagctggtggagtcgtgggggagcgtcggtccagccgtggggacgtccctgacgacctctctggagtaacggctacgtggtacttccaccgtttgacggttagtctacgtagggactggccgtacgttcggggtccgtacgtaacggttcccggaagggggtacgggccgttgggttcggttcgggtttacaacggttagttacggagtagcgttagggacttagaccaactaagtccgtacggaccggtacgttccggaggaacgggcccttactccccgaccccctgaacgtacgaaccgaaccgaccaacgaaccgaacaactactactaccgacgaactaaagtacgtaacgtacgtacgagggtacgacgaccggaacggaccgtaccggtacgttcgtaccgttagttacgtggtacgaacgtacggtacggtacgtaccgttaagaacgttcctaggttttccggttaacgacgtttcccggtacgggtacgggtaacccgaaggggtaaccg

SEQ ID NO: 162034 - DNA, 648 bp, Homo sapiens
  misc_feature: GYAE6OF01AZ0TT.35.25.C03.1.454.CMB.1.raw
  modified_base (534)..(534): a, c, t, g, unknown or other
  misc_feature (534)..(534): n is a, c, g, or t
  modified_base (576)..(576): a, c, t, g, unknown or other
  misc_feature (576)..(576): n is a, c, g, or t
  modified_base (597)..(597): a, c, t, g, unknown or other
  misc_feature (597)..(597): n is a, c, g, or t
tcagtacagatcgtcacgaccggtgctcgatttagtagtgtagatttgggtttgggggggaggagggagcccagcactagaagtcggcggtgtttccattcggtgatcagcactgaacacagaggactcaccatggagtttgggctgagctgggttttcctcgttgcttcttttaagaggtgtccagtgtcaggtgcagctggtgcagtcgtgggggcggcgtggtccagcctgggacggtccctgagtcctcgtcctggtcgaagcctctggattcctccttacaagtactatggcatgctacgtcggggtcccgccgaggtcctacccgagggccgaaggggtctgggagggttcgggtaggcgaaggtgagtatacgtagtttggaatcgggaaagtaaactaaaactacgttacggacaaggtaccgttacggtaggaaccgggtcctaagttcccaacctacgtcctaccgaagtacgaacttaactaccgaacgtacacttccgtagtcctactagcctaagtcgtanaaccgtagtaccgtagggacccttaggaacgaccgtaccgtntccgttacttagttaaccggngtaggacgtaacgagaaccgttagtaatttaggtcggtagtacgtaaacgg

SEQ ID NO: 162035 - DNA, 837 bp, Homo sapiens
  misc_feature: GYAE6OF01CORYH.35.25.C03.1.454.CMB.1.raw
  modified_base (344)..(344): a, c, t, g, unknown or other
  misc_feature (344)..(344): n is a, c, g, or t
tcagtacagatcgtcacgaccggtgctcgatttagtagtgtagatttgggttgggggagaggagcccagcactagaagtcggcggtgtttccattcggtgatcagcactgaacacagaggactcacagtggagtttggctgagtcgttgggttttccctcgttgtactttcgttttaaggaggttcgtacctagtcgtacgaggtgacgacgcgtggtgccgtaggtccggtggggggccgcggtcggtaccgacggtccggtgggacgtcctgacgtccgtctccgtaggacggtacgtccgtagtcggttacttccgtccgtaagtaaagtacttagtcggntacgtcgcgtacgtccggtccgaccgagtccgcgagacggaggtcgtaggaggtcgggacgtacgtagtagtgtactcgtagttaggtagtaaacgtaagtaaaactaacgaacgtttaaccgacgtaaacggttacccggtaacgtacgggtaaaccgggtccgtaacgtttacccaaccgttacctaccgtaaacccgtaaggtaacccgtaaactaaacgttaaccgtaaacgtaccccgtaagtccgttaaccgttcgttaccgaacgtaccgtaactaacggtacccgttaaccggtacgttccgggttaacgggaaccgttacccgggaacgtaccccgggttaacggtttaccggtacggttttaaacccggtttaccgtttaacgggacccggtttaggggaaaccggttaaacggtaaaccgtaacgttaaaaaccggtttaagtttaacgggttctttaaaccggttaacgtttaaaccgggg

SEQ ID NO: 162036 - DNA, 872 bp, Homo sapiens
  misc_feature: GYAE6OF01BROTM.35.25.C03.1.454.CMB.1.raw
  modified_base (182)..(182): a, c, t, g, unknown or other
  misc_feature (182)..(182): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttggctgagtcgttgggttttcctcgttgtcttcgttttaaaggnggtcgtccagtgtcgaggtgcagtctggtgcgtaggtcggtggggcggcgtcggtccacggtccgtgggacgttcccgtagacgtacctctccgttgtagaacgtcctcgttaggtacctttccttaccttaacgaaaacgtaacgttacgtcggacctaagtcggtaccgttaaccgggtcccggggttaccccgaccggtacgggtcccgtacccggaggggtaaccgggtaagggggtccgttaggggtaaggggttcggggtcgggtacggtaaggttacgttaatttaccggttagtttaaggttacggtaaaggttaagggtaaaatttaaaaacgtaaacgttaacgtaaccggaaccgtaacggtaccggttaacccggtagggtaacccgggtacccttaactacccgtaacccgtacttaccgttaaccgaaggtaaacgaacctttaaacgtaacccgtaaacgtaaccgttacgttaaccgttcggtacctacgtaccgtaacccgtaagtaaccgtaaggttaaacccggcgtttaccgggaccggggttacctaaggggaccgaccgttaccgggttcgtttaaccgtaacttccggttaggacggttaggtaaacggattaaaacgggtaaacgttaaagttaacggtttagttccgggtaaagtggttaaacgg

SEQ ID NO: 162037 - DNA, 903 bp, Homo sapiens
  misc_feature: GYAE6OF01DTAOW.35.25.C03.1.454.CMB.1.raw
  modified_base (256)..(256): a, c, t, g, unknown or other
  misc_feature (256)..(256): n is a, c, g, or t
  modified_base (298)..(298): a, c, t, g, unknown or other
  misc_feature (298)..(298): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatgggagtttgggctgagtcgttgggttttcctgttgcttacgttttaaggaggtcgtccaggtgtcgaggtgcagcgtggtgcgtaggtcggtgggggcgcgtgtccgaggccgtgggacgtccngacgcctctcgtgacgacgtcctgtgactttccgtaccttanaaacgtaacgttagtcggacagttcggaccgtaccggttcggggaccccgtaccggacgggtacccgtaccgggaacggggtaccggtaacggggggtacgtaggggggtaggggttcggggggtacggtacgttaagggtcgtaagttaacgttccggtttaaaggttttgaaaccgggtttaaagggtaaaactttaaaacgttaaaaccgttacgttaacccgggaacggtaaccggttacccgttaacggggtaaacgggggtaaacgggtccccgttaaacgttaccccgtaaccgtaacccgttaccgtaacccggtaaaggtaaacccggttaaaccttaaaaaccgtttaaccccgtaaaaccggttaacccgttaaccgtttacccggttaaccggttacccttaccgttaccgaaacccgtttaacgaaaaccggttaacggtaaacccgttacggggttaccggtaccgggttaaacccgtacgggtaccggtaacggtacccgttacggtacgttacgttaacgttcggtcggtacggtaccggaaggttaaacgtagttaaacgtaaagtttgtacggtagtcgttaacggg

SEQ ID NO: 162038 - DNA, 892 bp, Homo sapiens
  misc_feature: GYAE6OF01EJLZ8.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtgcaggtcgtgggggcggcgtggtccagccgtgggagtccctgagactctccgtgtgaacgcctcgtggtacttcctccttacaaacggtaactagtcggactagtcgaccgtacggttcggggtcccgccggacgggtccctacccggaggggaccggtaaacggggggtccgttagggggtaaggggttcgggggttacgggaccggtaagggttacggtaacgttaacgttaccggttaaagttttacggggaaacgttaaggggtaaaaaagttttaaaacgtaaaaaccgttaacgtttaaccggaccgtaaaccggttaacccggttaccgggtaaacggggtaaccgggggtacccttaacgtttaaccccgaaaccccgttaacgttacccgttaaccccggaaaaggtaaccgtaaacccttaaaaccgtttaaccccgaaaaacggtaacccttaccgtttaccgtttaccggttacctttaaccggtaccgttaacccgaaccttaacggttaaccggtaaaccgttacgggttacccggtaaccggggtaaccccttagggaaccggtaacccggtacggttaccgttacggttaacgtttaacgttacggttaggtacggtaacggtaacgtaagttaacgtaacgttaaagttcgtttaggtacgtcgttaaacggg

SEQ ID NO: 162039 - DNA, 861 bp, Homo sapiens
  misc_feature: GYAE6OF01E3FBQ.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactagaacacagaggactcaccagtggtagtttgggcttgagtcgtttgggttttcctcgttgtcctttacgtttttaaggaggttcgtaccgtaggttcgtacgtagggtagccgagtcgttgggtcgacgtagggttcgggtgggggggccggtaccggtcggtaccgaggtcccggtaggggtccgttcccgtaggactaccttccgtccgtaggacgaaccgtccgttgtacggttactttcccgttaccttaaccgaaaggtaacttacggtcggactagtccgaccgttccggttaccggggtccccgaccggacggtcctacccgggaggggtaccgggtaaacgggggttcgggttagggtcggggttcggggtacggacggttaggtacgtaacttgtaacgttagttaaggaggttaaagtaaaactaaaactaacggtactaacggtacacggtaacgtacccggtaagggtacgtacccgttactacctaccgactacgacgaaagtaaccgtaacgtaacgttaaccaaccgtaactacccgttacgttaccgttaccgctaccggtactaacgtagtaaccgtaaccgttcggttaccggacggtaaccgtacgggtaccgacccggttagtaccgtttacgttaacgtttacggttaccggttacggtacggtaacggaacgttaacggttaacctaaaggttaaccgttaggtttacggtccgtaagtttaacggg

SEQ ID NO: 162040 - DNA, 945 bp, Homo sapiens
  misc_feature: GYAE6OF01CWSVJ.35.25.C03.1.454.CMB.1.raw
  modified_base (168)..(168): a, c, t, g, unknown or other
  misc_feature (168)..(168): n is a, c, g, or t
  modified_base (176)..(176): a, c, t, g, unknown or other
  misc_feature (176)..(176): n is a, c, g, or t
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgcttnttttaagnggtgtccagtgtcaggtgcagtctgggtncgaggtcgtggggggcggtcgtggtccagtccgttggggacggtccctggacgaccttcctccgtggtgacgtcctgtggtacttcctcctacgaanaacgttatcggactagttcgcctaccggtcggggtcccgccgtagggccctccggacgggtacgggaaacggggggtctaggggagggttgggtacggcgtaggttcgaattaacgtgttaagtttaggaaggttaacggtaaaagtttaaactaaaaacgtactttaaccggacttaaacggtaaccgtttacccgggtaaggggtaaaccgggtccgtaacgtttacccgtaacctaaccgttcccgaacgtaaacggtaaaccgtaaaccgttaaaaccgttaaccccgtaaaacgaaacccgttaccccgtttaaccggttaccgttaccccgtttacggtacggtaacccttaaccgttaaaaccggttaaccggtaaaccggttaaccggtttacccgggtaccgggggttaaaccccgtaccgggggtaaacggtaaccccgggttaaccggggttaccccggttttacgggtttaacccgtttttaaacgggttaccggttacccggggtttaacggggtaacccggggtaaaagggtttaaaaccccgggttaaaaggtttaaaaacccggtttaaaaacgggttttaggtttttaaaccggggttaaccggttaacggtttaaaaaccggggg

SEQ ID NO: 162041 - DNA, 771 bp, Homo sapiens
  misc_feature: GYAE6OF01CD450.35.25.C03.1.454.CMB.1.raw
  modified_base (179)..(179): a, c, t, g, unknown or other
  misc_feature (179)..(179): n is a, c, g, or t
  modified_base (200)..(200): a, c, t, g, unknown or other
  misc_feature (200)..(200): n is a, c, g, or t
  modified_base (376)..(376): a, c, t, g, unknown or other
  misc_feature (376)..(376): n is a, c, g, or t
tcagtacagatcgtcacgaccggtgctcgatttagtagtgtagatttgggttgggggggagaggagcccagcactagaagtcggcggtgttccattcggtgatcagctactgaacacagagactcactagtggagttggctggatcgttgggtttcccagttgtccttagttttaaggnggtcgtccagtgtacgaggtncaggtcgtggtacacgtggtccgggtagggggccgacggttcggaccacggtccggtggggtaccgtccctaggaactccgtcgtccaggtacacggtcccttgtcggtacttcccgtcgaacaaacggtatcggtcggtacaggtcgactacgggtcggacccgctaaggtcccncggacggacggggtaacgggtcgtggggtaaccgggtggggccctagtacggtagtattacttggtacttagaaagtaacggaaattaacaaccttaggacgtacacggtacgtaccggtaaggggaaccctcgtagtaccctacgtacgtaccgtaaccgaaggtaacctaacgtaaaccgtaacgtaaacctaccggtaaccttaactaccggtttccaacgtttaccgaacgtaaaccgtgtaaaccggtttcggaaacccgttccgggtaacgggtaacgtacggtaaccgggaccgaacggtccgtacggtttaacgtacgttccggttagcggtaaaccggtgtaaaacgtagttaaacgtaacgttaggttacgacgttaacggtaag

SEQ ID NO: 162042 - DNA, 813 bp, Homo sapiens
  misc_feature: GYAE6OF01ATARC.35.25.C03.1.454.CMB.1.raw
  modified_base (183)..(183): a, c, t, g, unknown or other
  misc_feature (183)..(183): n is a, c, g, or t
  modified_base (201)..(201): a, c, t, g, unknown or other
  misc_feature (201)..(201): n is a, c, g, or t
tcagtacagatcgtcacgaccggtgctcgatttagtagtgtagatttggggtttgggggggagaggagcccagcactagaagtcggcggtgtttccattcggtgatcagcactgaacacagaggactcaccatggagtttgggctgagcttggggttttccctcgttgcttacttttaaaggnggtgtccagtgtcaggtncagctggtgcaggtcgtgggggccgcgtacggtccagccgtggggacgtccctgagacctctcctgtgaacgccttacgtggtactttccgtaccgtttacaaacggtaacctttagtcgggacctaagttcggaccgtaaccggttcgggggtaccccgaccgaacggggccccttacccggaacggggacccggtaaagggggggtccttaggggggaacgggtttcggggggtacgggacccgtaaagggttcggtaaattacggtaccgttaggttttacggaagttaacgggtaaaattaaacgtaaaccgtagttaccgacgtaacgtaccgtcgggtaagggtaaccggtccgtaatttaccgaaccgtacttacccgtacgaaacggaacgtaacctaaacttaacccggaaacggtaaccctaaccgttaccggttaccgttaccgtacgttaccggaaccctaacgtaacgttaacggaaacccggttaccgtacgggtaccgggtaaccgtacgggacggtaaccgtaccgggtctacgttacgtaacttcgtaggtacgacgtagaactagtaaacgtaattagttcgagtaccgtaagg

SEQ ID NO: 162043 - DNA, 784 bp, Homo sapiens
  misc_feature: GYAE6OF01C9PSH.35.25.C03.1.454.CMB.1.raw
  modified_base (155)..(155): a, c, t, g, unknown or other
  misc_feature (155)..(155): n is a, c, g, or t
  modified_base (175)..(175): a, c, t, g, unknown or other
  misc_feature (175)..(175): n is a, c, g, or t
  modified_base (193)..(193): a, c, t, g, unknown or other
  misc_feature (193)..(193): n is a, c, g, or t
  modified_base (249)..(249): a, c, t, g, unknown or other
  misc_feature (249)..(249): n is a, c, g, or t
  modified_base (391)..(391): a, c, t, g, unknown or other
  misc_feature (391)..(391): n is a, c, g, or t
tcagtacagatcgtcacgaccggtgctcgatttagtagtgtagatttgggttgggggggagaggagcccagcactagaagtcggcggtgtttccattcggtgatcagcactgaacacagagctcacatggagtttggctgagcttgggttttccncgttgtcttacgttttaagnggtgtccagtgtcaggtncagtcgtggtcgcgtaggtcggtgggggcgcgtaggtccaggccgtgggacgtccngacgtcctctcgtagagacgtcctgtcggtacttcctaccgttaagaaacgtaacttagtcgactagttcgccgtaccggtgggtccccgacgtaacggccgtacggacgggacggaacggggtgtaggggagggttcgggnggactaggtagtatacgttctaagtttgaaagtacgggaaaattaaactaaacgtacgttaaccgcgtaacggtaccttacggtaagggaccggtccgtactaccgtacctaactcgtaacgaacgtaacgtaaccgtaaactacccgaaacgtaacgttacctaccgttacgttccttaaccgtaccggtactaaccggtaacgttaacgtaaaccggtaacgttcgtaaccgggtaccgttaaaccgggtacggtaaccgtaaccgggttaacccggtccgtttaaacggtacgttttaaccgtaagggttcggtaaacggtaacggtaaagggtaaaccttaacggtttaaaaacgtaagttttaacgttcggtttaagggtaaaccggg

SEQ ID NO: 162044 - DNA, 841 bp, Homo sapiens
  misc_feature: GYAE6OF01D23LT.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagaggactcaccatggaggtttgggctgagcgttgggttttcctcgttgcttacgttttaagaggtcgtcctagtgtcaggtcgcagcgtggtgacaggtcggtggggggccggtcgtcggtccacggccggtcggggacggtccccgtggaacgtccttccgtccgttaggtcgaaacggtcgttcgtagggtactttaccgactttcctttaacaaaacttaaccgtgtacggacctagtcgtacctacggtccggggtccgaccgacggtccctacggacggaccggtaacgggtacggtaggtagggttgggttacggtacgtaggtttcgggtagggttaggtacgtaagggtaggtaacggtaaagttaaacgttaaggtaacgttactacgtcggaacgaacggacgtaaccgggtaacgggaaccgggtaccctaacggttccaacccgtctaacccttacgaactacgaaacgtaacctaaccgtaaaacgtaccgttttaacctttcgttaccgtaacgttaactaaagtacgtaaaccgtacgtaccggtaaggaaccggacggtacccgggaacggaaccggtaccggaagttaaacgttaaaccgttacgttaaccgtgggtaaccgggacggaaaccgggtaacggttaccggtacgggtaaccgggtaaccccgtaaccccccgggttaccggacgggttaaaccggg

SEQ ID NO: 162045 - DNA, 845 bp, Homo sapiens
  misc_feature: GYAE6OF01AL3I6.35.25.C03.1.454.CMB.1.raw
  modified_base (194)..(194): a, c, t, g, unknown or other
  misc_feature (194)..(194): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccagtggagtttgggctgagcgttgggttttcctcgttgcttcttttaagaggtgtccagtgtcgnggtgcagctggtgcgtacgtcggtgggggcggtcggtcggtccgaggtcccgtggggacgtccctgagtaccctctccgtgtacgaacgtcccttcgtaggtacttccttaacctttaacgaaacgtaaacgttagtcggtactagtacggccgtaccggttccgggtacccgcccgtaacggtccgtaccgaagggacggtaaggggtcgtaggggtgggtggggtacggactagggttagacgttagtacttagtttagaaggtaaacggtaaataaaacgtaaacgtacgttaacgacgtaacggtacccggttaccggtaacgggtaaccgggtaccgttaacctaccgtaacccgtacgttacccgaaccgtaacggtaaaccgtaactaacccgttaacccaaacgtaacctacttacccgttacttccttaccgtaccgtacaacgttagtaaccgacgttaacggtcccggttacgggaacccgtttaccgggaccggtaaccggtccgtttaacgggtttaccgttttaaccgttaacggtttacggttacccgggtaaggtaacccggaaaaggggtaacctttaaaaacggttaccggttaaaactttgggtttaaacggtacgtaaggtttaaaccggg

SEQ ID NO: 162046 - DNA, 783 bp, Homo sapiens
  misc_feature: GYAE6OF01D9PJH.35.25.C03.1.454.CMB.1.raw
  modified_base (160)..(160): a, c, t, g, unknown or other
  misc_feature (160)..(160): n is a, c, g, or t
  modified_base (164)..(164): a, c, t, g, unknown or other
  misc_feature (164)..(164): n is a, c, g, or t
  modified_base (177)..(177): a, c, t, g, unknown or other
  misc_feature (177)..(177): n is a, c, g, or t
  modified_base (198)..(198): a, c, t, g, unknown or other
  misc_feature (198)..(198): n is a, c, g, or t
  modified_base (318)..(318): a, c, t, g, unknown or other
  misc_feature (318)..(318): n is a, c, g, or t
  modified_base (773)..(773): a, c, t, g, unknown or other
  misc_feature (773)..(773): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagcttgggttttccngttncttacttttaagnggtgtaccagttgtacaggtncagtctggtagcgaggtccgtggggcgcgtggtaccagccgtgggacgtccctgacgtactctcgtgagaacgccttgtacggtactttcctccttaacgaaaggtaacctttgacggtnacgtcggacctaccggtttccgggcccaccgtaggtaccctaccggaacggggtaccggtaaggggtccgttaaggggtacgggtggggtaggaacctgggtacgtagttaacgtcgtaaggttttaggaaagttaccggtaaaacgtttaaaacttaaaacgtacgtttaaccggacgtaaacggtacccggttacccggttaagggaaacccgggggttacccgttaacgttaaccgtaacccgaacctttaccgaaccccggtaaagtaaccggtaaaccttaaaccgttaacccgaaacggttaaccttacgttaccgttacgttcccgttacacgtaactaactaacgtaacgtaaccgtagttacccgacggtaacgtacggacggtaccgtacgtgtacgtacttagttacgtacgtagacgtacgaatagttaaccgaattagtcgngtcgtaacgg

SEQ ID NO: 162047 - DNA, 865 bp, Homo sapiens
  misc_feature: GYAE6OF01A0T6T.35.25.C03.1.454.CMB.1.raw
tcagtacagatcgtcacgaccggtgctcgatttagtagtgtagattttggggtttggggggggagaggacgcccagcactagaagtcggcggtgtttccattcggtgatcagcactgaacacagaggactcaccagtggtaggtttgggctgaggtcgtttcgggttttccgttcgttgtctttacgttttaagtaggtcgtccgtaggttcggtcgagggtcggacgacggtcgttggtcgtcggtacgggttcggggttcgggggggtccggggtccggtcgggtcccggacgggtcccgggtacgggggtaccggttcccgtacggacgtacccgttccgtaaaaaaaccgttcggtacggtaccgtccgttcgtggttactttccttaccgttaacgaacgtaactaggtacggctagtcgacgtccggttcgggtccccggccggaccggtaccgtccggacgggaccggtaacggggtcggtaggggtagggtacggggacggtacgtaggtacgtacgttactacgttagttagtaaggtaaggtaaacgtaaagtaaactacgttacgactacggtacgtaccggtagggtaaccgggtacctaacttacccaacctacgttacccgaacttaacggaaaccgtaacccttaacttaaaccccgaaacggttaccttacccgttacgttacgtacctcgtaaccacccgtaactgtaaccgtaccggtagttaccggtacggaacgtacggtaaccggcgtaaccggttcgttgtttaacccggtatttcccgtaggaccggttagaagtaacccggtaaagttaacgttaagttaccgtacgttcggtgttaacgg

SEQ ID NO: 162048 - DNA, 698 bp, Homo sapiens
  misc_feature: GYAE6OF01ATZ4A.35.25.C03.1.454.CMB.1.raw
  modified_base (264)..(264): a, c, t, g, unknown or other
  misc_feature (264)..(264): n is a, c, g, or t
  modified_base (318)..(318): a, c, t, g, unknown or other
  misc_feature (318)..(318): n is a, c, g, or t
tcagtacagatcgtcacgaccggtgctcgatttagtagtgtagatttgggtttggggggggagaggagcccagcactagaagtcggcggtgtttccattcggtgatcagcactgaacacagaggactcaccatggagtttgggctgagcgtgggttttcctcgttgcttcttttaagaggtgtccagtgtcaggtgcagctggtgctagtcggtggggggcgtcggtggtccaggccggtgggaggtcctggagacctctccgngtcgagcctgtgtcttctccttagaagactgtggcatcgactcgtcgggtaccncgaggtcctcggaggtacggaacgggtgttaggggaggttcggggtcggtcgtaggtagtagttacctgttaagggtttgaaaggtaacgggtaaacttaaaataaacgtaacgttaaccgcgtaaacgggtacgttacccgggtaaggaaccgggaccgtaacgtcgaaccctaggttccccacggaacgtaacgtaaccttaaacgtaacccggaaacttaaccggcctttctcgtaccgtcgtacgtacaactataacggtacgtaacgtcgggtacggcctaacgggtggaccggttcgacgttaccgtattggttccgtaagggcgaacggtaaacggtagaaccgtaattaatacggtggtacgtaggttacgg

SEQ ID NO: 162049 - DNA, 843 bp, Homo sapiens
  misc_feature: GYAE6OF01DWR1I.35.25.C03.1.454.CMB.1.raw
  modified_base (151)..(151): a, c, t, g, unknown or other
  misc_feature (151)..(151): n is a, c, g, or t
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
tcagtacagatcgtcacgaccggtgctcgatttagtagtgtagatttgggtttgggggggagaggagcccagcactagaagtcggcggtgtttccattcggcgatcagcactgaacacagaggacctcaccagtggtaggtttggctaggngtcgtttcgggttttcctcgtttgtcttacttttaaggnggtcgtccgtagttgtcgaggtcncgagtcgtggtcgcgtaggtcggtcgggggcggtcggttcggtccncggtccggtaggggtccgttacccngggtaacgtccgttcctcgtacggtacgaaccgtccttgtcggttactttcctacctaagtaaacgaacttggacgtatacgtcgaccgtcgggtaccggtccgaccgtacggtcccgtaccggacggggtacggaacgggttccggtaggggagggttcggggactagtaggtagttaattaccgtaggtttaagttagggaaactaaaagggttaaaacttaaagtaaccgttaggtacgaaccgttaaccgtccgggtttaacgggacggttaaccgggtcccgtaacgttaccgtaacccgttaccgtacgtaaccgtaacgtaacgtaaacccgttaaaccgtaaaccgtaaacggtaaaccttaccgttccgttaccgtaccttaccggtacctaaacgtacgtaacgttaacggacgttacggtacggtaccggtacgtaacgggaccgtaacggtcggttacgtacggtttaactacggtttacgtaggtacggtagtaaacgtaacgttaaagtaaccgtagtttacgacggtttcgtaaggttacggg

SEQ ID NO: 162050 - DNA, 813 bp, Homo sapiens
  misc_feature: GYAE6OF01CTP4U.35.25.C03.1.454.CMB.1.raw
  modified_base (181)..(181): a, c, t, g, unknown or other
  misc_feature (181)..(181): n is a, c, g, or t
  modified_base (204)..(204): a, c, t, g, unknown or other
  misc_feature (204)..(204): n is a, c, g, or t
  modified_base (308)..(308): a, c, t, g, unknown or other
  misc_feature (308)..(308): n is a, c, g, or t
  modified_base (386)..(386): a, c, t, g, unknown or other
  misc_feature (386)..(386): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctggagcttgggttttcctcggttgcttcttttaaaggnggttcgtccagttcgtcaggttncagctgggtgcacggtcggtggggggccggtcgttcggtccaggccgttggggacgttccctggacgtaccttctccgtgacgacgtcctgtgtcttctcctanaagacttgtggcctagtcgacctacggtccgggtaccgccgacggtcccaaccgggtacgggaccggtaacgggggtnttacgggggtacggttcgggggtacgccgttaagggtccgagttaccgttacgtaagtttagggaaacgttaagggtaaaaacttaaacgttaaacgtacgtttaccggacgtaacggtacccgtttacggaacgggtacgggtaccctacgtaccgtaacctcgtacgtaccgaaagaacctaactaaaccgtaccgtaaacgtaacccttacgttaccggttactaccgtacgtaacgtaaccgtaaacgtaaacggaaccctaaccgggtaccgaacgggtaccggtaaacccgggtccccgtaacggaaccggttaccggtacgttaggtttacgtaaccggtttacggtacggtaggaacccgtaaagggtaaccctaggttaacggaagttcggttaaccgttagttaacggtttaaacgg

SEQ ID NO: 162051 - DNA, 754 bp, Homo sapiens
  misc_feature: GYAE6OF01CGG3T.35.25.C03.1.454.CMB.1.raw
  modified_base (334)..(334): a, c, t, g, unknown or other
  misc_feature (334)..(334): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttggctgagcttgggttttcctcgttgtcttacttttaagaggtgtcagtgtcaggtgcagctggtgctaggtcgtgggggcgcgtcggtccagccgtgggacgtcctggacgacctctcgtgtacgacgtcctgtggtacttccgtaccttacaaagtaacttacgtggactagtcggtccacggtcgggtccccncgaggtcctaccgaggacggaaggggtctagggtagggtcgggtacggctagggtcgtaattagttacttagtttaggaaggtaaggtaaaagtttaaacgtaaactagttaaccggacgtaacgtaccggttaccgggaggtaaaccgggtccgttaacttacccgaacctaccgtaccgtaaccgaagtaaccgtaacctaaaccgttaaccaaaccggtaaaccttccgtacgttaccgtccttaccgtagtaccaagtacgtaaccgaccggtacgtttccgggaccggtaccgttacgggaccgtaccgaccggttgttaaccgttcttaaacggttccgtggtaaccggtcggtaacgaaaggttaaacccgtaaagtttaaggttaggtttacgtagggttacgttaaacggg

SEQ ID NO: 162052 - DNA, 748 bp, Homo sapiens
  misc_feature: GYAE6OF01CSJTK.35.25.C03.1.454.CMB.1.raw
  modified_base (160)..(160): a, c, t, g, unknown or other
  misc_feature (160)..(160): n is a, c, g, or t
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
  modified_base (217)..(217): a, c, t, g, unknown or other
  misc_feature (217)..(217): n is a, c, g, or t
  modified_base (313)..(313): a, c, t, g, unknown or other
  misc_feature (313)..(313): n is a, c, g, or t
  modified_base (731)..(731): a, c, t, g, unknown or other
  misc_feature (731)..(731): n is a, c, g, or t
tcagtacagatcgtcacgaccggtgctcgatttagtagtgtagatttgggttgggggggagaggagcccagcactagaagtcggcggtgtttccattcggtgatcagcactgaacacagagactcaccatggtagttgggctgagtcgttgggttttccngttgcttacgtttaaggnggtctccagtgtcaggtncaggcgtggcgctaggtcggnggggcgtcgtggtccaggccggttgggaccgtccctaggactacctcctcgtaggtacgaacgtccctggttggtactttcccgtaaccggttaanaaaacggtaactttcgcgggtacctaacgttccggacctaacggggttcccgggggacccaccggttaagccccgtaacggaacggggtaccggtaaggggtccgaggggtacggttcgggggacacgttagtacgtaactcgtggttaagtttaggaacgtaaaggtaaacttaaaaccgtaacgttacgtacggaacgttacggttaccgcgggttaaaggaccgtcctactaccgactactccgaacgagtaacaacctaaacgtacccaaatccgtacttacggtcttccgctacacgaagttacaggtaacctggtacggcgacacggcgaccgtagtccgtacgttacgtagttcggtagacggttaaggaacgtttaaacggaactttaaacgggtacttttagggtaacnggttaaaggtttaccgg

SEQ ID NO: 162053 - DNA, 707 bp, Homo sapiens
  misc_feature: GYAE6OF01BOTDB.35.25.C03.1.454.CMB.1.raw
  modified_base (118)..(118): a, c, t, g, unknown or other
  misc_feature (118)..(118): n is a, c, g, or t
  modified_base (181)..(181): a, c, t, g, unknown or other
  misc_feature (181)..(181): n is a, c, g, or t
  modified_base (201)..(201): a, c, t, g, unknown or other
  misc_feature (201)..(201): n is a, c, g, or t
  modified_base (477)..(477): a, c, t, g, unknown or other
  misc_feature (477)..(477): n is a, c, g, or t
  modified_base (492)..(492): a, c, t, g, unknown or other
  misc_feature (492)..(492): n is a, c, g, or t
  modified_base (602)..(602): a, c, t, g, unknown or other
  misc_feature (602)..(602): n is a, c, g, or t
  modified_base (651)..(651): a, c, t, g, unknown or other
  misc_feature (651)..(651): n is a, c, g, or t
  modified_base (658)..(658): a, c, t, g, unknown or other
  misc_feature (658)..(658): n is a, c, g, or t
  modified_base (668)..(668): a, c, t, g, unknown or other
  misc_feature (668)..(668): n is a, c, g, or t
tcagtacagatcgtcacgaccggtgctcgatttagtagtgtagatttgggtttgggggggagaggagcccagcactagaagtcggcggtgtttccattcggtgatcagcactgaacanagaggactcaccagtggtagtttggctgagtcgttcggttttcctcgttgtcttctttaaggnggtctccgagtgtcgaggtncagtcgtggtaggagtcggtgggggagtcggtcggtaccgacgtccggtgggtccggttaccctaggacctacctccgtccgtggttacgaacggtcgttcgtaggtacttacctacttttaccgtaactaaacttaacgtacggttcgctagttacggaccgtacggtcggggtcccacggtacggccgtacggacgggacggtaacgggtacgttgggtaggttcggggtggtactagggtttctaggtcggttatggtacgtaggtaaactanacgtaattacgtagngtaacacggtaactagggtgtaaccggctactacaccgtacttcgacgtaagtctaaacgtactaacgtaactaacgtttacgttcttaccagtaactaagtacgtaacncggtctacggagaccggtaccgaggttaagccggtagtaattaacggtnttacggngtcgaacggngtacgtaggcgtacggacccgcccgaagtcggaggaccg

SEQ ID NO: 162054 - DNA, 131 bp, Homo sapiens
  misc_feature: GYAE6OF02IET9N.35.25.C03.1.454.CMB.1.raw
  modified_base (130)..(131): a, c, t, g, unknown or other
  misc_feature (130)..(131): n is a, c, g, or t
tcagtacagatcgtcacgaccggtgctcgatttagtagtgtagatttgggtttgggcacagcggccctgggctgcctggtcaaggactacttccacgatctgtactgagcgggctggcaaggcgcatagnn

SEQ ID NO: 162055 - DNA, 178 bp, Homo sapiens
  misc_feature: GYAE6OF02HXFUJ.35.25.C03.1.454.CMB.1.raw
  modified_base (171)..(178): a, c, t, g, unknown or other
  misc_feature (171)..(178): n is a, c, g, or t
tcagtacagatcgtcacgaccggtgctcgatttagtagtgtagatttgggtttggggaagaggaagactgacggtccccaggagttcaggtgctgggcacagcggccctgggctgcctggtcaaggactacttccacgatctgtactgagcgggctggcaaggcgcatagnnnnnnnn

SEQ ID NO: 162056 - DNA, 211 bp, Homo sapiens
  misc_feature: GYAE6OF02G1XYS.35.25.C03.1.454.CMB.1.raw
  modified_base (173)..(174): a, c, t, g, unknown or other
  misc_feature (173)..(174): n is a, c, g, or t
  modified_base (176)..(211): a, c, t, g, unknown or other
  misc_feature (176)..(211): n is a, c, g, or t
tcagtacagatcgtcacgaccggtgctcgatttagtagtgtagatttgggttgggggaagaggaagacctgacggtcccccaggagttcaggtgcctgggcacagccggccctgggctgcctggtcaaggctacttccagatctgtactgagcgggctggcaaggcgcatagnncnnnnnnnnnnnnnnnnnnnnnnnnnnnnnnnnnnnn

SEQ ID NO: 162057 - DNA, 174 bp, Homo sapiens
  misc_feature: GYAE6OF02JDTGI.35.25.C03.1.454.CMB.1.raw
  modified_base (172)..(174): a, c, t, g, unknown or other
  misc_feature (172)..(174): n is a, c, g, or t
tcagtacagatcgtcacgaccggtgctcgatttagtagtgtagatttggtttgggggaagaggaagactgacggtcccccaggagttcaggtgctgggcacagcggccctgggctgcctggtcaaggactacttccacgatctgtactgagcgggctggcaaggcgcatagnnn

SEQ ID NO: 162058 - DNA, 188 bp, Homo sapiens
  misc_feature: GYAE6OF02HM4DU.35.25.C03.1.454.CMB.1.raw
  modified_base (172)..(188): a, c, t, g, unknown or other
  misc_feature (172)..(188): n is a, c, g, or t
tcagtacagatcgtcacgaccggtgctcgatttagtagtgtagatttgggtttgggggaagaggaagactgacggtccccaggagttcaggtgctgggcacagcggccctgggctgcctggtcaaggactacttccacgatctgtactgagcgggctggcaaggcgcatagnnnnnnnnnnnnnnnnn

SEQ ID NO: 162059 - DNA, 177 bp, Homo sapiens
  misc_feature: GYAE6OF02HOQVP.35.25.C03.1.454.CMB.1.raw
  modified_base (169)..(177): a, c, t, g, unknown or other
  misc_feature (169)..(177): n is a, c, g, or t
tcagtacagatcgtcacgaccggtgctcgatttagtagtgtagatttggtttgggaagaggaagactgacggtccccaggagttcaggtgctgggcacagcggccctgggctgcctggtcaaggactacttccacgatctgtactgagcgggctggcaaggcgcatagnnnnnnnnn

SEQ ID NO: 162060 - DNA, 172 bp, Homo sapiens
  misc_feature: GYAE6OF02ILK3I.35.25.C03.1.454.CMB.1.raw
  modified_base (171)..(172): a, c, t, g, unknown or other
  misc_feature (171)..(172): n is a, c, g, or t
tcagtacagatcgtcacgaccggtgctcgatttagtagtgtagatttgggtttggggaagaggaagactgacggtccccaggagttcaggtgctgggcacagcggccctgggctgcctggtcaaggactacttccacgatctgtactgagcgggctggcaaggcgcatagnn

SEQ ID NO: 162061 - DNA, 240 bp, Homo sapiens
  misc_feature: GYAE6OF02HKZDU.35.25.C03.1.454.CMB.1.raw
  modified_base (183)..(240): a, c, t, g, unknown or other
  misc_feature (183)..(240): n is a, c, g, or t
tcagtacagatcgtcacgaccggtgctcgatttagtagtgtagattgggtttgggggaagagggaagactgacggtcccccaggagttcaggtgcgtgggcacacgcggccctgggcctcgcctggtcaaggacttacttccacgatcgtgtactgagtcgggcttggcaaggcgtcatagcnnnnnnnnnnnnnnnnnnnnnnnnnnnnnnnnnnnnnnnnnnnnnnnnnnnnnnnnnn

SEQ ID NO: 162062 - DNA, 171 bp, Homo sapiens
  misc_feature: GYAE6OF02H29XF.35.25.C03.1.454.CMB.1.raw
  modified_base (171)..(171): a, c, t, g, unknown or other
  misc_feature (171)..(171): n is a, c, g, or t
tcagtacagatcgtcacgaccggtgctcgatttagtagtgtagatttgggtttggggaagaggaagactgacggtccccaggagttcaggtgctgggcacagcggccctgggctgcctggtcaaggactacttccacgatctgtactgagcgggctggcaaggcgcatagn

SEQ ID NO: 162063 - DNA, 173 bp, Homo sapiens; identical to SEQ ID NO: 161973
  misc_feature: GYAE6OF02H1SMD.35.25.C03.1.454.CMB.1.raw
  modified_base (173)..(173): a, c, t, g, unknown or other
  misc_feature (173)..(173): n is a, c, g, or t

SEQ ID NO: 162064 - DNA, 174 bp, Homo sapiens; identical to SEQ ID NO: 161977
  misc_feature: GYAE6OF02IIC6Q.35.25.C03.1.454.CMB.1.raw
  modified_base (173)..(174): a, c, t, g, unknown or other
  misc_feature (173)..(174): n is a, c, g, or t

SEQ ID NO: 162065 - DNA, 176 bp, Homo sapiens
  misc_feature: GYAE6OF02FVHJ4.35.25.C03.1.454.CMB.1.raw
  modified_base (173)..(176): a, c, t, g, unknown or other
  misc_feature (173)..(176): n is a, c, g, or t
tcagtacagatcgtcacgaccggtgctcgatttagtagtgtagatttgggtttgggggaagaggaagactgacggtcccccaggagttcaggtgctgggcacagcggccctgggctgcctggtcaaggactacttccacgatctgtactgagcgggctggcaaggcgcatagnnnn

SEQ ID NO: 162066 - DNA, 172 bp, Homo sapiens
  misc_feature: GYAE6OF02HEN3M.35.25.C03.1.454.CMB.1.raw
tcagtacagatcgtcacgaccggtgctcgatttagtagtgtagatttgggtttgggggaagaggaagactgacggtcccccaggagttcaggtgctgggcacagcggccctgggctgcctggtcaaggactacttccacgatctgtactgagcgggctggcaaggcgcatag

SEQ ID NO: 162067 - DNA, 173 bp, Homo sapiens; identical to SEQ ID NO: 161973
  misc_feature: GYAE6OF02F7FMF.35.25.C03.1.454.CMB.1.raw
  modified_base (173)..(173): a, c, t, g, unknown or other
  misc_feature (173)..(173): n is a, c, g, or t

SEQ ID NO: 162068 - DNA, 174 bp, Homo sapiens; identical to SEQ ID NO: 161977
  misc_feature: GYAE6OF02FUHGB.35.25.C03.1.454.CMB.1.raw
  modified_base (173)..(174): a, c, t, g, unknown or other
  misc_feature (173)..(174): n is a, c, g, or t

SEQ ID NO: 162069 - DNA, 175 bp, Homo sapiens
  misc_feature: GYAE6OF02H0D1S.35.25.C03.1.454.CMB.1.raw
  modified_base (172)..(175): a, c, t, g, unknown or other
  misc_feature (172)..(175): n is a, c, g, or t
tcagtacagatcgtcacgaccggtgctcgatttagtagtgtagatttgggtttgggggaagaggaagactgacggtcccccaggagttcaggtgctgggcacagcggccctgggctgcctggtcaaggactattccacgatctgtactgagcgggctggcaaggcgcatagnnnn

SEQ ID NO: 162070 - DNA, 191 bp, Homo sapiens
  misc_feature: GYAE6OF02ICICX.35.25.C03.1.454.CMB.1.raw
  modified_base (172)..(191): a, c, t, g, unknown or other
  misc_feature (172)..(191): n is a, c, g, or t
tcagtacagatcgtcacgaccggtgctcgatttagtagtgtagatttgggtttgggggaagaggaagactgacggtcccccaggagttcaggtgctgggcacagcggcctgggctgcctggtcaaggactacttccacgatctgtactgagcgggctggcaaggcgcatagnnnnnnnnnnnnnnnnnnnn

SEQ ID NO: 162071 - DNA, 542 bp, Homo sapiens
  misc_feature: GYAE6OF02HQU0Z.35.25.C03.1.454.CMB.1.raw
  modified_base (421)..(421): a, c, t, g, unknown or other
  misc_feature (421)..(421): n is a, c, g, or t
tcagtacagatcgtcacgaccggtgctcgatttagtagtgtagatttggggtttgggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagcctggggaggtccctgagactctcctgtgaagcctctggattctccttcaagaactatggcatgcacgtgggtcccgccgaggcctccgaggcgaaggggctgggagtggggtggcagtgatatctatttgataggaataaataaacattacgcagactcggtagaacgggccgtattcacatctacaganaacaacttaccaagaaccactctgtcctctacgcacatacgaacacgtcgtacggacctaggacggacaccggctcgttactagttactgtgcgagagtataacgaattagtgtgataagg

SEQ ID NO: 162072 - DNA, 531 bp, Homo sapiens
  misc_feature: GYAE6OF02H6922.35.25.C03.1.454.CMB.1.raw
  modified_base (301)..(301): a, c, t, g, unknown or other
  misc_feature (301)..(301): n is a, c, g, or t
  modified_base (333)..(333): a, c, t, g, unknown or other
  misc_feature (333)..(333): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtctgggggcggcgtggtccagcctggggacggtccctgagactctcctgtgagcctctggattctccttcaagactatggcatgcactgggtcccnccaggctccaggcaaggggctgggagtggggnggcaggtgatatcattttgatggaagtaataaacattacgacagactccgtaggaacgggccgattcaccatctaccagagactaacttcaaagaccactctgtctctgacacatagacagtcgtagggacctgacggacacggctgtacttattctagtgacgtagagtactaacgaaattgttaggtcgataacgg

SEQ ID NO: 162073 - DNA, 514 bp, Homo sapiens
  misc_feature: GYAE6OF02GZS5N.35.25.C03.1.454.CMB.1.raw
  modified_base (301)..(301): a, c, t, g, unknown or other
  misc_feature (301)..(301): n is a, c, g, or t
  modified_base (372)..(372): a, c, t, g, unknown or other
  misc_feature (372)..(372): n is a, c, g, or t
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
  modified_base (456)..(456): a, c, t, g, unknown or other
  misc_feature (456)..(456): n is a, c, g, or t
tcagtacagatcgtcacgaccggtgctcgatttagtagtgtagatttgggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtctgggggcggcgtggtccagcctggggagtccctgagactctcctgtgaagcctctggattctccttcaagaactatggcatgcactgggtccnccaggctccaggcaaggggctggagtgggtggcagtgatatctatttgatggaaataataaaacattacgnagactccgtagaacgggccgattcaccatcctaccagacgactaataccaagaacactctgttactctnacanatgaacngtcncggactgagacacgctgtctattactgtgacgagagatacgtaaattagtgtgatagg

SEQ ID NO: 162074 - DNA, 616 bp, Homo sapiens
  misc_feature: GYAE6OF02F4KCS.35.25.C03.1.454.CMB.1.raw
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtggggcgcgtggtccagcctggggagtccctgagactctcctgtgaagcctntggacttctccttnaagactatggcatgcacgtgggtcccncaggctccgaggccgaaggggctgggaggtgggtggctaggtgatatctatttgatggaaagttaataaacagttacgctagactccggtagaagggtccattacacctactcacagacgtactaaacttaccaaagaacctaactcgtcgtacctctacgacaacgtattacgaacgtacgttacgtacggggtacctaggaacggtaccgacggtacctacgttacgttaacgtttacggtcggttacggaccggtaaggtaaccggtaactaacccggtaaaattacggtttacggttacgtacgttaacgg

SEQ ID NO: 162075 - DNA, 566 bp, Homo sapiens
  misc_feature: GYAE6OF02JCM1U.35.25.C03.1.454.CMB.1.raw
  modified_base (302)..(302): a, c, t, g, unknown or other
  misc_feature (302)..(302): n is a, c, g, or t
  modified_base (381)..(381): a, c, t, g, unknown or other
  misc_feature (381)..(381): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtctgggggcggcgtggtccagcctgggaggtccctgagactctcctgtgaagcctctggattctccttcaaagaactatggcatgcactgggtcccnccaggctccagggcaaggggctgggaggtgggtggctaggtgatagtctagtttgatggaaagtaaataaacagttacngtaagacctccggtagaacgggcccgattcacctatccctcgaacgacgaactaacttaccgaagaacctacgttctgtaccttctacgcaactatacgaactacgtcgtacggacttgacggacgtacggctcgtacgtacttcgtgtgacgaagagtactaacgaaattgtgtacgataacgg

SEQ ID NO: 162076 - DNA, 513 bp, Homo sapiens
  misc_feature: GYAE6OF02HZRAV.35.25.C03.1.454.CMB.1.raw
  modified_base (452)..(452): a, c, t, g, unknown or other
  misc_feature (452)..(452): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtctgggggcggcgtggtccagcctgggaggtccctgagacctctcctgtgaagcctctggattctccttcaagaactatggcatgcactgggtcccgcaggctccaggcaaggggctgggagtggggtggcaggtgatatcatttgatggaataaataaacattacgcagactcgtgaacggggccattccacatctaccagacacaattccaaagaacactctgtactctgcacatgaacagtcgngggacctgaggaccaggctgtctagttacgtgtgcgagagatacgaattgtgtcgattagg

SEQ ID NO: 162077 - DNA, 566 bp, Homo sapiens
  misc_feature: GYAE6OF02FY304.35.25.C03.1.454.CMB.1.raw
  modified_base (384)..(384): a, c, t, g, unknown or other
  misc_feature (384)..(384): n is a, c, g, or t
  modified_base (454)..(454): a, c, t, g, unknown or other
  misc_feature (454)..(454): n is a, c, g, or t
tcagtacagatcgtcacgaccggtgctcgatttagtagtgtagatttgggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtctgggggcggcgtggtccagcctgggaggtccctgagactctcctgtgaagcctctggattcctccttcaagaactatggcatgcacgtgggtcccgccaggctccgaggcaaggggctgggagtgggtggcaggtgagtatctatttggaatggaaagttaataaaacattacganagacctcggtagaacgggccgattcaccatctcagacgaacaacttaccaagtaacactactgtccttcngtacactatagaactgtcgtacgggacctggacggaccgacggccttagtcctacgttacgtggtacgacggtagtaagacttaacggaattacgttagtacgtcgttaagg

SEQ ID NO: 162078 - DNA, 602 bp, Homo sapiens
  misc_feature: GYAE6OF02HT2ZU.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcacggaacacagaggactcaccatggagtttgggctgagctgggttttcctcgttgctcttttaagaggtgtccagtgtcaggtgcagctggtgcagtctgggggcggcgtggtccagcctgggaggtccctgagactctcctgtgaagcctctggattctccttacaagaactatggcatgcacgtgggtcccgcaggcctccgaggcaaggggctgggagtggggtggcaggtgatatctaagtttgaagttaggaaagttaataaaactattaaccgctaagacctccggtaggaacgggcctatttcacctactactaccaagagaactaattaccaaagaacactctagtctactcgacactatacgaacgtacgttccgtacgggaccttaggaacgggaacacgggtctacgttacttatttacgtggttacggacgaagtaagtaacgtaacgtaaattacgttagttacggtacgtaagtaacgg

SEQ ID NO: 162079 - DNA, 643 bp, Homo sapiens
  misc_feature: GYAE6OF02IZ55F.35.25.C03.1.454.CMB.1.raw
  modified_base (302)..(302): a, c, t, g, unknown or other
  misc_feature (302)..(302): n is a, c, g, or t
tcagtacagatcgtcacgaccggtgctcgatttagtagtgtagatttgggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcgcgtggtccagcctgggacgtccctgagactctcctgtgaagcctctggattctccttcaagaactatggcatgcacgtgggtccncaggctccgaggcaaggggctggagtcgggtgcagtgatagtctagttgataggaaagtaataaaacattaacgctaagtacttaccggtagaacgggtccgaagttccaaccatacctaccgaagtaacgaacctaaacttaccgaaagtaaacctaacgttccgttagttacctcctagtaccgtaactaacgttacggaaactacggtccgtaacggggtaccttaggaacggaacgaccggtacttacgttacttaacgtttaacgttggtacggttaccggaagttaaggtaacgttaacggtaaaagttacgtttaggtacgtacgttaaacggg

SEQ ID NO: 162080 - DNA, 553 bp, Homo sapiens
  misc_feature: GYAE6OF02IKKYT.35.25.C03.1.454.CMB.1.raw
  modified_base (265)..(265): a, c, t, g, unknown or other
  misc_feature (265)..(265): n is a, c, g, or t
  modified_base (429)..(429): a, c, t, g, unknown or other
  misc_feature (429)..(429): n is a, c, g, or t
tcagtacagatcgtcacgaccggtgctcgatttagtagtgtagatttgggtttgggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagccgtgggacggtccctgagactctcctgtgagcctntggattctccttacaagaactagtggcatcgcacgtcggggtcccgccaggcctccgaggcgaaggggctgggaggtggggtggcaggtgatatctattgagtggaaataataaacattacgcagactccggtagaacgggccgtatacaccactctaccaganacaattaccaaagaactactctcgtctctcacacatacgactagtcgtggaccgtggacggacacggtctgtacttagttcgtgtgacgagaagacgttaacgaaagttattaggtcgagtagg

SEQ ID NO: 162081 - DNA, 172 bp, Homo sapiens; identical to SEQ ID NO: 162066
  misc_feature: GYAE6OF02HHGTD.35.25.C03.1.454.CMB.1.raw

SEQ ID NO: 162082 - DNA, 639 bp, Homo sapiens
  misc_feature: GYAE6OF02HS15L.35.25.C03.1.454.CMB.1.raw
  modified_base (509)..(509): a, c, t, g, unknown or other
  misc_feature (509)..(509): n is a, c, g, or t
tcagtacagatcgtcacgaccggtgctcgatttagtagtgtagatttgggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagcctgggaggtcctgagactctcctgtgagcctctggatttctcccttacaagtaactagtggacatgacacgtcgggtcccgccgaggcctccgagggccaagggggctagggagtggggtgcgagtgatatctagtttgagttaggaaagttaaataaaacgtattaacgacaagtaccgtcggtagggaacgggccgtaagttaccaacctactcctaccgaagaacgtaactaaacgttaaccaaacgaacctacttacctagtcctacgtcgaccanactacgaacgacgttaccggtacgggtacctaggacggacgtaccgggtcgttacgttacgttacgtttaacgtggtacgacggagaacgtaagtaacggtaaattacggtttagtacgtagttaacggg

SEQ ID NO: 162083 - DNA, 522 bp, Homo sapiens
  misc_feature: GYAE6OF02HHI5Y.35.25.C03.1.454.CMB.1.raw
  modified_base (301)..(301): a, c, t, g, unknown or other
  misc_feature (301)..(301): n is a, c, g, or t
  modified_base (341)..(341): a, c, t, g, unknown or other
  misc_feature (341)..(341): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (394)..(394): a, c, t, g, unknown or other
  misc_feature (394)..(394): n is a, c, g, or t
  modified_base (402)..(402): a, c, t, g, unknown or other
  misc_feature (402)..(402): n is a, c, g, or t
  modified_base (517)..(517): a, c, t, g, unknown or other
  misc_feature (517)..(517): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtctgggggcgcgtggtccagcctgggagtccctgagactctcctgtgaagcctctggacttctccttcaaagaactatggcatgcactgggtcccncaggctccgaggcaaggggctggagtgggtgcagtgactntcatttgatggaattaanaaactnttacgctagactcgtagaacggcatcacntctcaganacaattaccaagaacactctgtctctcgcacatacgaacacgtctacgggacctaggaggaccacggtctgtctagtacgtgtcgacgtagagtagtaacgtaaatagttgtagntaagg

SEQ ID NO: 162084 - DNA, 735 bp, Homo sapiens
  misc_feature: GYAE6OF02HVDT0.35.25.C03.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagtacagatcgtcacgaccggtgctcgatttagtagtgtagatttgggtttgggggggagaggagcccagcactagaagtcggcggtgttccattcggtgatcagcactgaacacagaggactcaccatggagtttgggctgagctgggttttcctcgttgctcttttaagaggtgtccagtgtcaggtgcagctggtgcngtctgggggcggcgtggtccagcctgggagtccctgagactctcctgtgacgcctctggattctccttcaagactatggcatgcacgtcgggtcccnccacggctccgaggcgaaggggctgggagtggggtgcagtgatatctatttgagtaggaattaaataaaacctagttacgacgtaagtaccgtacgggtacgggaaacgggtcccgtaagtttacccgtaaccctaacccgtttaacccgtacccgtaaaggaaccggtaacctaaaactttacccccgaaaaaggtaaacccctaacgttcccgttaccgttaccgttaccgtccggtaaccctaacgtacgtaaccgaaaccgtaccggttcggttacccgggggtaacccttagggaaccgggacctaaccggggtcttacgggttaccttaacggtttaccttacggggttacgtaacccgggttaagaaccgggttaaacgtaaccggttaaaaggtttagtttacggttacggttacgttaaaacgggg

SEQ ID NO: 162085 - DNA, 747 bp, Homo sapiens
  misc_feature: GYAE6OF02FFJ93.35.25.C03.1.454.CMB.1.raw
  modified_base (263)..(263): a, c, t, g, unknown or other
  misc_feature (263)..(263): n is a, c, g, or t
  modified_base (304)..(304): a, c, t, g, unknown or other
  misc_feature (304)..(304): n is a, c, g, or t
  modified_base (347)..(347): a, c, t, g, unknown or other
  misc_feature (347)..(347): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcgcgtggtccagcctggggacgtccctgacgactctcctgtgaagcctntggattctcttacaagaactatggcatgcacgtcgggtccncaggctccgaggccgaaggggtctgggacgtggggtgcaggtnattatctaagtttgaagtaggtaaaagtaataaaacgtattaaccggactaacggtaccttacccgggtaggaaacggggtcccgtaagtttacccaaccgtacttacccgtacccgaaaggtaacggtaaaccttaaaacgttaacccgaaaacggtaaaccctaccgttacgttcggttacccttaccgtacggtacccaacgttaagtaaccggtaaaccgtacggtttacccgggttaacggggttaacccgtaagggtaaaccgggtaaccgtaaccggggtccgtttacggtaccgtttaacggtttaaccgtggtaaccggtaacggtaaggtaaaccggtaacgttaaaccggttaaaactttaggttacggttacggtacgtttaaacggg

SEQ ID NO: 162086 - DNA, 171 bp, Homo sapiens
  misc_feature: GYAE6OF02F3FCC.35.25.C03.1.454.CMB.1.raw
  modified_base (168)..(171): a, c, t, g, unknown or other
  misc_feature (168)..(171): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagcgggctggcaaggcgcatagnnnn

SEQ ID NO: 162087 - DNA, 500 bp, Homo sapiens
  misc_feature: GYAE6OF02JD1WR.35.25.C03.1.454.CMB.1.raw
  modified_base (299)..(299): a, c, t, g, unknown or other
  misc_feature (299)..(299): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (451)..(451): a, c, t, g, unknown or other
  misc_feature (451)..(451): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtctgggggcgcgtggtccagcctgggaggtccctgagactctcctgtgaagcctctggattctccttcaataactatggcatgcactgggtccnccaggctccaggcaagggctggagtggttgcagttgngtggtangatggaagtaatagatactatgcagacacgtgaaggcgatcacatcncagaganaactcaagaacactttgttcctgacaaatagaacagctgagagccgagacacgngatatatactgtgcgagaagcgagtcgggagcccgtaccccggatgacg

SEQ ID NO: 162088 - DNA, 576 bp, Homo sapiens
  misc_feature: GYAE6OF02FJX0J.35.25.C03.1.454.CMB.1.raw
tcagtacagatcgtcacgaccggtgctcgatttagtagtgtagatttgggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggggggagtcgtggggggaggcgtggtccagcctggggagtccctgagactctcctgtgcagcgtctggattcaccttcagtagttatggcatgcacgtgggtccgccaggctccgaggcgaaggggctgggagtgggtgcagttatagtggtatgatggaagtcaataaagctatgacagactccgtagaacgggccgatcacatctacagagacaataccaagaacacgctacgtatctagactaaagtcgaacacgaccgtagaacgacgacccgaacggacgaccggtacttaggtagttacgttaacgtaggttacggacggtaacgaaccgtaacggtaacggaaggtagtacgggaccttaacgtaacgg

SEQ ID NO: 162089 - DNA, 580 bp, Homo sapiens
  misc_feature: GYAE6OF02HA73F.35.25.C03.1.454.CMB.1.raw
  modified_base (437)..(437): a, c, t, g, unknown or other
  misc_feature (437)..(437): n is a, c, g, or t
tcagtacagatcgtcacgaccggtgctcgatttagtagtgtagatttgggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagccgtgggaggtccctgagactctcctgtgaagcctctggtattctccttcaataactatggcatgcacgtcgggtccgccgaggcctccgagggccgaagggggctgggaggtggggtggcgtagttataggtggtatgagtacggaagtacgaataaagactatgacagactccggaggaacgggcctagtcaccatcctacgaaganaacgtaactcgaaagaaccacgtcgtatactctagaactaaagtacgaaccgacgaccgtagaacgtacgaccgaacgaccgacggctagtagtattacgtggtagacgaacgaacgtacgtagaacgtgtacggtactaacg

SEQ ID NO: 162090 - DNA, 682 bp, Homo sapiens
  misc_feature: GYAE6OF02JU40Y.35.25.C03.1.454.CMB.1.raw
  modified_base (160)..(160): a, c, t, g, unknown or other
  misc_feature (160)..(160): n is a, c, g, or t
  modified_base (253)..(253): a, c, t, g, unknown or other
  misc_feature (253)..(253): n is a, c, g, or t
  modified_base (276)..(276): a, c, t, g, unknown or other
  misc_feature (276)..(276): n is a, c, g, or t
tcagtacagatcgtcacgaccggtgctcgatttagtagtgtagatttgggtttggggggggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtgcagtcgtgggggcgcgtggtccaggcctgggaggtccctgagactctccngtgaagcctctggattcctcttnaagtaactagtgcatcgcctacgtcgggtcccgcgaggtcctaccgagggtaccgaaggggtccttgggtagggtggggtcggcaggttagatatcgtaagtttacggagtagggtaaaataattaaaacagttaccggactaacggtaccgttacgggacgtaacgggccgtactttccaaccgtacgtccctaacgacggtaactaaacctaacgttaaccaaacgtaacctacttacctcggttaacccttcgtacacgtaacacggtacaacgtacggttccggacggtacctagggaaaccggtccgtacgggaccttagtaccgtttaacgttcggtacgtacggtacggtaagtaacgtaacgtaaacggttaagtaccgttaggtagtaccgttaagg

SEQ ID NO: 162091 - DNA, 784 bp, Homo sapiens
  misc_feature: GYAE6OF02GMGWD.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagccgtggggagtccctgacgactctcctgtgaagcctctggtattcctccttacaaagaactagtggcatgcacgtcgggtcccgcgacggctccgaggcgaaggggctgggagtgggtgcgaggtgatatctagtttgagtaggaaagtaaataaaactagttaccgacaacgaccgttaccggtaggaaacggggtacccgtaacgtttacccaacccgtaagttacccctaccgtaaacggtaacgtaaaccgtaaaccttaacccgaaaaaccggtaaacctaaccgtttaccgtttaccgttacccttaccgttaccggtaccctaaacgtaacgttaacggaaaccgttaacgggttaccggttaccggggtaacccgttacgggtaaacccgggtaacccgggtaacccgggttaccggtttaccggtttaacccgtttaaccggttttaacggttcgggttaaccggtaccggtaacgggtaaacggttaaacgttaaacccgggttaaaaagttttacggttacggtttaccggtacggtttaaacggg

SEQ ID NO: 162092 - DNA, 595 bp, Homo sapiens
  misc_feature: GYAE6OF02F6L7O.35.25.C03.1.454.CMB.1.raw
tcagtacagatcgtcacgaccggtgctcgatttagtagtgtagatttgggtttgggggggggagaggagcccagcactagaagtcggcggtgtttccattcggtgatcagcactgaacacagaggactcaccatggagtttgggctgagctgggttttcgtcgttgctcttttaagaggtgtccagtgtcaggtgcagctggtgcagtctgggggcggcgtggtccagcctgggaggtcccctgagactctcctgtgaagcctctggattctccttcaagaactatggcatgcacgtgggtcccgccaggcctccgaggcgaagggggctgggagtggggtggcagtgatatctagtttgatggaaagttaataaaactagttacgcaagtaccgttccggtagggaacgggccgtattaccacctactcctaccaagacgaactaacttaccaaagtaaccactctagtcctctgccaactatacgactagtcgtacgggtacctaggacggaccgacggtctacgttactacgttacgtggtacggacgtaagtagtaacgttaacggtaaattagtttgtacgtcgtaacgg

SEQ ID NO: 162093 - DNA, 623 bp, Homo sapiens
  misc_feature: GYAE6OF02HH3GD.35.25.C03.1.454.CMB.1.raw
  modified_base (176)..(176): a, c, t, g, unknown or other
  misc_feature (176)..(176): n is a, c, g, or t
  modified_base (267)..(267): a, c, t, g, unknown or other
  misc_feature (267)..(267): n is a, c, g, or t
  modified_base (317)..(317): a, c, t, g, unknown or other
  misc_feature (317)..(317): n is a, c, g, or t
  modified_base (396)..(396): a, c, t, g, unknown or other
  misc_feature (396)..(396): n is a, c, g, or t
tcagtacagatcgtcacgaccggtgctcgatttagtagtgtagatttgggtttggggggggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtgcagtcgtggggcgcgtggtccagccgtggggacgtccctgacgacctctcctggtgaacgcctntggacttcgtccttacaagtaaactgtcggcatcgcctacgtcgggcccnccgaggcctcgaggcgaaggggctggggagtggggtcgctaggtgatagtctagttgaagtaggaaataaataaacgtntaacgcaagtaccgtcggaggaacggcctagtaccacctacgtccacgagaagaactaacttaccaaacgaacctaacgtcgtacgtcctcgtagaccaactacgtacaacgtacgtcgtaccgggacttacgggacggaacgtcggtactacgttcttaagttccggtagtccggaagtaacgaagttaacgttaagtaagttacggttaggtacgtagttaacgg

SEQ ID NO: 162094 - DNA, 734 bp, Homo sapiens
  misc_feature: GYAE6OF02JOVEN.35.25.C03.1.454.CMB.1.raw
  modified_base (174)..(174): a, c, t, g, unknown or other
  misc_feature (174)..(174): n is a, c, g, or t
  modified_base (225)..(225): a, c, t, g, unknown or other
  misc_feature (225)..(225): n is a, c, g, or t
  modified_base (293)..(293): a, c, t, g, unknown or other
  misc_feature (293)..(293): n is a, c, g, or t
tcagtacagatcgtcacgaccggtgctcgatttagtagtgtagatttggtttgggggggtaggaggagcccagcactagaagtcggcggtgtttccattcggtgatcagcactgaacacagaggactcaccatggagtttgggctgagctgggttttctcgttgctctttaagnggtgtccagtgtcgaggtgctagctggtgcagtcgtggggcgcgtggtccngcctgggacgtccctgagctctcctgtgacgtcctcgtggtacttctccgttaccaaagtaaccttgnggcagtcgccacgttcggggcccgtaccaggtcctacccgaggtccggaaaggggtcctagggacgggttgggggtacggaccgtaggttacgagttagttaccctagttttaggaagttacggtaaaaggtaaacttaaaaccagtttaacgccgaacgtaccgttccggtaggggaaacggtcccggtaacttcccgaaccgtacgttacccgtaccgaacggtaagtaacccgtaaactttacccgaaaagtaaacccttacgtcgtttaacgtccgttaacgttccgaccaacgtaacttaaccgaacgttaccgtaaccgtacggggtacctaggaaacggtacgtacggtccttacgtacgttacgttaacgtcggtaacggtcggtaacgagtacgttaaaccgtaagtttacgtacggttcgaccgttaacgg

SEQ ID NO: 162095 - DNA, 202 bp, Homo sapiens
  misc_feature: GYAE6OF02GURTL.35.25.C03.1.454.CMB.1.raw
  modified_base (173)..(202): a, c, t, g, unknown or other
  misc_feature (173)..(202): n is a, c, g, or t
tcagtacagatcgtcacgaccggtgctcgatttagtagtgtagatttgggtttgggggaagaggaagactgacggtccccccaggagttcaggtgctggcacagcggccctgggctgcctggtcaaggactacttccacgatctgtactgagcgggctggcaaggcgcatagnnnnnnnnnnnnnnnnnnnnnnnnnnnnnn

SEQ ID NO: 162096 - DNA, 756 bp, Homo sapiens
  misc_feature: GYAE6OF02IL96D.35.25.C03.1.454.CMB.1.raw
  modified_base (281)..(281): a, c, t, g, unknown or other
  misc_feature (281)..(281): n is a, c, g, or t
  modified_base (317)..(317): a, c, t, g, unknown or other
  misc_feature (317)..(317): n is a, c, g, or t
  modified_base (577)..(577): a, c, t, g, unknown or other
  misc_feature (577)..(577): n is a, c, g, or t
  modified_base (637)..(637): a, c, t, g, unknown or other
  misc_feature (637)..(637): n is a, c, g, or t
tcagtacagatcgtcacgaccggtgctcgatttagtagtgtagatttgggtttgggggggtaggaggagcccagcactagaagtcggcggtgtttccattcggtgatcagcactgaacacagagactcaccatggagtttggctgagtctgggttttcctcgtttgcttcttttaaggaggttcgtccagttgtcaggtgcaggtctggtgctagtcgtgggggcgacgtggtacccagcccgtagggacggtccctaggaacggtccttccgtccttggngaacgtcccttgtaggtactttccttccccgtttanaaacgtaacctttagacggacctagtcgcctacggtcggttcccgaccgtcggccttaccggacggccgaaacgggggtcctaggggtaacgggttggggtcggacgaaggttagaacgttagtcgttaagttcgaagttaggaaaacgtttaaactaaaacgttaagtaccgagtaaacgacccgttcggaggtaacccgggtcgtaactttacgaaccttacgtccgtaaccgaaggtacaacgttaactaaccgaanaaacctcgtacttcgtaccttcgctacacgtagtacgaacgtagttcccgacgggtaccngggaaccgtaccgaacggttcccgtagttaacgtttaaccgttcgggtccgttaaggtccgtaaaggaaccggttataaaccggttaaaagttccgtttacggtacggtaggtttaagg

SEQ ID NO: 162097 - DNA, 688 bp, Homo sapiens
  misc_feature: GYAE6OF02JF26Q.35.25.C03.1.454.CMB.1.raw
  modified_base (174)..(174): a, c, t, g, unknown or other
  misc_feature (174)..(174): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttggctgagctgggttttcctcgttgctcttttaagnggtgtccagtgtcaggtgcggctggtgcagtcgtgggggcggcgtggtccagcctggggacgtccctgagacctctccgtgtgaactcctctggtattctccttcaaagaactagtggcatcgcacgtcgggtccgcgaggctccgaggcgaaggggctggaggtgggtggcgaggtggatagtctagtttgagtaggtaaagttaaactaaacgtagttacgacgtaacgtacctaccggtaggaacgggccgtaatttaccgaacctacgtaccgtaacccgacggtaaacgtaaccgtaacgttaaccgaaacgtaaacccgtaaccttcgttaccgttacccgtttacgtacgtaccaaccgttacgtaacggtaaaccgtacggttaccggtaacggggtaaccgtcgggaacggtaccggtaacggtccgttacggtacttacgttacgtggtcggacggtaagaacgtaacgtaacgtaattcgttaggtacgttacgtaagtacgg

SEQ ID NO: 162098 - DNA, 571 bp, Homo sapiens
  misc_feature: GYAE6OF02FUR8X.35.25.C03.1.454.CMB.1.raw
tcagtacagatcgtcacgaccggtgctcgatttagtagtgtagatttgggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtctgggggcggcgtggtccagcctgggacggtccctgagactctcctgtgaagcctctggattcctccttcaagaactatggcatgcacgtgggtcccgccgaggcctccgaggcgaagggggctgggagtggggtgcaggtgatatcgtatttgatggaaagtaataaactattacgcagacctcggtagaacgggcctattccacctatcctaccgaagacgaactaacttaccgaaacgtaacctactctgttcctctacgcactatacgaactagtcgtacggaccgtaggacggaccacggtctgtactagttactggtagcggtagagtaactaacggtaattagttgtacgtataagg

SEQ ID NO: 162099 - DNA, 806 bp, Homo sapiens
  misc_feature: GYAE6OF02F370J.35.25.C03.1.454.CMB.1.raw
  modified_base (325)..(325): a, c, t, g, unknown or other
  misc_feature (325)..(325): n is a, c, g, or t
tcagtacagatcgtcacgaccggtgctcgatttagtagtgtagatttgggtttgggggggagaggagcccagcactagaagtcggcggttgtttccattcggtgatcagcaccgaacacagaggactcaccatggagtttgggctgagcgttgggttttcctcgttgcttcttttaagaggtgtccagtgtcaggtgcagtcgtggtgcgtaggtcggtgggggcgcggtggtccagccgtgggcgtcctagacgtctcgtcgtgtacgactcctgtgtacttcctccttacaagtactagtggcatcgactcggtcgggtcccncgacggtccctaccgggacggacgggtaccgggtaggtggggtacggttcgggggtggaccgtaggttcggtaattcgttacgttaagtttaggtaacggtaaaggtaaaaacgtttaaaacgttaaaacgtacgttaacggaccgtaaacgttacccggttaccggggtaacggtaaaccgggtccttaaccgtacctaaacgtacccttaaccgtaccgaaagtaaccgtaaaaccttaaccgtaaaccgtaaacgaaccttaccgttacttcccgttacccgtagtacccaacgtaacctaacgtcgttaaaccggtcggtttacccggtaacggtaaccggtaggaaacccggtacggtaccgtttaccgttaacttacctttaccggttagggtcgtaacggaacggtaacgtaacgggttaaactaagttaacgtttaacgggttacgtacgttaccgggtagttttaaaccggg

SEQ ID NO: 162100 - DNA, 197 bp, Homo sapiens
  misc_feature: GYAE6OF02IEEYH.35.25.C03.1.454.CMB.1.raw
  modified_base (175)..(197): a, c, t, g, unknown or other
  misc_feature (175)..(197): n is a, c, g, or t
tcagtacagatcgtcacgaccggtgctcgatttagtagtgtagatttgggtttggggggaagaggaagactgacggtccccccaggagttcaggtgctgggcacagcggccctgggctgcctggtcaaggactacttccacgatctgtactgagcgggctggcaaggcgcatagnnnnnnnnnnnnnnnnnnnnnnn

SEQ ID NO: 162101 - DNA, 137 bp, Homo sapiens
  misc_feature: GYAE6OF02I2FBS.35.25.C03.1.454.CMB.1.raw
  modified_base (130)..(137): a, c, t, g, unknown or other
  misc_feature (130)..(137): n is a, c, g, or t
tcagtacagatcgtcacgaccggtgctcgatttagtagtgtagatttgggtttgggcacagcggccctgggctgcctggtcaaggactacttccacgatctgtactgagcgggctggcaaggcgcatagnnnnnnnn

SEQ ID NO: 162102 - DNA, 784 bp, Homo sapiens
  misc_feature: GYAE6OF02HXRBE.35.25.C03.1.454.CMB.1.raw
  modified_base (254)..(254): a, c, t, g, unknown or other
  misc_feature (254)..(254): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtggggcggcgtggtccagcctgggacggtccctgagactctcctgngacgcctctggtacttctcctttcaagtaactatggacagtcgcacgtcgggtcccgccgacggcgtccgacggcgaaagggggtcctgggtacggtggggtcggtcgaaggtgtacgttagttaccgtaagtttttagagtttacggggaaaagtttaaaacgtaaaaacgtaagtttaaccggaccaaacggtaccgtttacccggtaacggggaacgggggtacccggttaacgtttacccggaaacccttaacgtacccgttacccaacggtaaaccgtaacccgtaaaactttaccccgaaaacgtaaaccgtaaccctttaccgttacggttaccttaccgttcgaacctaaccggtaaattacggtaaactaccggttacggtcggggaaccgttaacgggaacggtaacccgtagggtcctttacgtttccgtttaagtttaccggtaggtttacggacggttaaggtaacggtaacgttaaacggtaaacgttaagtttacggttacggtaccgtttaagg

SEQ ID NO: 162103 - DNA, 721 bp, Homo sapiens
  misc_feature: GYAE6OF02JMX1F.35.25.C03.1.454.CMB.1.raw
  modified_base (151)..(151): a, c, t, g, unknown or other
  misc_feature (151)..(151): n is a, c, g, or t
  modified_base (253)..(253): a, c, t, g, unknown or other
  misc_feature (253)..(253): n is a, c, g, or t
  modified_base (304)..(304): a, c, t, g, unknown or other
  misc_feature (304)..(304): n is a, c, g, or t
  modified_base (435)..(435): a, c, t, g, unknown or other
  misc_feature (435)..(435): n is a, c, g, or t
  modified_base (555)..(555): a, c, t, g, unknown or other
  misc_feature (555)..(555): n is a, c, g, or t
tcagtacagatcgtcacgaccggtgctcgatttagtagtgtagatttgggtttgggggggtaggagggaggcccagcactagaagtcggtggtgtttccattcggtgatcagcactgaacacagaggactcaccatggagtttgggctganctgggttttcctcgttgctcttttaagaggtgtccagtgtcaggtgctagctgggtggacgtcgtggggggaggcgtggtcccagccgtggggacggtcccngacgactctcctagtgaagcgttctggattcattctaccaaattaaccttnaggtcattgcaaccgtttcggggcccgtaccgaggtcctacccgagggtaccgaaggggacctgggacggttgggttacggctagggtttgtaggttgtatggacgttagggtaacggtaaatagggtaanaccgttatacgtacgaaacggtacgaaccggtggaaaccggggggtcaaaccgtttaccaaccgtactttacgacccagtacgaaactacctacgaaacgtacttacgttcgttccgtanaaccgtaactataacccgggaactccctaagggacgaaccgtccgaacgggtacgtaaccgggacgtattaacgttacgttacgtagggttaccacgggtaagaaccgtaggtaccgggttaagggacccgtaacccccggtaaccccgggttagtacgaaccggg

SEQ ID NO: 162104 - DNA, 176 bp, Homo sapiens
  misc_feature: GYAE6OF02GKK0D.35.25.C03.1.454.CMB.1.raw
  modified_base (175)..(176): a, c, t, g, unknown or other
  misc_feature (175)..(176): n is a, c, g, or t
tcagtacagatcgtcacgaccggtgctcgatttagtagtgtagatttgggtttggggggaagaggaagactgacggtccccccaggagttcaggtgctgggcacagcggccctgggctgcctggtcaaggactacttccacgatctgtactgagcgggctggcaaggcgcatagnn

SEQ ID NO: 162105 - DNA, 688 bp, Homo sapiens
  misc_feature: GYAE6OF02I52BT.35.25.C03.1.454.CMB.1.raw
  modified_base (186)..(186): a, c, t, g, unknown or other
  misc_feature (186)..(186): n is a, c, g, or t
  modified_base (296)..(296): a, c, t, g, unknown or other
  misc_feature (296)..(296): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
tcagtacagatcgtcacgaccggtgctcgatttagtagtgtagatttgggtttggggggggagaggagcccagcactagaagtcggcggtgtttccattcggtgatcagcactgaacacagaggactcaccatggagtttgggctgagctgggttttcctgttgctcttttaagaggtgtccagtntcaggtgcagtctggtgcagtcgtgggggcgcgtgtccagccgtgggacggtccctgacgcctctccgtgtgaacgcctgtggtattcctccttcaagaccttagtggcntcgcgacgtcgggtcccgccgaggtcctaccgagggacccgtaagggggtctaggggtagggtcgggngggtacgtaggtanacgtttacgcttaaacgtttgagtaagggtaaagtaaaacgttaaaacctaaggttaccgaactaaccggtaccgttaaccgggtagggaaccggggtaccgtaacttacccgaacctaactccgtacccaagaagtaaccgtaacttaccaaacggtaacctacgtttctaacgttcctctacggacctaaccgtagtaacgaactacgtcggtacggtcgtacggaacgtacgtaccgtctcggttactactacggtgtacggtacgaaggtagacgttaacgtaaattggttacgacgtcttaacgg

SEQ ID NO: 162106 - DNA, 733 bp, Homo sapiens
  misc_feature: GYAE6OF02FF331.35.25.C03.1.454.CMB.1.raw
  modified_base (177)..(177): a, c, t, g, unknown or other
  misc_feature (177)..(177): n is a, c, g, or t
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (332)..(332): a, c, t, g, unknown or other
  misc_feature (332)..(332): n is a, c, g, or t
  modified_base (673)..(673): a, c, t, g, unknown or other
  misc_feature (673)..(673): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagcttgggttttcctgttgcttacttttaagnggtgtccagtgtcaggtgcagctggtgcaggtcgtgggggcgtcgtcggtccncgtccgtgggacgtccctaggacnctctaccgtggtacgaacgtcctcgtcgtacttcctctacgaagacttagtcggactagtcgccgtcttccgggcccncgtagcctacggaggtaccggaggggttccgagggtaggtcgggtcgactaggtactagtcgtacgtaagtttggaacgttaaggtaaaactaacgtaaacgtcgtaaccggacgttaaccgtacccggttacggaacgggtacccggtaccttaacttaccggaaccttaccgttaaccccggtaacaaacgtaaaccgtaaaccttaaacccgtaaccgtaaaccgtaaccttacggtcctaccgtttacccagacctacgaacgtacgtaccgaacgtacgtccggtaacggtacccgagaaccggtctaccgtacgtttcgtaacttacggttacgngaacggtacgtagtaaacgtacgtaaacgtaacttcgggtacgtacgttaacgttaacgg

SEQ ID NO: 162107 - DNA, 781 bp, Homo sapiens
  misc_feature: GYAE6OF02HU9XS.35.25.C03.1.454.CMB.1.raw
tcagtacagatcgtcacgaccggtgctcgatttagtagtgtagatttgggtttggggggggagaggagcccagcactagaagtcggcggtgtttccatccggtgatcagcactgaacacagaggactcaccatggagtttgggctgagcttgggttttcctcgttgcttcttttaagaggtgtccagtgtcaggtgcagctggtggagtcgtgggggaggcgtggtccagccgtgggacggttcccgtgagacctcctccgtgtgaagcgtctggattcattcttacaattaactagtggcatgcacgtgggtccccgccgaggcctaccgagggaccgaaggggacgttggggtaggttgggtttacgggcttagggtttgttcgggtagggttataggtagttaaggggtaaagttaaaagttaaggtaaatttaaaccggttagttacgaccgttaaacggaacccgtaacccggggtttagggaaaccggggtacccgtaactttacccgaaacccgttacttacccgtacgaaagtaaccgaaactaaccgttaaacccgaaacgttaaacttccgtttttacgttcccgttaacgtaacctaaacgtacgaaacccgtacgacccgttaagacgaaccgggtaccggaacggtaaaccgaacgggttacgaatttaacgttgtttaaccggtggtaaccggtagaaacggtaacggtaccggttacggacgggtaccccggtaccccccggtaacccggtaggacgtaacccggg

SEQ ID NO: 162108 - DNA, 654 bp, Homo sapiens
  misc_feature: GYAE6OF02H1HD5.35.25.C03.1.454.CMB.1.raw
  modified_base (207)..(207): a, c, t, g, unknown or other
  misc_feature (207)..(207): n is a, c, g, or t
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
tcagtacagatcgtcacgaccggtgctcgatttagtagtgtagatttgggtttggggggggagaggagcccagcactagaagtcggcggtgtttccattcgggtgatcagcactgaacacagaggactcaccatggagtttgggctgagcttgggttttcctcgttgcttcgttttaagaggtgtccagtgtcaggtgcagctggtncaggtcgtgggggacgcgtggtccaggcctggggtagtccctgagactctctgtgagcctntggacttctccctanaagtaacctagtcgganagtcgctacgtgggccccaccaggcctccgaggccgtaaggggcgtagggtggtaggggtcggacaggtcgaagttacgtactagtttcggaaggtaggtaaaggttaaacttaaaaaccggtttaaaccgctaaaggtacccttacgggtaagggaacgggcgttattaccgacctaacgttcacgtactagaactaacttaccgaacaacgtactactgtcctactacgcaactataccggtaatccgtaacgtcgggtaacgacggtacggaacgtaccggtactgttaccgtatttacgtcggtacggtacgaagtacaaggtaacgtaagtagttagtacgacttaagg

SEQ ID NO: 162109 - DNA, 180 bp, Homo sapiens
  misc_feature: GYAE6OF02J05GW.35.25.C03.1.454.CMB.1.raw
  modified_base (173)..(180): a, c, t, g, unknown or other
  misc_feature (173)..(180): n is a, c, g, or t
tcagtacagatcgtcacgaccggtgctcgatttagtagtgtagatttgggtttgggggaagaggaagactgacggtcccccaggagttcaggtgctgggcacagcggccctgggctgcctggtcaaggactacttccacgatctgtactgagcgggctggcaaggcgcatagnnnnnnnn

SEQ ID NO: 162110 - DNA, 658 bp, Homo sapiens
  misc_feature: GYAE6OF02JO7BN.35.25.C03.1.454.CMB.1.raw
  modified_base (544)..(544): a, c, t, g, unknown or other
  misc_feature (544)..(544): n is a, c, g, or t
  modified_base (591)..(591): a, c, t, g, unknown or other
  misc_feature (591)..(591): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggtttttcttgtggctatttaaaaggtgtccagtgtgaggtgcagctgttggagtcgtgggggaggtcttggtacaggtccgtgggggggtccccgtggacgtacctcgtcccttggtcgaacgtccctcgtaggattcctaaccgtttacggaactatcgccatgtcgcgtcggggtccgccgaggccgtaccgagggggtaacgggccgtgggacggttgggtcctacgagtttagtacggtggttaggtggtagtactacgtactacgacctacgcacgtcgtacccgtaggaacgggtcccgttaccactactccgacagtacgaccgtaacttccaaagacctaccagtactaacgtacctgtaacaaagttacgaaacgcacgtacgngacgtcgagaccgacggactattattacgtcgtacgacgaacgtacntacgtccggtattaagtacgtaacgttcgtaacgtcgggtaacttaacggtaacttggtacgttacg

SEQ ID NO: 162111 - DNA, 693 bp, Homo sapiens
  misc_feature: GYAE6OF02FXORH.35.25.C03.1.454.CMB.1.raw
  modified_base (280)..(280): a, c, t, g, unknown or other
  misc_feature (280)..(280): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagcttggggttttccctcgttgcttcttttaaagaggtgtccagtgtcagggtgcagcgtggtgcaggtcgtgggggccgcgtggtccaggccgtggggacgtcccctgacgaccttctcctggtgaacgccctntggattcctccttcaaagaactatggcatgcacgtcggtccgccaggcctcgaggcgaaggggctgggagtgggtgcgagtgattatctagttgagttaggaaagttaaagtaaaacagttaacgacacgtaccgtacgtagggaacgggtccgtaacgttaccgacctactacctaccgaagtaacgacgtaaactaccgaaacgtaacctaccttacgtacgttcctacgtacgacctaacagtaacgaaccgttacggtccgtacgggtaacccgtacgggaacggaaccgtaccgggaccgtttagggttacccttaacgttttaccggtaggttacggtaaccgggtaacggtaacggtaacgttaaacggttaaagtttacgtttaggttacggtaccgttaaaggg

SEQ ID NO: 162112 - DNA, 705 bp, Homo sapiens
  misc_feature: GYAE6OF02HLUOI.35.25.C03.1.454.CMB.1.raw
tcagtacagatcgtcacgaccggtgctcgatttagtagtgtagatttgggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagccgtgggacggtccctgagactctcctgtagacgcctcgtggtactttcctccttacaaacgaacttacgtcggctagtgcctaccgtcgggtacccgccgacggtcctccgaggtccgaaggggcctggggacggttggggtggctaggtacgtattacgtcgtagtttaggagtaggaagttaaataaactagttacgacgtaacgtaccgtaccggtaggaacgggtaccgtaacgtttccgaaccgtaacgtccctaacgaagtaacgtaaccgtaacgtttaacccaaacggtaacctaaccgtttccgttacgttccttacgtcgacctacgtaacgtacgtaacacggttcgacgggttaccgaggtacggacgacggtctacgttacttacgttacgtcggttacggacggtaacgaacggttacgtaaaccggttaaactttaggttacggtacgttacgttaaacgg

SEQ ID NO: 162113 - DNA, 824 bp, Homo sapiens
  misc_feature: GYAE6OF02F9NLJ.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagcttgggttttcctcgttgtcttctttttaagaggtgtccagtgtcgaggtgcagctggtgcagtcgtggggcgcgtcggtccagccgtgggacgtccctgacgtctctcctgtgaacgcctgtgtacttccttacctttacaaacgtaacttagtcggacagttacgcaccggttcgggtaccccgaccgtacggccgtacccggtaaggaccggtaacgggggtaccgtggggtaacgggttcggggtacgggaccgtaggtacggaacttaagttaccgtaagttttagggtaaaggttaacggttaaaaacgtaaaacttaaaacgtaacgtttaaaccggccgtaaacgttacccgggttaacccggtaagggaaaccggggtaccttaacgttaaccgtaaacccgtaacgttacccgtaccgtaaacggtaacgtaaaccgttaaacttaacccgaaaagtaacccttaaaccgttaccgtttacgtaccgttcgtaccgtaccaaccgtaacgtaacgtaaaccgtacggtccgttaacgggtaccgtagggaaaccggtccgtaaccgggtaccgttcgttaactacgtttaccgtaaggtccggtaaacggacggaacgttaacgttaaacggttaaaagtttcgtttacggttacgtacggttaacg

SEQ ID NO: 162114 - DNA, 753 bp, Homo sapiens
  misc_feature: GYAE6OF02IZRSA.35.25.C03.1.454.CMB.1.raw
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcaggtcgtgggggcggcgtggtccagccgtggggacggtccctggacgactctcctgtgaacgcctcgtggtattcctccttacaagtaaccttgtcggacagttcggccgaaccgttcggggtaccccgccgtaagggtccctacccggaggggtacggaaacggggggttccgtacgggggagggttccgggggttagggaccgtagggttacggaattacgttccttaagttttcggaagttaggaaaactttaagtaaaacctgttaaccggactaacggtacccgttacggtacgggaaacgggtcccgtaacgttacccgaaccgtaccttaccgtaccggaaacgtaacggtaacctaaaccgtttaacccgaaacggaacccttacgttaccgttcgttacccgttcgtaccgaccacgtaacgttacgaacgtacgttcggtacggtaccgtacggacggaccgacgtcgttacgttactaacgtttcggtacgtcggtagagaacggtactaacgtaaacttgttagtacgtacgtaacgg

SEQ ID NO: 162115 - DNA, 603 bp, Homo sapiens
  misc_feature: GYAE6OF02GLCJB.35.25.C03.1.454.CMB.1.raw
  modified_base (179)..(179): a, c, t, g, unknown or other
  misc_feature (179)..(179): n is a, c, g, or t
  modified_base (197)..(197): a, c, t, g, unknown or other
  misc_feature (197)..(197): n is a, c, g, or t
  modified_base (271)..(271): a, c, t, g, unknown or other
  misc_feature (271)..(271): n is a, c, g, or t
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (424)..(424): a, c, t, g, unknown or other
  misc_feature (424)..(424): n is a, c, g, or t
  modified_base (463)..(463): a, c, t, g, unknown or other
  misc_feature (463)..(463): n is a, c, g, or t
  modified_base (468)..(468): a, c, t, g, unknown or other
  misc_feature (468)..(468): n is a, c, g, or t
tcagtacagatcgtcacgaccggtgctcgatttagtagtgtagatttgggtttgggggggggagaggagcccagcactagaagtcggcggtgtttccattcggtgatcagcactgaacacagaggactcaccatgggagtttgggctgagcttgggttttcctcgttgctcttttaagnggtgtccagtgtcaggtncagctggtgcagtcgtggggggcgcgtggtccagccgtggggacgtccctgatactctcctggtagaagtcctntggattcctccttacaagaactanggcatgcaggtcgggaccncgaggcctccgaggcgaaggggctggnggtggggtgngaggtnatgtntagttgatagggtaaattaataaactagttaacggctagacccgtacggtagaacggccgtntacactagtcacgagacactaataccaagtacactcgtntactntacacactaatagtaactcggtacgtccgggtaccgtaaggcggaaccgtacggcgttacgtacttaattcgttaggtacggtacggaagtaagtaacgttaaggtaaatttacgtcggttactacgttaacggg

SEQ ID NO: 162116 - DNA, 691 bp, Homo sapiens
  misc_feature: GYAE6OF02FTMB2.35.25.C03.1.454.CMB.1.raw
  modified_base (176)..(176): a, c, t, g, unknown or other
  misc_feature (176)..(176): n is a, c, g, or t
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (284)..(284): a, c, t, g, unknown or other
  misc_feature (284)..(284): n is a, c, g, or t
  modified_base (307)..(307): a, c, t, g, unknown or other
  misc_feature (307)..(307): n is a, c, g, or t
tcagtacagatcgtcacgaccggtgctcgatttagtagtgtagatttgggtttggggggggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtgcagtcgtgggggcgcgtggtccagccgtgggacgtccctgacgactctctgngagtcctntggattctccttcaagactanggactatgacacgtcgggtcccncgaggtcctccgaggccgaaggggtcctggggtaggtgggtcggctaggtcgattacgtctagtttggaattagggaaaatttaaataaaaccgtattaaccgacgtaacggtaaccgttacccggtagggaaaccgggtccgttaacttaccgaacccttacgtacccgtacccgaggaaaccgtactaaacgttaccgaaaccgaaccttacctcgttacgtacctaccgtcgaccacgtaagacgtaaacgtcgtaccggtaccggaaccgttggaaccggtactacccgggttattcgttaacttaccgtttacgtaccgtcggtaaccgtaggtaaccgtaactaaaccggttaaattcgttacgtcgttagttaacgg

SEQ ID NO: 162117 - DNA, 858 bp, Homo sapiens
  misc_feature: GYAE6OF02JDSQM.35.25.C03.1.454.CMB.1.raw
  modified_base (181)..(181): a, c, t, g, unknown or other
  misc_feature (181)..(181): n is a, c, g, or t
tcagtacagatcgtcacgaccggtgctcgatttagtagtgtagatttgggtttgggggggggagaggagcccagcactagaagtcggcggtgtttccattcggtgatcagcactgaacacagaggactcaccatggtagtttgggctgagcgttgggttttcctcgttgcttctttaaggnggtgtccagtgtcaggtgcagtcgtggtgctaggtcggtggggggcggcggtcggccagccggtaggggacggtccctaggacgtaccttccgtccgtggtacgaacggtccctcgtaggtactttccgttccttacaaaggtaaccttagtcggactagtcggaccgtacggttccggggcccgaccgtacgggtccctacccgggaagggtaccgggtaacgggggtccggttagggggaacggggttcgggggtacgggaccgtaagggtttaggtaagttaaccgttacgttaagggttttaacggaaaggttaaaggggtaaaaacgtttaaaacgttaaaaccgttacggtttaacccggaacggtaaaccggttacccgtaccggggtaaacgggtaacgggggtaccccttaacttaccccggtaaccttaacgtccccggttaacccgaaaggaaccgttaaacctaaccgttaacccgaaagtaaccttaccgttcgttcgtacgttccgtacgacaactaacggtacgtaaccgtggttaccggacggtacgttacggacggaccgtccgggtacttacggttacttaacggtttcggtacggtacgtaacgggtaagtaacgtaacgtaacgttaatttccggtagttaccggtacttaaccggg

SEQ ID NO: 162118 - DNA, 746 bp, Homo sapiens
  misc_feature: GYAE6OF02JX5RV.35.25.C03.1.454.CMB.1.raw
  modified_base (174)..(174): a, c, t, g, unknown or other
  misc_feature (174)..(174): n is a, c, g, or t
  modified_base (196)..(196): a, c, t, g, unknown or other
  misc_feature (196)..(196): n is a, c, g, or t
tcagtacagatcgtcacgaccggtgctcgatttagtagtgtagatttgggtttgggggggagaggagcccagcactagaagtcggcggtgtttccattcggtgatcagcactgaacacagaggactcaccatggagtttgggctgagctgggttttcctcgttgctctttaagnggtgtccagtgtcaggtgcagntggtgctagtcgtggggcgcgtcggtccagccgtgggacgtccctgagacctctccgtgtagacgtcctgtacggtacttccgtaccttacgaagtaacctagtcggactagtcgaccgtacgttccgggtcccgccgtaaggtcctacccgagggtacccgtaacgggggctaggggtagggttcgggacgggtaccgtaggtaccggtaattacggtaccttaaggttttcggaagttacgggtaaaacgtttaaactaaaacgtcggttacgacgtaacgtaccgttacgagggaaccggtcccgtaattaccgtaccgtactaccgtaccgaagtaacgtaacgtaacctaaccgaacgtaacctaccgttcgttacgtaccgtactacgaactaacgtagtaaccgtacggtaacgttacggtaccggtaacgtaccggaagtaccggtaccgtacgttacggttcttaaccggttacgtaggttaccacggtaacgttaagaacgtttaagtaaacggtttcgttaggtacgggttactaacgg

SEQ ID NO: 162119 - DNA, 765 bp, Homo sapiens
  misc_feature: GYAE6OF02IBOVI.35.25.C03.1.454.CMB.1.raw
tcagtacagatcgtcacgaccggtgctcgatttagtagtgtagatttggggttgggggggagaggagcccagcactagaagtcggcggtgtttccattcggtgatcagcactgaacacagaggactcaccatggagtttgggctgagcgttgggttttcctcgttgcttcttttaagaggtgtccagttgcgaggtgcagtcgtggtgcaggtcggtgggggccgcggtggtccaggccgtggggaccgtccgtgagtaccttctccgtggaagacgtcctcgttcggtaactttccgttacccttaacgaaacgtaaacttggtacggtctagtcgaccgtaacggtcgggtaccccgacgtacggtcccgtaaccggaggggtaccggtaaagggggtccgtagggggtacgggttacggggggtagtacggtagtggtaactaggttaccgtagttttaggaaggtaaggttaaaactaaaagtaaacgtacgttacgacaacggtaccgtaccggtaaggggaaccggtcctaattaccaaccgtactccgtacgtaacgaacgtaaactaacttaccaaagtaacccttactacgtacgtcctacgtacaacctactaacgtaacgacgttaaccggtcgtaacggtaaccgtacgggacgtaccggagttcgtacggttaactttacgttcggtaacgtggtaacggtaagtaagtaacgttaaagtaaacgttttgtacggttacggtatttaaccgg

SEQ ID NO: 162120 - DNA, 141 bp, Homo sapiens
  misc_feature: GYAE6OF02JJMXJ.35.25.C03.1.454.CMB.1.raw
  modified_base (129)..(141): a, c, t, g, unknown or other
  misc_feature (129)..(141): n is a, c, g, or t
tcagtacagatcgtcacgaccggtgctcgatttagtagtgtagatttgggtttgggcacagcggccctgggctgcctggtcaaggactacttccacgatctgtactgagcgggctggcaaggcgcatgnnnnnnnnnnnnn

SEQ ID NO: 162121 - DNA, 720 bp, Homo sapiens
  misc_feature: GYAE6OF02IX8RI.35.25.C03.1.454.CMB.1.raw
  modified_base (179)..(179): a, c, t, g, unknown or other
  misc_feature (179)..(179): n is a, c, g, or t
  modified_base (287)..(287): a, c, t, g, unknown or other
  misc_feature (287)..(287): n is a, c, g, or t
tcagtacagatcgtcacgaccggtgctcgatttagtagtgtagatttgggtttggggggggagaggagccccagcactagaagtcggcggtgtttccattcggtgatcagcactgaacacagaggactcaccatggagtttgggctgagcttgggttttcctcgttgcttcttttaagnggtgtccagttgtcgaggtgcagtcgtggtgcgagtcggtgggggcggcggtggtccaggccgtggggacgtccctgacgcctcctcgtgtcgacgccttagtcggtnttccgtccttaacgaagtaacttagtcggcagttcggccgtaccggttcggggcccgtccgacggtccgtaccggaggtacgaacgggggtctagggtagggtcgggtagcgaggttaggtaacttagtcgttaagttggtaagtaggtaaaatttaaactaaacgtacttaaacggctaaaccggttacccgttacgggtaacgggtaacgggtcccgtacgtttaccgaacccttaacctaccgtaccgaacgaaccgtaaaccgtaaaccgttaaccgaaaccgtaactaccgttacttcgtccttgtacgacctatacgtacgaacgtcgtacggtacgtaccgtacgacgacgacgttcgtacgttacgttacgtacgtgtacggacgtaagaacgtagtaacgtattaccgttagtacgtagtaagg

SEQ ID NO: 162122 - DNA, 824 bp, Homo sapiens
  misc_feature: GYAE6OF02IYAR4.35.25.C03.1.454.CMB.1.raw
  modified_base (240)..(240): a, c, t, g, unknown or other
  misc_feature (240)..(240): n is a, c, g, or t
  modified_base (314)..(314): a, c, t, g, unknown or other
  misc_feature (314)..(314): n is a, c, g, or t
  modified_base (527)..(527): a, c, t, g, unknown or other
  misc_feature (527)..(527): n is a, c, g, or t
  modified_base (669)..(669): a, c, t, g, unknown or other
  misc_feature (669)..(669): n is a, c, g, or t
tcagtacagatcgtcacgaccggtgctcgatttagtagtgtagatttgggtttgggggggagaggagcccagcactagaagtcggcggtgtttccattcggtgatcagcactgaacacagagactcaccatggagtttggctagagtcgttcgggtttttcctcggttgaccttcgtttttaaaggagggttctccctaggttcgtcgaggtgaccaggtcgtggtcgactaggttcggngggggggtccggccggttggtaccccaagggtcccggttggggaccgttccctaggacgtacctcgtccgtagnggtaactccttcgttaggtctttctaccgttacgaaacgtacgttaagttcggactagttccgcgtaccggttacgggtcccgcggtaaccgccgtacccggaagggcgtaaacggggccgtttagggggacgggttacggggtacgacggtaaggtacgaacggttataccggtaagttaggtagtaaaggtaaaactaaacgtaaacgtanaacgtacgtaacgtaacgcggtaaggaacgtccgtaactaccactacgttacgaccgtagaaaccgtacgtaacttaaccgaaacgaaccttaccggtactaggttacctacgtacgacccaacgtaacgtacgaaacggtnttaccgggtaacgtaccgtaaacggcggttaacccgacgtaccgttacgtaaccgttttaccggtaattacccgggacggtaacgtaacggtaaagttaaccggtaaaacggtttaaaccttagggttttacccggtaacgttaccggttaacgg

SEQ ID NO: 162123 - DNA, 215 bp, Homo sapiens
  misc_feature: GYAE6OF02FOFRQ.35.25.C03.1.454.CMB.1.raw
  modified_base (176)..(176): a, c, t, g, unknown or other
  misc_feature (176)..(176): n is a, c, g, or t
  modified_base (178)..(215): a, c, t, g, unknown or other
  misc_feature (178)..(215): n is a, c, g, or t
tcagtacagatcgtcacgaccggtgctcgatttagtagtgtagatttgggtttgggggggaagaggaagactgacggtccccccaggagttcaggtgctgggcacagcggccctgggctgcctggtcaaggactacttccacgatctgtactgagcgggctggcaaggcgcatagncnnnnnnnnnnnnnnnnnnnnnnnnnnnnnnnnnnnnnn

SEQ ID NO: 162124 - DNA, 788 bp, Homo sapiens
  misc_feature: GYAE6OF02J2TCD.35.25.C03.1.454.CMB.1.raw
  modified_base (62)..(62): a, c, t, g, unknown or other
  misc_feature (62)..(62): n is a, c, g, or t
  modified_base (184)..(184): a, c, t, g, unknown or other
  misc_feature (184)..(184): n is a, c, g, or t
  modified_base (207)..(207): a, c, t, g, unknown or other
  misc_feature (207)..(207): n is a, c, g, or t
  modified_base (378)..(378): a, c, t, g, unknown or other
  misc_feature (378)..(378): n is a, c, g, or t
  modified_base (722)..(722): a, c, t, g, unknown or other
  misc_feature (722)..(722): n is a, c, g, or t
tcagtacagatcgtcacgaccggtgctcgatttagtagtgtagatttgggtttggggggganaggagcccagcactagaagtcggcggtgtttccattcggtgatcagcactgaacacagaggactcaccatggtagtttgggctggagtcttgggttttcctcggttgcttacgttttaaggnggtgtccaggtgtcgaggtcacnggtcgtggcgcgtaggtccgggtgggggccgtcggttacggtaccgcgggtccggtaacggggccgttcccgagtaccgtccttccggttacgtggaacggtccgccttggtagtacctttccaccgttagaaacgtacgtgtcggactgtcgacgtccggtacggtcccncgtacgccgtacgaggtcgggtacggtcggaggtgggtggaccgtgtaggtacgtaagtttccgtaagttacgttaggaaggtttaacggaaaacttaactaaacgtcggtacgtacgaccgttaaccggtcgtaaagggccgtactaccgtacgcctagtacccgaaacgtagtaaccgtaactaacccgttaaacgaaccgtaaccgttcgttaacccgttcgttaaccttcggaaccgtacaaaccgttagtaacccgtagtaccggttaaccgggtatacccggggaaaccggaccgtttaacggccgttaacgttccgtttaccgttaggttacccggnggttaaccgaaggtaaccggtaagtaagttaaccttacggttagtttcggtaacttaggttacggg

SEQ ID NO: 162125 - DNA, 690 bp, Homo sapiens
  misc_feature: GYAE6OF02JYYCU.35.25.C03.1.454.CMB.1.raw
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (288)..(288): a, c, t, g, unknown or other
  misc_feature (288)..(288): n is a, c, g, or t
tcagtacagatcgtcacgaccggtgctcgatttagtagtgtagatttgggtttggggggagaggagcccagcactagaagtcggcggtgtttccattcggtgatcagcactgaacacagagactcaccatggagtttggctgagctgggttttcctcgttgcttcttttaagaggtgtccagtcgtcaggtgcagctggtcgcagtcgtggggcgcgtggtccagcgtgggacgtccngagactctcgtgnganccgtntggacttcctcttacgaacgtaacttagnggacagtacgcaccgtagggtcccaccgcggactccgaggcgaagggtcaggtaggtgggagcgagtcggtaatctacgtagttagaagtcgggtaaataaataaacgagttacgaccgtaaggacctacgggtacgtaacggtcccagttacccaactacgttcccgtaccaagtactaaaccgtaacttaacccgaaacgtaaacccgttacttccggttagtccccttaacgtaccacgtaaaccgtagttacgtaaacccggtagttaaccccgggttgggtaaccgtagggaaaccgtccgggtaacgtcgtacgttaccgttacgttaacccggtgttaaggaaccgtaggtaacgtaaccttaaagaaccgttagtttggacgtaacgtttacgg

SEQ ID NO: 162126 - DNA, 817 bp, Homo sapiens
  misc_feature: GYAE6OF02HGGGG.35.25.C03.1.454.CMB.1.raw
  modified_base (175)..(175): a, c, t, g, unknown or other
  misc_feature (175)..(175): n is a, c, g, or t
  modified_base (334)..(334): a, c, t, g, unknown or other
  misc_feature (334)..(334): n is a, c, g, or t
tcagtacagatcgtcacgaccggtgctcgatttagtagtgtagatttgggtttggggggggagaggagcccagcgctagaagtcggcggtgtttccattcggtgatcagcactgaacacagaggactcaccatggagttgggctgagctgggttttcctcgttgcttctttaagnggtgtccagtgtcaggtgcagtctggtgcgagtcgtgggggcggcgtggtccagccgtgggaggtccctgacgtacctccgtcctggtagacgtcctactggtactttccgtccttacaaacggtaacttagtcggcatcgacgtacgtcggggtcccncgacgggtcctaccgagggccggaagggggcttagggtagggtgggggtacgcgtaggtagtacgttataccgttagttacggaagtaagggtaaaattaaaacttaaacgtaacgtttaccgacgttaaacggtaacccggttaccgggttaagggaaacggggtccccttaacgtttaccccggaaacctttacgttaacccctacccggtaaaggtaaaccgtaaaccttaaccggtaaacccgtaaaaccggaaccttaacccgttacgttaccgtcctacgtacgactaacgttacgttacgaaaccgtcggggttaacgttacccggggaccttaggggaaaccggtaccgggtcccgtttacggtacgtttaaccggtttacgtttaccggtacggttaccggtaacggtaacgggttaaagtaacggtttaaacgtaaaggtttagtttacgggttaacgtaccgtttaaagggg

SEQ ID NO: 162127 - DNA, 758 bp, Homo sapiens
  misc_feature: GYAE6OF02G3WVD.35.25.C03.1.454.CMB.1.raw
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
tcagtacagatcgtcacgaccggtgctcgatttagtagtgtagatttgggtttggggggggagaggagcccagcactagaagtcggcggtgtttccattcggtgatcagcactgaacacagaggactcaccatggagtttgggctgagcgttcgggttttcctcgttgcttcttttaagaggtcgtccagtgtcaggtgcagctggtgcgagtcgtggggcgcgtggtcagcgtgggacgtccgtgagctctcctgagacgcctcgtggtacttctccttntagtacgttanacggctagtgacgtacgtcgggtcccgacgtacggccgtccgagggtaccgaagggggttccgtggggtagggttcggggtagggtaccgttaaggtttacggtagttagggttagtgggaacgttaggggtaaactacgtaaaagttaaacggtagttacgtacggtacgtaaacgggtacccgttccgggttaacggggaaccggggtacccgtacttacccggaaacctacgtacccgttaaccgaagtaaaccggtaactaaaccgtaccgaaaaccggtacctaccggtacgttacgttacgtacggtaacgaaactaaacggtaccgaacgtacggtactaagggaaccgtacggacccgtaacggaccgtacgggtacttacggttagttaacgttacgtggttaaccgacggtaacggtaacgtccgggtaaagtggtaacggtacgtaacttaacgg

SEQ ID NO: 162128 - DNA, 763 bp, Homo sapiens
  misc_feature: GYAE6OF02G8UAP.35.25.C03.1.454.CMB.1.raw
  modified_base (179)..(179): a, c, t, g, unknown or other
  misc_feature (179)..(179): n is a, c, g, or t
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (210)..(210): a, c, t, g, unknown or other
  misc_feature (210)..(210): n is a, c, g, or t
  modified_base (746)..(746): a, c, t, g, unknown or other
  misc_feature (746)..(746): n is a, c, g, or t
tcagtacagatcgtcacgaccggtgctcgatttagtagtgtagatttgggtttggggggggagagggagcccagcactagaagtcggcggtgtttccattcggtgatcagcactgaacacagaggactcaccatggagtttgggctgagctgggttttcctcggttgcttcttttaagnggttgtccagtgtcagggtncagctggtncngtcgtgggggcgcgtggtccaggtccgtggggacgttccctggacgtcctctcctggtcgaacgccttcggtggactttcctccttacgaaacgaacttagcggacagtcggcctaacgtcgggtacccgccgtaggtctaccgacgggcgaacggggggctacgggtagggtcgggggttcgccggtagttcggattacggttacctaaggttttcggaagttacgggtaaaagtttaaaacgtaaaaacctggtttaaacccgtacccgaacggttaccccggttacccggggttaggggaaacccgggggtccgtaacgtttacccaaccgtactttccgtacccgaaaggtaaacgtaaaccgtaaccttaacccgaaaacgtaaacccttacggtcccttacggttcctcgtaacgtaccgactacgaacgttactacggtccgggttacggtaccgtaggaccggttacggacgttcgtcgttacctttacgtcgttggcggtacggtaataccgtaagtactaaggttntccggttgacgttacgg

SEQ ID NO: 162129 - DNA, 820 bp, Homo sapiens
  misc_feature: GYAE6OF02HN7U1.35.25.C03.1.454.CMB.1.raw
tcagtacagatcgtcacgaccggtgctcgatttagtagtgtagatttgggtttggggggggagaggagcccagcactagaagtcggcggtgtttccattcggtgatcagcactgaacacagaggactcaccatggagtttgggctgagcttgggttttcctcgttgtcttcttttaagaggtgtccagtgtcaggtgcagctggtcgctaggtcgtggggggcggcggtggtccaggtccgtggggacggtcccgtgacgactccgtcctggtgacgtcctcgtggtactttcctaccttacaaacgtaacttagtcggacagtcgactaccggttcgggccccgtaccgacggtcctacccggtaacgggacggaaccgggggcggtacggggtaacgggttcggggggtacggtaccggtaaggttacggtaacgttagttaccggtttagttttaggaacgggttaaaggggttaaaacgtttaaaaaccgttaaaacgttaacgtttacgaacgttacggtaaccggttccgggtaaggggaaccgggtccgttaacttaccaacccttaccgttacccgtacggaaacggtaacggtaaaccttaacccgttaaaccaaaccggtaacctaacccgtttacgtcgttaccttcgaccgtaccaacctaaggtaaccgacgtacgttaccggtccgggtaaccgtaaggacccggtaacgtacggtacccgttaggttaaccttacgttacgtggtacgaacggtaaccggtaagtacctaaacgggttatttaggtacggttactagggttaacg

SEQ ID NO: 162130 - DNA, 683 bp, Homo sapiens
  misc_feature: GYAE6OF02F1QOC.35.25.C03.1.454.CMB.1.raw
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (510)..(510): a, c, t, g, unknown or other
  misc_feature (510)..(510): n is a, c, g, or t
  modified_base (551)..(551): a, c, t, g, unknown or other
  misc_feature (551)..(551): n is a, c, g, or t
tcagtacagatcgtcacgaccggtgctcgatttagtagtgtagatttgggtttgggggggagaggagcccagcactagaagtcggcggtgtttccatcggtgatcagcactgaacacagagactcaccatggtaggtttggactgagcgttggttttcctacggttgtccttacttttaaggacggtgtccagttgtcgtaggtgcgtacgtcgttggtgccgtagtcggttcgggggcggtcgttggtcccacggtccgttggggacggtcccgtaggactaccttctccggttagcggaaccgccttacgttagcgtttaccctccgttacaaagtaccgttacgtgactagttcgaccgtaggtccggtacccgcgtacggccacgcggtacggaagggtcgtagtggtacggtcgngtaaganacgtacttgtagttacgagtagtaaaagttaacaaacgttacgtacactaacggccttacggaaggacggtaccgtacttacncctagtcctacgacgtagaccctaatacccgaaataacgtnacgttctcctatcgacacgtatacgtagtaccgtggtaccgacgtggacgaaccgtgtacgtcctagttacgttccgtgtacggaacgtagtaccggaatttacgtaacttacgttcgacggttactaacgg

SEQ ID NO: 162131 - DNA, 485 bp, Homo sapiens
  misc_feature: GYAE6OF01C201J.3.1.A01.1.454.CMB.1.raw
  modified_base (406)..(406): a, c, t, g, unknown or other
  misc_feature (406)..(406): n is a, c, g, or t
  modified_base (469)..(469): a, c, t, g, unknown or other
  misc_feature (469)..(469): n is a, c, g, or t
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtggacagtccaaggatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtgggtcccacaacgttcagcggcagtggatctgggacagagttcactctcaccatcagcagcctgcagcctgacgatgtggcaacttattactgccaanagtatgattagtattgggactttcggcctaagggacctaaagactagaaatcaaagactgtgntgcaccntcngtctac

SEQ ID NO: 162132 - DNA, 494 bp, Homo sapiens
  misc_feature: GYAE6OF01DNKE1.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggacaaactttattactgaccaacagtatgatagttattgggacttcgggccaaagggaccaagataagaaaatcaaaagaactgtaggcttagcaaccatctgtcttac

SEQ ID NO: 162133 - DNA, 536 bp, Homo sapiens
  misc_feature: GYAE6OF01D5LBT.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccagggtgccaaatgtggacagtccaaggatgacccagtcctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtgggtcccaccaacgttcagcggcagtgatcgtgggacagagttcactctcacatcagcagcctgcagcctgacgatgtggactaacttattactgaccaactagtatagtattagttagttggtacgttccggaccgtaacggggaaccaaaggtataaagtaaacgtacgtaaaacggaacgttggtacggtcgtacggtccaaccctagttcctgttccttacc

SEQ ID NO: 162134 - DNA, 476 bp, Homo sapiens
  misc_feature: GYAE6OF01AIISW.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggcaagggaccagatagaaatcaaagactgtggctgcacatctgtcttc

SEQ ID NO: 162135 - DNA, 511 bp, Homo sapiens
  misc_feature: GYAE6OF01EPR5M.3.1.A01.1.454.CMB.1.raw
  modified_base (379)..(379): a, c, t, g, unknown or other
  misc_feature (379)..(379): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtgggtcccaccaacgttcagcggcagtgatctgggacagagttcactctcaccatcagcagcctgcagcctgacgntgtggcaacttatactgaccaacagtatgattagttattggacgttcggaccgaagggaccaaagataaggaaacttaccgaaaagtaacctggtacggacttacgaccaacctaatccttggtcctttacg

SEQ ID NO: 162136 - DNA, 549 bp, Homo sapiens
  misc_feature: GYAE6OF01ESU0M.3.1.A01.1.454.CMB.1.raw
  modified_base (439)..(439): a, c, t, g, unknown or other
  misc_feature (439)..(439): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccgaggcagacgacccaaagctaccttatctctgatcgccctacctaatttcgactacgagggttccggggtaccccaaccgtaacgttcaggcgcgaggtggactcgtgggacaggtagttccacttctaccacactacgagccagcctgaccacgcctagacgatggtgactaactttataccngacccaatacgtatagaatttagttagttaggtacgttcggacgaaacgggacaagaataagaaacgtacaaagtactggacggctacggactacgtatcgtgttcttac

SEQ ID NO: 162137 - DNA, 747 bp, Homo sapiens
  misc_feature: GYAE6OF01AXOR7.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagacgccccaaagctccttatctctgatcgcctcctaatttcgcacgacggttcggggtaccccaaccgtaacgttcaacggccggaccgaggtgggacgtcgtaggggaacaaggtacgtttaccacgttctaccaaccctataccgagcctaacggccctggaccaacggtcccgtaggaaccggtagttcgggttacgggtaacctaaaccttttaactttaaccgtacggtaacccctaaacgtaaggttaacgttaacggtaagttttaacgggttttaacggtttaacggggttaacccgggttttacccggggtaacccggtaaaacgggggtaaccccgtaaaaagggtaaacgttaaaacggaaaaaccgtttaacccggaaaaaaccggttaaaccggtttagggttaccgggtaaccgttaccggtaacccgaaccccttaaacgtttacccgtttcgtttaacccgttttaacccg

SEQ ID NO: 162138 - DNA, 493 bp, Homo sapiens
  misc_feature: GYAE6OF01A07L8.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtgggtcccacaacgttcagcggcagtggatctgggacagagttcactctcacatcagcagcctgcagcctgacgatgtggccaaacgtttattactcgccctaaacagttatagattagttattggtacgtttcggaccaagggaccaagtataagaaatcaaagactgtagctgacacatctgtcttac

SEQ ID NO: 162139 - DNA, 614 bp, Homo sapiens
  misc_feature: GYAE6OF01AJJAN.3.1.A01.1.454.CMB.1.raw
  modified_base (342)..(342): a, c, t, g, unknown or other
  misc_feature (342)..(342): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgctatctttaggagacagagtcaccatcacctgccgggccagtcaaagtattagtaactcgttggcctggtatcagcaaagaccaggcagagccccaaagctccttatctctgatgcctccaatttgcacaggtcggggtccccacgaacgttcagcggcagtggatcgngggacagtagttcacttctcaccatcagcagcctgccagccctgaccgagttcggtacgggtactaactttacttacctcggtaccctaaacgtagttaatacggtaagtttaacggtttaagtttcggggtaaccggttttaccggggaacccgtaaagggggaaccctaaagggtaacgttaaaacggtaaaacgttaccgtaaaaccggtaacgttcggtacgggtacctacggaaccctaccgtaattccgttacggttcctttaccc

SEQ ID NO: 162140 - DNA, 585 bp, Homo sapiens
  misc_feature: GYAE6OF01CCXA5.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtacaaagtattagtaactcgttggcctggtatcagcaaagaccaggcagacgcccaaagctccttatctctgatcgcctccaatttgcacagtcggggtacccaccgaacgttcgacgcggcaggtggatcgtgggacagtacgttcactctcaccatcagcagcctgcacgcctgaaccgagttgtggactaactttattactcgactaacgtagttaactagtaagttaggtttagttacgggtacgtttaccgggaccgtaaaacggggacctaaaggtaacttaaacggaaaacgttaaccgaaaacggtaaccgttagggtacggtacgttacggaccaacccgtattaccgttcgttcctttaccg

SEQ ID NO: 162141 - DNA, 575 bp, Homo sapiens
  misc_feature: GYAE6OF01CQ469.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagaaagagtcaccatcacctgccgggccagtcaaagtattagtaactcgttggcctggtatcagacaaagaccaggcagacgaccccaaagcctccttatcctctgatcgcctactaatttgcacgaggtcgggtcccaccgaacgttcagcggcagtggatcgtgggacagtagttcactctacacatcagcagcctagcacgctgaacgacgtgtcggactaacgtttatacgtacgacctaaacgaggttaatcgtaatttaggtttaacgttcgggtaacgtttccgggaaccgtaaacgggaaccaaaggtaagtaaagaaactaacgaaaacgtaagttggtacggacctggacctaaccgacttcgttacgttccttgtaacccg

SEQ ID NO: 162142 - DNA, 529 bp, Homo sapiens
  misc_feature: GYAE6OF01CMX9G.3.1.A01.1.454.CMB.1.raw
  modified_base (379)..(379): a, c, t, g, unknown or other
  misc_feature (379)..(379): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtcgggtcccacaacgttcagcggcagtggatctgggacagtagtcactctcacatcagcagcctgcagcctgacgntgtggacaactttatactcgaccaactagtaatgtaattaagtttagttacgggtacgttcggaccgaaacgggtaaccaaaggaactaaggaaaataccgaaaacgtaacgtgtacggacttacgaccaacctattcttgttcttaccg

SEQ ID NO: 162143 - DNA, 477 bp, Homo sapiens
  misc_feature: GYAE6OF01A7PID.3.1.A01.1.454.CMB.1.raw
  modified_base (460)..(460): a, c, t, g, unknown or other
  misc_feature (460)..(460): n is a, c, g, or t
  modified_base (462)..(462): a, c, t, g, unknown or other
  misc_feature (462)..(462): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtgggtcccacaacgttcagcggcagtggatctgggacagagttcactctcaccatcagcagcctgcagcctgacgatgtggcaacttatactgccaacagtatgattagttattggacgttcggcaagggaccaagataagaaatcaaacgaactgngntgcacatctgtctac

SEQ ID NO: 162144 - DNA, 492 bp, Homo sapiens
  misc_feature: GYAE6OF01BHJDZ.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgaccagtgtggctaactttattactcgcccaactagtatgattagttattggacgttcggacaagggaccaagataagaaagtacaaagaactggtagctgcactatctgtcttac

SEQ ID NO: 162145 - DNA, 650 bp, Homo sapiens
  misc_feature: GYAE6OF01CCFAF.3.1.A01.1.454.CMB.1.raw
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (230)..(230): a, c, t, g, unknown or other
  misc_feature (230)..(230): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccaggagcctgacgcgggctggcaaggcgtcgatagngancncatnactncggcatanaagtatatactcgtgctgtatnagacaagacgagacagacgaccaacgactacttactactctgtagtcgtacctactaacttacgtacacgacggtacgggtaccgaaccgtaacgtacgacgacggacgagtaggtagtacgtacggacgaacgtacgtactactactaccaacctactacgacgacgacgtaccgtacgacgacgtacgtacggaacgtaacgttaggtacgtaacgtaaacttaacgttaacgtacgtaaccgtaaacgtaacgtaagtaagttaagttaaggtttaacggttacggttaaccggttaaccggtaccggtaaacgggtaaaccgtaaacgtaaagtaaacgtaaacgtaaacgtaaaacgtaaacgttaacggtacggtacgtacgtaaccgtaacctaactacgttacgttactacg

SEQ ID NO: 162146 - DNA, 694 bp, Homo sapiens
  misc_feature: GYAE6OF01CJCTO.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttgcctgtatcagcaaagaccaggcagacgccccaaagctcctatctctgatcgcctcctaatttcgctaacgacggtcggggtaccccaaccgtaacgttcaacggccggacctaagggttggaacttcgtggggaacaggtacgttccaccttcctacctacccattacgaacggcctaacggtccccttaggccctaacggccccgtaggaaccggaagttcgggtacggaccttaaaccgtttattaacccgttcgaaccctaaaccgtagtaagttagtaagtttaacggtttagtttaacgggtaccggtttaccggggaccgtaaaacggggtaccctaaaaggtaacgttaaaacggaaaacgttaaccggtaaaaacccggtaacgtttacgggtagggtacctttaccgggaacctaaccccgtatttacccgttcgtttcgttttaacccc

SEQ ID NO: 162147 - DNA, 549 bp, Homo sapiens
  misc_feature: GYAE6OF01ESN8A.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaattttcgcacgaggtcggggtaccccaacctaacgttcacgcggcgagtggatcgtgggacagtagttcactctcaccatcagcacgcctgcagcctgacgatggtcggactaactttattaccgtcgacccaagtagtactagtaattaggtttagttgggtacgttccgggaccgaaaggggtaccaaaggtataaaggaaataccgaaaacgtacgtggtacggactcgacctacctattccttgtcttaccg

SEQ ID NO: 162148 - DNA, 671 bp, Homo sapiens
  misc_feature: GYAE6OF01C7KTS.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgctatcgtttaggagacagagtcaccatcacctgccggcagtacaagtattagtactcgttgcctggtatcagcaaagaccaggcagacgaccccaaagctccttatctctgactcgcctacctaatttcgactacgacggtacggggtaccccaaccgtaaccgttcgacggccggacgtaggtgggacttcgtacgggaactaggtacggttcaccgttctacctaacctataccagtccacgcccgttagacgtacgtccctaggacgtagtcggtacggtaccttaaacttacgttaaccgtacgtaaccctaaacgtagtaagttagtaaacgtttaggttaacgttacgggtaccggtttaccgggaaccggtaaacggggaaccctaaaggtaaacgtaaacgtaaaacgtaaccgaaaacggttaacgttacgggtacggtaacgttacgaacccgtaacctagtttccttacggtttaccctttaacccg

SEQ ID NO: 162149 - DNA, 768 bp, Homo sapiens
  misc_feature: GYAE6OF01APRJE.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgctacttacgttaggacacgagtacgtaccacctactaccaccgtccggcccggacgtacgtaacgtaaagttattaacgtaccgttcggtcgtccgttaggtactacgacgaacgaacgaccgaggacacgacccgtaacccgaacgtccttactactctctagtactccgtaccttactacgttcgacgacgtacgggtcccggtaaccctaaccgtacgtacgcggaccgagtacggtggtacgtacgggtacggaacgtacggttacttaccgtacttacccgtaccaacctacgtacgaccgggtaccacccggtcgtaccgaccgtaccgtaccggtaacgaacgtttcgtacgggtacccgtaaacctttaaccgtttacttaccggaacccgtaacccttaaggttagttaccgtaaaggttttagtttaaccggttttacggacccggggtttaaccgtaaccccgggaaggtaaaacccgtacggtaaagttaaaccggtaaaacgtaaaccgtaaccggtaaaaggtccggtttggacggtcctaccggtaaccctacgttagttccgttaccgttaccgtaccc

SEQ ID NO: 162150 - DNA, 617 bp, Homo sapiens
  misc_feature: GYAE6OF01BAQAO.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagacaaagaccaggcagacgaccccaaagctaccttatctctgatcgccctactaatttgactacgtacggtcggggtaccccaaccgtaaacggttcacggtcggacaagtcggaatcgtagggacagacgttcactctcaccatcagtcagcctgacacgcctaggacgtagtgtcggactaaacgtttactacgtcgaacctaacgtagtaacttaggtaattacggttaagtttacgggtaccgtttacccgggaaccgaaaggggtaaccctaaaagacgttaaaacggaaaacgtaccgtaaaaacggtaacgttggtacggacctacggtaccaaccgttacgtttacttcggttcctttaaccc

SEQ ID NO: 162151 - DNA, 507 bp, Homo sapiens
  misc_feature: GYAE6OF01AVHAW.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagacgaccccaaagcctaccttatctctgatcgcctccaatttgcacaggtcgggtcccacaacgttcagcggcaggtgatcgtggacagagttcactctcaccatcagcagcctgcagcctgacgatgtgactaattatactcaccaacgagtatagtattagttatcggtacgttccggacaagggaccaagacgtaagaaacgtcaaacggactgtacggactacgccactactcttgtcttacg

SEQ ID NO: 162152 - DNA, 523 bp, Homo sapiens
  misc_feature: GYAE6OF01EVTNL.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccggccagtcaaagtatagtaactcgttgcctggtatcagcaaagaccaggcagacgccccaaagctccttatctctgatcgcctccaatttcgcacaggtcgggtcccaccgtaacgttcagcggcagtggatcgtgggacagagttcactctcacatcagcagcctgcagcctgacgatgtaggactaactttatacgtcgaccaatagtatagagttagttagttggtacgttcggacgtaagggaaccaaagataaggaaactacgaaaacgtacgtgtacggactacggacctacctattcgttgtacttaccg

SEQ ID NO: 162153 - DNA, 524 bp, Homo sapiens
  misc_feature: GYAE6OF01AJTEZ.3.1.A01.1.454.CMB.1.raw
  modified_base (340)..(340): a, c, t, g, unknown or other
  misc_feature (340)..(340): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtccccaccaacgttcagcggcaggtggatcgngggacaggagttcactctcaccatcagcagcctgcagcctgacgatcgtggctaacttattactcgccaacagttatagtattagttagttcggtacggttccggaccgaaaggaaccaaggtaataagtaaacgtacgaaaacgtaacgttggaggtcgtagaccacctattctgtctttacc

SEQ ID NO: 162154 - DNA, 611 bp, Homo sapiens
  misc_feature: GYAE6OF01A7VKD.3.1.A01.1.454.CMB.1.raw
  modified_base (414)..(414): a, c, t, g, unknown or other
  misc_feature (414)..(414): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtactcgttggcctggtatcagcaaagaccaggcagacgaccccaaagctccttatctctgatcgccttccaatttcgacacgaggtcggggtccccaacctaacgttcgacggcggcaggtgggatcgtaggggacaggtagttccactcctcgacctatccagcacgcctgcacgcctaggaaccgtntcggtggacctaactttacgttactcgacccaaacgtagttataggtaattaagggtttacgttacgggtacccgggtttcgggacccgtaaacggggaacctaaaggtacgttaaagaaaacgttaccgaaaaccggtaacttacgggttaggaccgttaacgaccgaacccttacgtccttcggttactttaccc

SEQ ID NO: 162155 - DNA, 495 bp, Homo sapiens
  misc_feature: GYAE6OF01A7CVM.3.1.A01.1.454.CMB.1.raw
  modified_base (412)..(412): a, c, t, g, unknown or other
  misc_feature (412)..(412): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagacgccccaaagctccttatctctgatcgcctccaatttgcacaggtcgggtcccaccaacgttcagcggcagtggatcgtgggacagagttcactctcacatcagcagcctgcagcctgacgagtgtggactaacttattactgacccaanagtatgattagttattggacgttcggacaaggacaagataagaaatacgaaagaactgtaggctacgacacattctgtcttac

SEQ ID NO: 162156 - DNA, 757 bp, Homo sapiens
  misc_feature: GYAE6OF01B8MDE.3.1.A01.1.454.CMB.1.raw
  modified_base (256)..(256): a, c, t, g, unknown or other
  misc_feature (256)..(256): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgaccaaatgtgacatccagatgacccagtcctcccctccaccctgtcctgctattcgtttaggagacagacgtcaccatccaccgtcggcccggccagtacaaagtattagtactcgttggcctggtancagacaaagccgagacagacgacccaagctctanctngactcgaccctatattcgacacgtcgggtccgggtaccccaacggtacgttacgacggcggtagtacggtcgggtaccgttacccggggactaacggtacgtttaccgaccttacccgtaccaaccgtacgtaccgaacggtcccgtacgtcccgttacggcccgtaaccggtcccgtaacgggtaaccgtacggtttacgggtaaccggtaacctttaaacccgtttaacgttaacccgtaccgtaaacccgtaacgtttaaggttagttaacggttaacgtttaaggttttaccgggttacggggttaaccggtttaccgggaaacccggtaacggggtaaacccaaagggttaaacgtaaacggttaaaacctaaaccggtaaacggtacgttacgggtacggtacccgttacgacccgttaacccgatttacccggtactttcccgttacttaaccccgg

SEQ ID NO: 162157 - DNA, 649 bp, Homo sapiens
  misc_feature: GYAE6OF01BP810.3.1.A01.1.454.CMB.1.raw
tcagagacgcactccacgaccggtgctcgatttagacgtctcatcgaggggagactcagtcaggacacagcatggacatgtgggtccccgctcagctcctggggctcctgctgctctggctcccaaggtgccaaatgtgacatccagatgacccagtctccctccaccctgtctgctatctttaggagacagagtcaccatcacctgccggccagtcaaagtattagtaactcgttggccttggtatcagacaaagaccaggcagacgaccccaaagtctccttatctctgatcgtcctacctaatttgctacgaggttcggggtacccaaccgtaacggttcgacggcggctaggtcggtacgtcgtgggacgaggtacgttccacgttcctaccacctataccgaggtcctacggtcctggccaacggtcctacgggacgtaagttcgggtaccggaaccttaacgttttacgtacctcggaacccaaagttgttaacgttagtaagtttagtttaagttacggggtacggtttaccggaccggtaaagggaaccgtaaaggtacgttaaacgaaacgtaccgaaaacggtacgttagggttacggaaccgttcgacctaaccgtattcccgttgttcctttacccg

SEQ ID NO: 162158 - DNA, 614 bp, Homo sapiens
  misc_feature: GYAE6OF01DS2ET.3.1.A01.1.454.CMB.1.raw
  modified_base (348)..(348): a, c, t, g, unknown or other
  misc_feature (348)..(348): n is a, c, g, or t
tcagagacgcactccacgaccggtgctcgatttagacgtctcatcaggggagactcagtcaggacacagcatggacatgtgggtccccgctcagctcctggggctcctgctgctctggctcccagggtgccaaatgtgacatccagatgacccagtcctccctccaccctgtctgcattcttaggagacagagtcacatcacctgccgggcagtacaaagtattagtaactcggttggctggtatcagacaaagacaggcagacgacccaaagcctacttatctctgactcgcctactatttgaccacgtacgggtcgggtaccccaaccgtaacgttcgaggccggngaggtggactcgtagggacagtacgttacactctacacctagcacgaccacgcctgactacgcctaggacgtagtcggtacgtaccttaacgtttacttaacgtcgaacctaacgtagttacgttaagtagtttaaggttaagttaccggggttaaccgttccgggaaccggtaaacgggtaacaaaaggtataaacggaaaacgtaacgtaaaggtacggttacggtggtaccgttacgacccacttatcgttagttccgttacc

SEQ ID NO: 162159 - DNA, 548 bp, Homo sapiens
  misc_feature: GYAE6OF01BWIF4.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtcctccctccaccctgtctgcatcttaggagacagagtcaccatcacctgccggccagtacaaagtattagtaactcgttgcctggtatcagacaaagaccaggcaagacgaccccaaaagcctccttatctctgatcgcctaccaatttcgacacgtaggtcgggtacccctaccgtaacgttcaacggtcgcaagtggatcgtggacagagttcactctacaccatcagcacgcctgcacgcctggaaccgatcggtcgactaactttactaactgacccaagtagtaactgtaataggtttagttacggtacgttacggacgtaaaggaacctaagagtaaagaactaacgaaacgacgtggtacgatcgacacgtattcgtgtcttaacg

SEQ ID NO: 162160 - DNA, 545 bp, Homo sapiens
  misc_feature: GYAE6OF01AR8LH.3.1.A01.1.454.CMB.1.raw
  modified_base (418)..(418): a, c, t, g, unknown or other
  misc_feature (418)..(418): n is a, c, g, or t
tcagagacgcactccacgaccggtgctcgatttagacgtctcatcagggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggcagtcaaagtattagtaactcgttggcctggtatcagcaaaagaccaggcagacgaccccaaagctccttatctctgatcgcctcctaatttgaccacgacggtcggggtacccctaccgtaaccgttcacggcggcaggtggactcgtggacagagttcactctcaccatcagcacgcctgcagccgtgacgatgtcgactaacttntacctcgaccaacgtagtatagtaattaggttaagttggtaccgttcggaaccgtaagggaacctaaagataagaaaacgtaccgaaaacgacttagggacgctacggacactattcctgttcctac

SEQ ID NO: 162161 - DNA, 529 bp, Homo sapiens
  misc_feature: GYAE6OF01ATAQ8.3.1.A01.1.454.CMB.1.raw
  modified_base (441)..(441): a, c, t, g, unknown or other
  misc_feature (441)..(441): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagacaaagaccaggcagacgaccccaaagcctccttatctctgatcgccctcctaatttcgacacgacggtcggggtaccccaacctaacgttcacggtcggcaggtggactcgtaggggacaggtacgttcacttcgtacacatcagcacgctgcagcctgacgagtcgtacgactaacttatacctgacctaanagttatagtattagttagtggtacgttcggacgtaaggacaagataagaactacgaaagtactggagactagacactatctgtctacg

SEQ ID NO: 162162 - DNA, 1011 bp, Homo sapiens
  misc_feature: GYAE6OF01AR5KN.3.1.A01.1.454.CMB.1.raw
tcagagacgcactccacgaccggtgctcgatttagacgtctcatcagggggagactcagtccaggacaacagcatggaccatgtgggtcccgcctcagctcctcggggtctcctcgctggctcgtcggcgtccgaggtcgcctaattggtggacagtccagactgacccgagtcctccctccaccctggtctgcatcgtttaggagacagtacgttcggacctagtacgtaccgtacgggacccggggtcctacggggtaccctaaaagggttaagttttaacggtaaaaccgttccggttttcggggtccccttaggggttaactaccgaacggttaccgtaaaaacgggaacccgtaaggggaccgtaaccggaaccggtaaccccccttaaaaacggtcctttaaccctttaacttccgttacggttacgaccgttaccggaccccggtttacccgtaaacggttttacggaccggtaacgttaacggggttaccgggggttacccccgtaaccggttaaaccggggttttccgaacggggtaccgggtacccgtaaaacggggttacggggtaacgtttccggggtacggggaaaccgtaacgggttaaccggtttaccctaaaccgtttccgttaaccgaaaccccgtaaggtttacccggtaaccgggaccggtaaccgggtacccggttacggaacccgttaacggtacccgggtttaacgggaaccgggttaacggttaccggggtaccggggtaaacccttaaacccggttttacgttaacccgtaccgggtaccctaaaccgtaggtttaacgttacggttaaacgtttacggtttaaccggttcggggttaaacccgttcccgggaccggtaaaaacggggtcccgtaaaaggttaccggttaaacgttaaacgttaccggaaacggtaccggttacgggtaccggtacggttaccgggtaccggtaccctaagttccgttacggttaccgttaacccgg

SEQ ID NO: 162163 - DNA, 741 bp, Homo sapiens
  misc_feature: GYAE6OF01DGFOB.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgaccaaatgtgacatccagatcgacccagtcctccctccaccctgtctgctattcgtttaggagacagagtccaaccatccaccgtcggcccggacagtacaagtattagtaactcggttgcctaggtactcagacaaagaccaggcagacgacccaagtctacttagtctctagatccgccttacctaagtttcgacctacgtacgggtccgggtacccctacgtaacgtcgacggacggtacgtaggtacgacgtcggtacgggaactaggtacgttcctaactcctaacgtaccgtatccgaagccgtacgtacccgtgaccgtaccggtaccgtaacggtaacgttacggtacggttaccggtaacccgttaaacttttacggttacccgtaacggtaaccgtaacgttaaggttaacgttaaggttaagtttacggttttaacggttacggggtaaccgggtttaacccgggaaccggttaaaaccgggaacgttaaaacgaaacgttaaacggaaaacgttaaccgtaaaacccgttaacggttcggtaccggtaacgtacccggaacgttaacccgttgttaacccgttcgtttccctttaaacccg

SEQ ID NO: 162164 - DNA, 531 bp, Homo sapiens
  misc_feature: GYAE6OF01BW15J.3.1.A01.1.454.CMB.1.raw
  modified_base (352)..(352): a, c, t, g, unknown or other
  misc_feature (352)..(352): n is a, c, g, or t
  modified_base (418)..(418): a, c, t, g, unknown or other
  misc_feature (418)..(418): n is a, c, g, or t
tcagagacgcactccacgaccggtgctcgatttagacgtctcatcagggggagactcgagtcaggacacagcatggacatgtgggtccccgctcagctcctggggctcctgctgctctggctcccaggtcgccaaatgtgacatccagatgacccagtctccctccaccctgtctgcatctttaggagacagagtcaccatcacctgccggccagtcaagtattagtaactcgtggcctggtatcagcaaagaccaggcagagccccaaagctcctatctctgactcgcctcctaatttgcacagtcgggtcccaccaacgttcaagcggcaggtggactcgtgggactagngttcactctcaccatcagcacgcctgcacgcctgacgatgtcggactaacttagtacctgaccaanagttatacgtattagttagttagggacgtttacgggccaaacggggaccaaaggtactaaaggtaaactacgaaacgaacgtggtaggctaggccaacattcctgtcttaccg

SEQ ID NO: 162165 - DNA, 718 bp, Homo sapiens
  misc_feature: GYAE6OF01DJ8I5.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtcgccaaatgtgacatccagatgacccagtcctccctccaccctgtctgctattcgtttaggagacaggactccaaccatccacctggcccgggccagtacaagttatagtaacgtcggtggcctggtatcgagacaaacgaccgaggacagacgaccccaagcctcttatctctagactcgtcctactaagtttcgacctacgacgggttcgggtaccccaacgtaacccgttcgaacggtccggtacgtagggtcggtactcgggtagggaacctaaggtaccgtttaccgtaccttccttacccaacctacgttaccgacgtaccgacggtccctagacccgacgtccgttacggacgtagttcggaccggtaccttaaacgtttaccttacgtaccgaacccgtaagtacggttaagtttagtaaacgttttagtttaacggttacgggttaacccggtttaccggggaaccgtaaacgggtaaaccgtaaaggtaaactaaggtaaaaaccgttaaccgaaaacgttacggttacggtacgtcgtaccggaccttaaccccgtattaccgttcgttcccttaacccg

SEQ ID NO: 162166 - DNA, 842 bp, Homo sapiens
  misc_feature: GYAE6OF01B57PJ.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatcgacccagtcctccctccacctgtctgcattcgtttaggagacagagtccaccatccaccgtcggcccggcagtacaaagttattagtaacgtcggttcgccgtaggtactcgagacgaaacgaccgaggcagaccgaccccaagtccttacctatctctgatcgccctactaatttcgaccacgtacgggtccgggtacccctaaccgtaaccggttcgaacggccggacgtagggtaggtacgttcggtacggggaacgtaaggtacgtttaccgaacctttcccgtaacccaacccgtactaccggacggtacccgtaaccggtccccgttacggacccgtaacccggtacccgttaacgggaaccgttaggtttacggggttaccgggtaaccctttaaaaccgtttttaaccgtttaacccgtacccggtaaccccgttaaaacgttacggtttaacgttaacggttaaacgttttaacgggtttttaacggttaaccggggtttaacccgggtttacccgggaaacccggtaaaacgggggtaaacccgtaaaagggtaaacgttaaaacgggtaaaaaccgttaaacccggtaaaaaccgggttaacggtttacgggttaccgggtacgttaacccggaacccttaaccgttaaccgtttccgtttaccgtttacccgtttaaccccg

SEQ ID NO: 162167 - DNA, 613 bp, Homo sapiens
  misc_feature: GYAE6OF01BXOA2.3.1.A01.1.454.CMB.1.raw
  modified_base (410)..(410): a, c, t, g, unknown or other
  misc_feature (410)..(410): n is a, c, g, or t
tcagagacgcactccacgaccggtgctcgatttagacgtctcatcagggggagactcagtcaggacacagcatggacatggtcgggtccccgctcagctccgtggggctcctgctgctctggctcccaggtgaccaaatgtgacatccagatcgacccagtcctcccctcccaccctgtctgctattcgtttaggagacagagtcaccatccaccgtgccggccagtacaaagttattagtaactcgttggcctggtatcagacaaagaccaggcagacgaccccaaagcctaccttatctctgatcgcctacctaatttgacacgtacggtcggggtaccccacctaacgtcacgcggcaggtggatcgtagggacagtagtcactctacaccatcagcagcctgaccngccgtagacgtagtcgtcggacttaactttagttacgtacgaaccaactagtatacggtaatttaggtttacgttacgggtacgggttaccgggaacccgtaaacgggaaccgtaaaggtaagtaaaacggaaacgttaaccgaaaacggtaacgttcggacggtacgtacgacctaccgtacttcgttacgttcgttaaccg

SEQ ID NO: 162168 - DNA, 580 bp, Homo sapiens
  misc_feature: GYAE6OF01DKMO9.3.1.A01.1.454.CMB.1.raw
  modified_base (557)..(557): a, c, t, g, unknown or other
  misc_feature (557)..(557): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagacaaagaccaggcagacgaccccaaagctccttatctctgatcgcctcctaaatttgactacgacggtcggggtaccccaaccgtaaaccgttcgacggcggacaaggttgggatcggtagggaacaggtacgtttaccactctcaacctatcgaagcgagcctaggccacggcctaggaccgtaagtcggtaggaacttaaacgtttattaccgtacggaccaaacgtagttatagtagttagtttagttcgggtacgttaccgggaccgaaacgggtacaaagataaagaaatacgaaaagtacgtgngtctagacacatcttgtcttacg

SEQ ID NO: 162169 - DNA, 508 bp, Homo sapiens
  misc_feature: GYAE6OF01EX967.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaaagaccaggcagacgaccccaaagctccttatctctgatgcctccaatttgcacaggtcgggtcccaccgaacgttcagcggcagtggatcgtgggacagacgttcactctcaccatcagcagcctgcagcctagacgatggtgactaactttattacctgaccaatagtatgtaattagttattagggtacgttcggacgaaagggaccaagtataagaaactcgaaagactgtagctagactacattctgtcttac

SEQ ID NO: 162170 - DNA, 655 bp, Homo sapiens
  misc_feature: GYAE6OF01BBDIN.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccggccagtcaaagtattagtaactcgttggcctggtatcagacaaagaccaggcagacgaccccaaagctaccttatctctgatcgcctacctaatttcgaccaacgtacggtaccggggtaccccaacccgtaacgttccgacggccggacgtagggtggaactcgtaggggaactaggtacgttccaccgtctaccacctactcgacgcacggcctagccacgtccgtagacgtatggtcggaccttaaactttacttaccgtcgaaccctaagtagttaagtagtaagtttacggttaagttacgggtaccggttaccgggaaccggtaaacggggaaccctaaaggtaaacgttaaaacggaaaactaaccggtaaaaccggtaacgttacgggtacggtaccttacggacctacccgttaaattccgttacgtccctttaacccg

SEQ ID NO: 162171 - DNA, 668 bp, Homo sapiens
  misc_feature: GYAE6OF01B64XG.3.1.A01.1.454.CMB.1.raw
  modified_base (186)..(186): a, c, t, g, unknown or other
  misc_feature (186)..(186): n is a, c, g, or t
  modified_base (219)..(219): a, c, t, g, unknown or other
  misc_feature (219)..(219): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (411)..(411): a, c, t, g, unknown or other
  misc_feature (411)..(411): n is a, c, g, or t
  modified_base (454)..(454): a, c, t, g, unknown or other
  misc_feature (454)..(454): n is a, c, g, or t
tcagagacgcactccacgaccggtgctcgatttagacgtctcatcagggggagactcagtcaggacacagcatggacatgtgggtccccgctcagctcctggggctcctgctgctctggctcccaggtgccaaatgtgacatccagatgacccagtcctccctccaccctgtctgcatcttagganacagatcacatcacctgccggcagtacaaagtnttaagtactgttggacctggtatcagacaaagaccaggnacganaccccaaagctccttatcctctgactcgaccctctaaatttcgacctaacgtaggtacggggttaccccaaaccgtaaccgtttacgaacggaccggacgtaagggtagggaacttcggtaggggactaaggtaaggtttcacttacncctaaccagtcaacgacaacgcctgactacgccgtagaacgtntggtacggtaaccttaactttaatacctagaccctaaagaagtaagtacgtaattacgtttaagtagggtaaccggtttaccggaaccgtaaacgggaaccctaaaaggaagttaaaaccgaaaagttaaacccgtaaaacggtaacgttcgggtaacgggctttaacgggacctaaacccgtaacgttattcccgggttaccttttaaacccg

SEQ ID NO: 162172 - DNA, 570 bp, Homo sapiens
  misc_feature: GYAE6OF01D2NXL.3.1.A01.1.454.CMB.1.raw
  modified_base (229)..(229): a, c, t, g, unknown or other
  misc_feature (229)..(229): n is a, c, g, or t
  modified_base (299)..(299): a, c, t, g, unknown or other
  misc_feature (299)..(299): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaatgtgacatccagatgacccagtcctccctcccacccttgtctgcatcgtttaggagacagagtccaccatccacctcggccgggccagtacaaagtnttagtaactcggttggccgtaggtatcagacaaagaccagacagacgaccccaaagtcctacttactctntgatcgcctccgtaattcgacacgaggttccgggacccacctaacggtacgacgcggacaggtggatcgagggatagagttcactctaccgactatacacgacacgcctgaccgtacgccgtagaccgtagtgtacggtactaacgtttactacgtcacaacgtagtatagtagttagtagttacggtacgtacggacgaacgggtaaccaagtactaaagaacgtacgaaatacgtggtacgctagacctacgaattcttagtccttacg

SEQ ID NO: 162173 - DNA, 680 bp, Homo sapiens
  misc_feature: GYAE6OF01DC75X.3.1.A01.1.454.CMB.1.raw
  modified_base (186)..(186): a, c, t, g, unknown or other
  misc_feature (186)..(186): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtcctccctccaccctgtctgcatcttaggganacagacgtccacatccacctcggccggcagtacaaagtattaagtaactcggtcggctaggtatcagacgaaagaccaggacagaccgaccccaaagcctaccttatctctgactcgcctactaatttcgcaacgtacggtccgggtaccccaaccgtaaccgttcacggtcggacgtaggtaggtacgttcggtagggtaacaggtacgttcgtacctccgtaccaacctactaccgaagtacccgacgtccctacggaccgtacgtcccgttaggaaaccggttcgttacgggtaccggttaaccttaaacttttaacgttaccgtaccgaaccctaacgtagtaacgttagtaacgtttaggttacgttacggtaccggttaccggaccggtaaacgggaacctaaagaacgtaagaaacgtaaccgaaacgtaacggttcggtacgggtacctacggaacctaacctagtttaccgttgttcccttaccg

SEQ ID NO: 162174 - DNA, 588 bp, Homo sapiens
  misc_feature: GYAE6OF01A3PSH.3.1.A01.1.454.CMB.1.raw
  modified_base (219)..(219): a, c, t, g, unknown or other
  misc_feature (219)..(219): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccggcagtcaaagtntagtactcgttgcctggtatcagcaaagaccaggcagacgaccccaaagctcctatctctgatcgcctacctaatttcgacacgaggtccggggtacccctaaccgtaacgttcgacggcggacaggtggatcgtacgggactagtacgttcacttcctacaccatcgagcacgcctgcacgtctgacgtgtgtcgaactaaccttattaccgtcgacctaaacgtagtagttacgtaagtttacggttagttacgggtaccggttaccggaccggaacgggtaaaccaagtaacgtaaacgtaaacgtaaccgtaaacgacggttacgcggtacctcgacccgtacaacgtttcgtcgttccttaccg

SEQ ID NO: 162175 - DNA, 525 bp, Homo sapiens
  misc_feature: GYAE6OF01CB258.3.1.A01.1.454.CMB.1.raw
  modified_base (432)..(432): a, c, t, g, unknown or other
  misc_feature (432)..(432): n is a, c, g, or t
tcagagacgcactccacgaccggtgctcgatttagacgtctcatcagggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaaagaccaggcagagccccaaagctcctatctctgatgccctccaatttgcactaggtcggggtcccaccgaacgttcaagcggcaggtggaatccgtgggacaggtagttcactcctcaccatcagcagcctgcagcctgacgatgtcggctaaattacttactcgacctaacagtactanagttagttattgggacttcgggaccaaagggaccaaaggataagaaactacgaaacgacgtggtaggacagtaccactatcttaggtcttacg

SEQ ID NO: 162176 - DNA, 846 bp, Homo sapiens
  misc_feature: GYAE6OF01DPDC8.3.1.A01.1.454.CMB.1.raw
tcagagacgcactccacgaccggtgctcgatttagacgtctcatcaggggagactcagtcaggacacagcatggacatggtgggtccccgctcagctcctggggctcctgctgctctggctcccgaggtgaccaaatgtgacatccagatcgacccagtcctcccctccaccctgtcctgcattcgttaggagacagtagcaccatccaccgtcgccgggcctagtacaaagttacttaagtaactcggtttacggcctagggtataccgaagaaccgaaaagaaccgaggacaaggaacgaaccccctaaaaggtccttacctttaagtccgtactacggtactacgtacccttacccgtaaattttggaacctaacggacgggttcccggggtaaccccctaaccggtaaaccgtttccgaaggccggtaccgtagggtacggtactacggttacgggaactaacgggtacgtttacccacttaccttaaccaacccttaacgaccggttaaccgacccaaacccgtaggaacccgtacggtaccccgttaaaggaaccggtaagttacggggttaaccggactttaaaacctttaacgtttaaccctacgggaaaccccgtaaataagggttaattagtaagttttaacgggttaacgtttacggggtaacccgggttttaaccgaaaccccgggtaaagggggtaaaaccctaaaaggtaaaacggttaaaaacgtaaaaaccggtaaaaccgtaaaaaccggtaacggtttacgggtacgggtaccgttaacggacccctaaacccgttagtttaccttacgtttccgaccttttaacccg

SEQ ID NO: 162177 - DNA, 624 bp, Homo sapiens
  misc_feature: GYAE6OF01DNJU2.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatcgacccagtctccctccaccctgtctgctattcgttaggacacagagtcacatcacctggccggacagtacaaagtattacgtaactcgtggcctaggtatcgagacaaagaccgaggacagacgacccaagtcctcttatctcagtactcgacctactaatttcgactacgtacggtccgggtacccaacgtaaccgttacacggcgacgaggtcggactcggtacggaacaggtacttcctactctacctactacgtacgacgaccacgtccgtagcctaggtccctaggacgtatcggtacgacttaacctttagtacgtacgaactaacgtagttacgtagtacgttaagtttacgtaacgggtacgttaccggaccgaaacgggtaacctaaaggtaacgtaaagaaacgtaccgaaacgtacggtcgtaggtacccgtagtaccctaactagtccgttgtcctttaacccg

SEQ ID NO: 162178 - DNA, 840 bp, Homo sapiens
  misc_feature: GYAE6OF01DSM0Z.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtcctccctccaccctgtctgctatctttaggagacagagtccaccatccacccgcggccgacgtacgtaaacgtaagttagttaacgtacgttcggtcgtcgtagtactagacgaaacgaaccgagacgacgacgacccgaaccgactccttacgttctctgacgtctccgtcctacttagtcgacgtacggtacgggtacccgtaccctaacgtaccgtacgcggacgtaggtaggtacgtacgtacgggaacgtacgtacgtacgttaccgaccttaccaacctacgttaccgacgaccgaccgtaccgttccgacgtaccgtaccgtacggaacggtacgtttacggttacgggtaacccgttaaacgttttaacccgtttaacgttacccgtaacccgttaaacgttaaaccggtttaagttaagggtttaacgtttaaacgggttttaacgggttttaaccggggttaacccgggggttttaaccccgggtaaccccgggtaaaaccggggtaaaccggtaaaacccggttaaacggttaaaaacggtaaaaaacgttaaaccccggtaaaaccggtaaaaacgggtttcggttaccggggtaacccgtaccgttaaccccggtaaccttaaccgtttaaccgttttacccggttttaccgttaccccttttaaccccggg

SEQ ID NO: 162179 - DNA, 646 bp, Homo sapiens
  misc_feature: GYAE6OF01AWZIH.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtcctccctccaccctgtctgctatctttaggagacagagtcaccatcacctgccggcagtacaagtattagtactcgtgctggtatcagacaaagacaggcagacgaccccaaagtcctaccttatctctgtactcgcctcctaagttttcgacacgaggtccgggtaccccaaccgtacgttcgaggcggacgaggtaggtatcgtcgggaacaggtagttccacgttcctaccacctactcgagtccacgtccgtagaccacggacctgggaaccgtagttacgggtaggtacccttaaacgtttacttaccgtacgtaacctaaaccgtagtaacttaggtactttaaggttacgtttacggtaccggttacgggaccgtaaaggaacccgtaaaggtaataaacggtaaacgtaaccgtaaaacgggtacgttcggtacggtaccttacgtacccgaaacttacgttcgttcgttaccgtttaacccg

SEQ ID NO: 162180 - DNA, 566 bp, Homo sapiens
  misc_feature: GYAE6OF01DMF2J.3.1.A01.1.454.CMB.1.raw
  modified_base (545)..(545): a, c, t, g, unknown or other
  misc_feature (545)..(545): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtcctccctccaccctgtctgcatctttaggagacagagtcaccatcacctgccgggcagtacaaagtattagtaactcgtgcctgtatcagcaaagaccaggcagagccccaaagctccttatctctgatcgcctcctaatttgcaacgtaggtcggggtccccaaccgtaacgttcgaacgcggactaggtaggactcgtggggaacaggtacgttccacttcctacaccatcagccacgcctagaccagtcctaggaacgatggtcgtacctaaactttactttactacgaaccctaagtagttaataggtaatttaaggttagttgggtaccgttaccggacgaaacgggacctaaagagtaagaaactacaaacggtagtgtacggntacgaccactatctgtcttac

SEQ ID NO: 162181 - DNA, 713 bp, Homo sapiens
  misc_feature: GYAE6OF01ECEIK.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatcgacccagtcctccctccaccctgtctgcattcgtttaggagacagagtcaccatccacctcggccgggccagtacaaagttattaagtacttcggttcggcctggtactcgagacaaacgaccaggaccagaaccgaccccaaagtccttacctttatccgtctgtactccgaccttacctaagtttcgactacgtacgggtccgggtacccctaaccgtaacgttcgacggtccggctaggtggactcggtagggactacgtacgttcactctaccaccatacgagccgacgtccgtgacctacgtccgtagaccggtagttggtacgtaacttaactttacgtaccgtacgaaccgtaacgtagttagttagttaagtttacgggtttacggttacgggttaacccggttaccgggtaacccggtaaaggggtaaacctaaacggtaaacgttaaaaccgtaaaacggttaaacccgtaaaacgggtaaccggttagggtaccggtaccgtaacgggtaacccttaacccgttacgtttccggtttcgtttacccggttaccc

SEQ ID NO: 162182 - DNA, 676 bp, Homo sapiens
  misc_feature: GYAE6OF01BMR1G.3.1.A01.1.454.CMB.1.raw
  modified_base (185)..(185): a, c, t, g, unknown or other
  misc_feature (185)..(185): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgctatcttagganacagacgtcacatcaccgtgccggcagtacaagtatagtactcgtgctaggtactcagacaacgcgagcagacgaccaagctactatctngactcncctacgtaattcgaccagtacggtcggtacccaacttaacgtcacggcgcgtaggtcggtatacgtagggaactaggtacgttaccacttccgactacccgtatctaacgccacgtcctcgacctacgtaccgtaggtaacctagtacggtacggtaaccttaaacgtttacttaccgtacgtaaccctaaacgttagttaacgtagtttaagttacgggttttaacgttacgggttaacccggtacgggtaacccgtaaacgggtaaaccgtaaaggtaaacgttaaaacggtaaacgtaaccgtaaaaacccgggttacggtttaaacgggacggttaaccgtaccggtaacccgtaaccttaaccgtttcgtacccggtttcttaacccccg

SEQ ID NO: 162183 - DNA, 596 bp, Homo sapiens
  misc_feature: GYAE6OF01DDWUV.3.1.A01.1.454.CMB.1.raw
  modified_base (389)..(389): a, c, t, g, unknown or other
  misc_feature (389)..(389): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtactcgttggcctggtatcagcaagaccaggcagacgcccaaagctccttatctctgatcgcctcaatttgcacaggtcggggtccccaaccgtaaccgttcacggcggactaggtggactcgtgggacagtagtcacgtctcaccatcagcagcctgcacgcnacgatcgtggactaactttattacctacgacctaacgagttaagtgggtttagttaacgtttcgggaaccggttttccgggaaccggaacggggtaacccgaaaaggtaataaacggtaaaacgtaaccgtaaaaacggtaacgttagggttacggaccttaggacccttaaccgacgttccgttaacgttccgtttcgttaaaccc

SEQ ID NO: 162184 - DNA, 679 bp, Homo sapiens
  misc_feature: GYAE6OF01CM4U6.3.1.A01.1.454.CMB.1.raw
  modified_base (187)..(187): a, c, t, g, unknown or other
  misc_feature (187)..(187): n is a, c, g, or t
tcagagacgcactccacgaccggtgctcgatttagacgtctcatcagggggagactcagtcaggacacagcatggacatgtgggtccccgctcagctcctggggctcctgctgctctggctcccaggtgccaaatgtgacatccagatgacccagtcctccctccaccctgtctgcatctttagganacagagtcaccatccacctgccggccagtacaaagtattagtaactcgttgcctggtatcagacaaagaccaggacaagacgaccccaaagcctaccttatctactgatcgcctacctaatttcgacacgtacggtcgggtacccaaccgtaacgttcacggcggacagtggactcgaggacagtagtccactctaccacaactcgagacctacgcctagacaacggtcctaaggaaccgtagtcgtaggaccttaaacgtttaacgttacttacggaaccctaacgtaagtttaactggtaacgttttaaagggtttacgtttacgggtaacccgggtttaaccgggaacccgtaaaacgggggtaaccctaaaaggtaaacgttaaaggaaaaaccttaaccggaaaaaccggtaacgttaccgggttaaggtacccttaacgggaccctaaaaccggttacgttacccggttacggttccctttaaccg

SEQ ID NO: 162185 - DNA, 776 bp, Homo sapiens
  misc_feature: GYAE6OF01CH3OE.3.1.A01.1.454.CMB.1.raw
  modified_base (193)..(193): a, c, t, g, unknown or other
  misc_feature (193)..(193): n is a, c, g, or t
tcagagacgcactccacgaccggtgctcgatttagacgtctcatcaggggagactcagtcaggacacagcatggacatgtgggtccccgctcagctccgtggggctcctgctgctctggctcccgaggtcgaccaaatgtgacatccagatcgacccagtcctccctccaccctgtctgctacttcttagganacagacgtccaaccactcaccgtcggacccgggtaccaggttactaaaagttacgttaacgttaaccgttcggttacggtacccgttaggtactcgaacgacgaaacgaccgaggacacgaccggacccaaacgtccttaccttatcctgtagtactcgtacccttactagtttcgacacgtacgggtccggtaccctaacgtaaccgtcgacggacggtactaaggtcgtacgtcggtacggactagtacgtccacgtcctaccaacgatccgacgtaccgtacgacccgtgaccctacggtacccgttacggacgtacggttcgggttaaccgtaacctttaaacgtttaccgtttaaccgaaccggtaacctaaaccgtttaggtaagttacgggttaacgtttaacggtttaaccggtttaccggggttaaccggtttacccggggaacctaaaaccggggtaaccgaaacgttaaacggtaaaacggtaaacccgtaaccggaaaacggtttaccgtcgggttacgggtaacctacgggtaaccttaacccgtatttccgttacgttcccgtttaccc

SEQ ID NO: 162186 - DNA, 635 bp, Homo sapiens
  misc_feature: GYAE6OF01DVKM3.3.1.A01.1.454.CMB.1.raw
  modified_base (620)..(620): a, c, t, g, unknown or other
  misc_feature (620)..(620): n is a, c, g, or t
tcagagacgcactccacgaccggtgctcgatttagacgtctcatcagggggagactcagtcaggacacagcatggacatgtggggtccccgctcagctcctggggctcctgctgctctggctcccaggtgccaaatgtgacatccagatgaccccagtcctcccctccaccctgtctgcattctttaggagacagagtccaccatccacctcggccgggccagtacaaagtattagtactcgttggcctggtatcagacaaagaccaggcagacgaccccaagctccttatctctgatcgccctactaatttcgactacgtacggtccgggtaccccaaccgtaacggttcaggccggagacgggtgacgttcggtagggaacgagtacgttctacctctaccgaacccagttccgacgtaccgacggtccctggaaccgtacggtcctaggaacgtgttaggtcggtaaccttaactttacgtactccgaacctaacgttaggtaacttagtaagtttacgggtttagttacgggtacccggtttaccgggaccgaaagggtaacccaaggtaataaacggaactaacgaaacgtacggttgacggtctacgcaacctntacttcgtcttaccg

SEQ ID NO: 162187 - DNA, 555 bp, Homo sapiens
  misc_feature: GYAE6OF01DRTYE.3.1.A01.1.454.CMB.1.raw
  modified_base (360)..(360): a, c, t, g, unknown or other
  misc_feature (360)..(360): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccggcagtcaaagtattagtaactcgttggcctggtatcgagacaaacgacaggacagacgaccccaaagcctacttaatctctgatcgccctaccaatttcgacacgtacggtcgggtaccccaaccgtaacgttcacggcggcaggtggatcgngggactagtagttcactcgtccaaccatacagcacgcctgacacgccgtgacgtagtcggtacgaccgtaactttagtactacgaacctaacagttactagagttagttagtaggtacgttacggaccgtaaaggacaagaataaagaaactacgaaacgtagtcgtaggcacgtacactatccttgtccttacg

SEQ ID NO: 162188 - DNA, 657 bp, Homo sapiens
  misc_feature: GYAE6OF01EPOGS.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagacgtcaccatcacctcggccggccagtacaaagttattagtaactcgttcggcctggtatcagacaaagccaggcagacgaccccaaagtcctcttatctctgatcgccctactaatttcgactacgtacggttaccgggtaccccaaccgtaacgttcgacggcggaccgtaggtcggacgtcggtacgggaacgtagtacgttcgaaccttcctacacctactacgacgccacggtcctgaccgacgtaccgtaggaaccgtgttaccgggtagtaccttaaacgtttacgttaacctaccgaacctaacgtagtacttagtaagttagtttacgttacgggtaccggttacggacccgaaaggtaactaaggtaataaacggtaaaacgtacccggtaaaagtacgttcggtacgtacccgttacgaacctaacccgtatttccgttccgtttcccgttaacccg

SEQ ID NO: 162189 - DNA, 755 bp, Homo sapiens
  misc_feature: GYAE6OF01C4QZK.3.1.A01.1.454.CMB.1.raw
tcagagacgcactccacgaccggtgctcgatttagacgtctcatcaggggagactcagtcaggacacagcatggacatgtgggtccccgctcagctccgtggggctcctgctgctctggctcccaggtgaccaatgtgacatccagatcgacccagtcctccctccaccctgtctgctattcgttaggacgacgagacgtccacctataccgaccgtcggcccggacctagtaacgtaaagttagttacgtacgttcggttcggtccgtaggtactacgagacgaaacgaccgacgacacgaccgtacccaagtccttactactcctcgtacgtactcctacctactagtttcgacgtacgtacgggtccggtacccctaacgtacgtcgacggtacggacgtaggtacggtacgtcggtacggtactaggtacgttacctaccgtccgtaccaacctacgtacggacgtaccgtaccgtccgtacgacctaccggtaccgtacggtacgttacgtcgggtaaccgtaaccttaacctttacgtaccgtaccgtaacgtaacgttaacggttaagtaaccggtttagtttaaccggggttacgttaaccggggttaccggttacccgggaacggtaaacgggtaaacgtaaggtaaacgtaaacgtaaaaccgtaaccggtaaaggtaaccggttcggtacggtaccgtacccgtaccggttacttaccgtttcgttacccgttcttaaccccgg

SEQ ID NO: 162190 - DNA, 653 bp, Homo sapiens
  misc_feature: GYAE6OF01EQ0U9.3.1.A01.1.454.CMB.1.raw
  modified_base (190)..(190): a, c, t, g, unknown or other
  misc_feature (190)..(190): n is a, c, g, or t
  modified_base (277)..(277): a, c, t, g, unknown or other
  misc_feature (277)..(277): n is a, c, g, or t
  modified_base (325)..(325): a, c, t, g, unknown or other
  misc_feature (325)..(325): n is a, c, g, or t
  modified_base (475)..(475): a, c, t, g, unknown or other
  misc_feature (475)..(475): n is a, c, g, or t
tcagagacgcactccacgaccggtgctcgatttagacgtctcatcaggggagactcagtcaggacacagcatggacatgtgggtccccgctcagctcctgggggctcctgctgctctggctcccaggtgccaaatgtgacatccagatgacccagtctccctcaccctgtctgcatctttaggagacagngtcaccatcacctgcccggcagtcaagtattagtactcgttggccttggtatcagcaaagaccaggcagacgccccaaagcttaccnttatctactgactcgtaccattttccgaactttcgactaggggtaccnccgggtaacccgttaccaaacggttcgacgacggtcggaagttcggtaggtaccagggacttacgaactttcctactacccgtacacctaacgtccagtccctaagcccgtaggccgtacggaccgttagtacggtacgtacggttaacnggttactaacgttacgtaaccgtacgtaacgtaacgtacgtaagttagttagttacggttaacggttacgggtaaccggttacggtaaccgtaaacggtaaacgtaaacggtaacgtaacgaaacggtaacgtacgtacggtacggtacgtacgtaccgtacctaccgttacgttacg

SEQ ID NO: 162191 - DNA, 718 bp, Homo sapiens
  misc_feature: GYAE6OF01EQXBL.3.1.A01.1.454.CMB.1.raw
  modified_base (141)..(141): a, c, t, g, unknown or other
  misc_feature (141)..(141): n is a, c, g, or t
  modified_base (193)..(193): a, c, t, g, unknown or other
  misc_feature (193)..(193): n is a, c, g, or t
  modified_base (224)..(224): a, c, t, g, unknown or other
  misc_feature (224)..(224): n is a, c, g, or t
tcagagacgcactccacgaccggtgctcgatttagacgtctcatcaggggagactcagtcaggacacagcatggacatgtgggtccccgctcagctccgtggggctcctgctgctctggctcccaggtgccaaatgtgacntccagatgacccagtcctccctccaccctgtctgctattcttaggagacagngtcaccatcaccgtcgccggcagtacaagtnttagtactcgttggccttgtatcagacaaaacgcgacgacacgaccaccgacgtcctacttactcctcgtagtcgtcctaccttacttagtccacgtacggtcggtacccggtaccctaaccgttacgtacggaccggacgtacggtaggtcggtacgtacgggacggtacgtacgtacgttaccctccgttaccctaaccgtacctaacgttacgacgaaccggtccgtacccgtacgtacccggaacccgtaccgggaacgtacggtaccggttggggtaacccttaacctttaaacgtttacctacccggaaccgtaaaccttaccgtaagttacgttaagttacgtttagggtttacggttaccggtacccgggttacggaaaccgggtaaccggataaaccggtaagaaaactcgaaaccgttaaaggcttgggggacctacctaccggttaacccaagtttcccttgttccgttaacccgtttacccg

SEQ ID NO: 162192 - DNA, 515 bp, Homo sapiens
  misc_feature: GYAE6OF01CO6KZ.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccagcagagccccaaagctccttatctctgatgcctccaaatttgacacagtcgggtacccacaacgtcagcgcagtggatctggacagagttcactctcaccatcagcagcctgcagcctgacatgtcgctaacttagttacagtacccaaatagtaactaggtaattagttacgttggacgtttacggaccaaagggtacaaagtataaggaaactacgaaaacgaacttgtagccagtaccaccatcgtgtcgttaccg

SEQ ID NO: 162193 - DNA, 619 bp, Homo sapiens
  misc_feature: GYAE6OF01D7WHR.3.1.A01.1.454.CMB.1.raw
tcagagacgcactccacgaccggtgctcgatttagacgtctcatcagggggagactcagtcaggacacagcatggacatgtgggtccccgctcagctcctggggctcctgctgctctggctcccaggtgaccaaatgtgacatccagatcgacccagtcctccctccaccctgtctgctattacgttaggagacgagacgtccacactccaccgtcggccggcagtacaagtatagtactcgttcgctgtactcgaagacaaacgacaggacacgacgaccaacgtctaccttatctctagtacgtccgtaccttactaagttcgactacggaccggttacgggtaccccaacgtacgttacgacgcggagtacgtcggtactcggaggaacgtaggtacgttcaccgtctacgactatcagctacgcgtacgcgtaacgccgagtacgtaggtcgtactaacgtttaacttagtacctacgaacaagtagtactgtaacgttagttacgttcggtaccggtaacgacggtaaacggataaacggtagaaaacgtaactaacggtaaagacgttcgtacggtagaacctaccgtacttactcgttacgtctttaacccg

SEQ ID NO: 162194 - DNA, 804 bp, Homo sapiens
  misc_feature: GYAE6OF01BS4PS.3.1.A01.1.454.CMB.1.raw
  modified_base (194)..(194): a, c, t, g, unknown or other
  misc_feature (194)..(194): n is a, c, g, or t
tcagagacgcactccacgaccggtgctcgatttagacgtctcatcagggggagactcagtcaggacacagcatggacatgtgggttcccgctcagctccgtggggctcctgctgctctggctcccaggtgaccaaatgtgacatccagatcgacccacgtcctcccctccaccctgtctgctattcgttagganacgagacgtccaccactaccaccgtcggcccgggacctaggtacctaaagttacttaacgttaaccgttcggttggccgttggtactacgaacgaacgaaaccggaccgagggaccacggaaccgaccccgaaagtcccttaccttactctcgtgtactccgacccttacttaacgtttcgaccgtaccgtacgggttacccgggtaccccctaaccggtaaccggttccgacggggaccggtacggtagggtacgggtacggtaccggtaggggtaacctaacggtaaccgtttaccccgtaccgttacccgtaacccctaaccgtaccgtaccgtacggacccggtacccgacccgttccggaaccgtaccggccgttaacgggtaaccgtaggttaccggttaacggtacccttaacgtttaccgtacctacccgtaacctaagttagtagttagttaaagttacggtttaggttaccgggttaccggtacccggaaccggtaaacggaaccgtaaagtaaaccgtaacgtaaacgtacgtaaacccgtaggttcggacggtcctaccgtaacctcccgttaagtttcccgtccttacccgttcccg

SEQ ID NO: 162195 - DNA, 738 bp, Homo sapiens
  misc_feature: GYAE6OF01EGI6K.3.1.A01.1.454.CMB.1.raw
  modified_base (190)..(190): a, c, t, g, unknown or other
  misc_feature (190)..(190): n is a, c, g, or t
tcagagacgcactccacgaccggtgctcgatttagacgtctcatcaggggagactcagtcaggacacagcatggacatgtgggtccccgctcagctcctggggctcctgctgctctggctcccgaggtgccaaatgtgacatccagatcgacccagtcctccctccaccctgtctgctattcgttagganacagacgtccacctatccaccgtcggccggacagtacaaagttattacgtaacttcggtcgtccgtaggtactcgaacgacgaaacgaccgaggacacgaccgacccaatcctccttatctcgtagactccgacctactacttcgaccgtaacggtcggtccgggtaacccctaacgtacgttcgacggcggacgtaggtcgtacgtcggtacggaactacggtacgttacccgacttaccgtacgtaacctagtaccgaaccggtaccgtaccgtaccgtcggtaacctaccgggtccgaacggtacgttcggtacggttaccgtaaccttaacgtttacttaccgtacggaaccctaaggtaacgttaaacgtaacccggttaccgggacggttaccggtaccccgggtacgggaacccggtaaacggggtaccggtaagggttacggtaacgtaaccgttaaccggaaacgttaacccgggttaggccgggttacggaccgtacggtacctaaccgttctttacggttcccgttcccgttacccg

SEQ ID NO: 162196 - DNA, 674 bp, Homo sapiens
  misc_feature: GYAE6OF01BKLYI.3.1.A01.1.454.CMB.1.raw
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtcctccctccaccctgtctgctatcgtttaggagacagacgtcaccatcacctggccgggcagtacaaagtattagtaactcgttggcctggtatcgagacaaacgaccgaggcagacgaccccaagtcctccttatctctgatcgcctactattcgactacgacggtcgggtacccaccgtacgttcgagccgntaggtggagtcgnggacgagtagttcactctacacctactcgacgtcacgtccgtgacctacgcctaggacgtacgttagtacgtaaccgttaacctttacgttaaccgtacccgaaccgtaaacgtagttacgtaaggtttaaacgttaggttttaaccgttacggggttaacccggttaccgggtaacccggtaaaacgggaccctaaaaggtaaacgtaaaacggtaaacgttaaacccgtaaaacggtaacgggtttcggtaacccggtacgttaccggaaccttaaccgtacttaccggtttcgttaaccctttacccgg

SEQ ID NO: 162197 - DNA, 722 bp, Homo sapiens
  misc_feature: GYAE6OF01BYDR4.3.1.A01.1.454.CMB.1.raw
  modified_base (516)..(516): a, c, t, g, unknown or other
  misc_feature (516)..(516): n is a, c, g, or t
  modified_base (535)..(535): a, c, t, g, unknown or other
  misc_feature (535)..(535): n is a, c, g, or t
  modified_base (645)..(645): a, c, t, g, unknown or other
  misc_feature (645)..(645): n is a, c, g, or t
  modified_base (670)..(670): a, c, t, g, unknown or other
  misc_feature (670)..(670): n is a, c, g, or t
tcagagacgcactccacgaccggtgctcgatttagacgtctcatcaggggagactcagtcaggacacagcatggacatgtgggtccccgctcagctcctggggctcctgctgctctggcctcccaggtcgacctaaatgtagacataccagagtcgacccacgtcctccctccctaccctgtctgacctattcgtttaggacgtacagtacgtaccaacctactccaaccgttcggacccgggaccaacggttacaaaagtttaacgtttaacgttaaccggtccggtttcggtccgttaggttacgtacaaggtaaccgaaaacggacccgaggtacgaacggaaccgaccccgtaaacgtccttaccgttaactcctacgtcgtactcccgtacctaaccgttaagtttccgactacggtacggttccgggaccctaacgttacgtcgacggccgacgtgtacggtacgtcggtacgagtacgtcttacgtacctacgtaccaactacgtgacncgtaccgccttacggaacncgtaccggtacagtaggtcgtacgttaccatttacgaccgtcaaccctagtactgttaagtacgttagttcggttacgtaccggtacggaacgtagggaacgaagttaanaaacggaaacgtactaaaaccgggnttagggacccgttagacgtacaacgttacttcgttaaccgttcctttaaccg

SEQ ID NO: 162198 - DNA, 810 bp, Homo sapiens
  misc_feature: GYAE6OF01AP4X6.3.1.A01.1.454.CMB.1.raw
tcagagacgcactccacgaccggtgctcgatttagacgtctcatcagggggagactcagtcaggacacagcatggacatggtcgggtccccgctcagctccgtggggctcctgctgctctggctcccagggtgaccaaagtgtgacatccagatcgaccctacgtcctccctcccaccctgtctgactagttcgtttaggacgacgtaggacgtaccacctactcctaccgtcggcccgggacaagtacctaaagttacttacgtaaccgttcggttcggtccgttggtatacgaagaccgaaagccgaggacgacgaccgaccccaaagtccttaccttactcctacgtcgactccggtacccttaccgtaagtttcgaccgtaacggtacgggttaccgggtaccccctaaccgttaacggtccgacggacccggtagtaacgggtccggtaacgttaccgggacgggtaacgtaaggttaccgttaccctaccgttacgtacccgtactaaccgtcgtaccgaccgtaccggtccgtacgtaccgaccggtaccgtacggtacggtacggtacgtaaccggttaaccttacgtttaaccgttacgtaccgtaaccctaaggttacgttaacgttaggttaacggtttaacgtttacggttacggggttacccgggttaaccgggaaccggtaaacgggtaaactaacggtaacgtaaaacgtaaacgttaaccggtaaacgttacggtacggacccggttacgacccggtaactaccgttaagttccgttaaccggtctttaccccg

SEQ ID NO: 162199 - DNA, 719 bp, Homo sapiens
  misc_feature: GYAE6OF01DEENO.3.1.A01.1.454.CMB.1.raw
tcagagacgcactccacgaccggtgctcgatttagacgtctcatcgagggggagactcagtcaggacacagcatggacagtgtcgggtccccgctcagcctccgtggggctcctgctgctcgtcggctcccgaggtcgaccaaagtgtagacataccagactcgacccagtcctccctccacctgtctgactagttacgttaggacacgagacgtcacactccaccgtcggcccggactagtaactaagttacgttaacgtaccgtcggttaggaccgttaggtactacgaagaacgaaacgaccgaggaccgaacgaccgaacccaacgtccttaccgttagtctacgtgtactccgtacctactagttacacgtaggtacggtccggtacccaacgtacgtcgacggacgtacgaaggtcgacgtcggaacggacgtagtacttacgtacctacaccgtacgtataccgacgtcctaacggtccgtagaccgtacgtaccgtaaggaacgttaggtacgttacgtaacctttaaacttacgtaccggaacgaactaacggttagtaagtaacccgtttaaggttacgtttaacgggtacggttaccgggttaaccggaaccggtaaacggtaaaccgtaaggtaacgtaaaacgtaaccgtaacggtaacgtacggtcggtaacgcgtacaccgttactacgttctaccgtacttcg

SEQ ID NO: 162200 - DNA, 762 bp, Homo sapiens
  misc_feature: GYAE6OF01EP63L.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtcctccctccaccctgtctgcatcttaggagacagagtcacatcacctggccggccagtacaaagtattagtaacgtcgttggctggtatcagacaaagaccaggcagacgaccccaaagctaccttatctctgatcgcctactaatttcgacacggtacggttcggggtacccctaccgaaaccgttcgaacggtcggactaagggttcggtaacgttccggttaggggaacctaagggttaaccgtttacccgtaaacctttcccgtacctaaacccctaagtttacccaacgggaccctaaccggtccccgttacgggaccgaaaccggttcccgtaaccgggtaaaaccggtacgttacgggtttaccgggttaaccttaaaccgttttaacgtaacccgttacgaacccctaaagtacgttaagttaggtaaagtttaacggttaagtttacggggtaacccggtttaccgggaacccggtaaacgggaaacccgtaaaggtaacgtaaaaggtaaaccgttaaaccgaaaaggttaccggttaaaggtacgggtacctacgggtaccctaacccgtagtttcccgttagttcccgttaaccg

SEQ ID NO: 162201 - DNA, 748 bp, Homo sapiens
  misc_feature: GYAE6OF01CBM9O.3.1.A01.1.454.CMB.1.raw
tcagagacgcactccacgaccggtgctcgatttagacgtctcatcaggggagactcagtcaggacacagcatggacatggtcgggtccccgctcagctccgtggggctcctgctgctctggctcccaggtgcaaatgtgacatccagatcgacccagtcctccctccaccctgtctgctattcgttaggagacagactcaccatcaccgtcggccggactagtacaaagttattaagtactcgtcggcctaggtatcagacaaacgaccaggcaacggaccgaacccaacgtcttaccttactctcgtagtactccgtaccttacctaaatttcgaaccacgtacgggtaccggtacccaaccgtaacgtacgacggcggtacgtaggtacggacgttcgtacgggaactaacggtctaccgtacctactacccaaccgtaactcgaacgtacccgtacgccgttacgacgtaccgggtaccgtacgtaacgttaggttacgggtaacggtttaccgttaaaaccgttttacgttacctaacgtaacccgtaaacgtagttaacttaggttaaacgtttagggtttacgggttacggtaacccgggttaccgggtaacccgaaacgggtaacctaaaagggtaccgttaaaaacggtaaacgtaaaccgtaaaacggttacggttaacgggtccggtaaccttaccgaaccttaaacccgttaagttccgttacgttaccttaccccg

SEQ ID NO: 162202 - DNA, 874 bp, Homo sapiens
  misc_feature: GYAE6OF01D37Q1.3.1.A01.1.454.CMB.1.raw
tcagagacgcactccacgaccggtgctcgatttagacgtctcatcaggggagactcagtcaggacacagcagtggacatggtcgggtccccgctcagcctccggtggggctcctgctgctcgtcgtcctcccgaggtcgactaaagtgtgacactaccagactccgaccctacgttccctcccctccctacccgttcgtccgtcgacttacgttacggttaggacgaacgtacggtaccgtaccaacctaccttaccgaccggtccggacccgggtacctaacgtaaacgttaaacggttacgttaacggttaccgttcggttcggtacgttacggtacgtacgaacgaacgaacggtaccgacgacgaccgaccgacctaaccgtccttacgttacctcgtactcgtaccgttccgtacctttacgttaacgttacgaaccgtaccgggtaccgggttaccccgtaacccgtacccggtaaccggttacggaccgggtacggaccggtaacgggtaggtaccggtacgggtaacgggtaacctaggttaacccttaccgtaaccttacccgacctacgtaacgtaccgtacgaccgtaccggaccgtacgaccgtaccgtacggaacttcggtacgtaacgggtactttaaacgttaacccttacgttaacccggactaaccgtaacgggttaagtacggtttaaacggttaggtttaccgggtttaacgggttacccgggtaaacgggtaacccggtaaacggaacggtaaacgtaaacggttaacgaaacgtaaacgtaacccggtaacgttaggccggttacggaacctacggtacttaacttcggttacccttccgtaccgttacccgg

SEQ ID NO: 162203 - DNA, 720 bp, Homo sapiens
  misc_feature: GYAE6OF01DEK9V.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatcgaccagtctccctccaccctgtctgctattcgtttaggagacagtacgtacaccatccaccgtcggcccgggactagtacaaagttattacgttaacctcggttacggtccttagggtactacaaggacgtaaaacggaccgaggacaacggaccgaaccccaaagtcccttacctttaactccgtacttacgactcgtaccctacctaagtttcgactacgtacggtccggggtacccctaaccgtaaccggttcgacggtacggccgtaggtacggtacgttacggtacgggaacgaaggtacggttactacccgttaccttaccgacgaaccttcggaacgtcccgacgtccgtaacgcgaaccggtccgtacggaacggttacgtcggtacggtaaccttaaacctttagttaccgtacgaacccgtaattacggtaagtacggtagttttacggtaagttaccgggttaacggttacgacggaaccggtaacaagtaaagaactaaacgaacgtaaatcgtacggagtaccgtcggtaacctacggttccacttacgtccttaaccg

SEQ ID NO: 162204 - DNA, 869 bp, Homo sapiens
  misc_feature: GYAE6OF01ALDN1.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacactccagatcgacccacgttcctcccctccacccgttgtctcgtactaacttcgtttaggaacgacaacgtacgtaccaccgtactcccgtaccgtcggcccggactagtacgtaaagttacttaacgtaaccgttcggttacggtaccgtaggtactacgagaacgtaaacgaccgaaggaccgaacgacccggtaacccctaagtcccttaccttagttccgtacgtacgtacgtcctacccttaacgtactttcggacctacggtaccgggttccgggtacccctaaaccgtaccggttaccgacgggtaccggtacgtagggttacgacgttacgggaacgggtaacctagttacccgttactaccgttacccgtaaccgtaacccgttaacgttacgacgtaccctaccgggttccgtaaccgtacccgaacggttaccggtaggttaaccggttacgtccgggtaacggttaacctttaaacgttaccgtttaaccgaacccgtacgtaaacgtcgtttaacgtaacggtttaacgttacgggttaccgttttaccggggaaacggtttaccccgggaaacggtaaccggttaaaaccggtaaggttaaaccgtaaacggtaaaaacccgttaccgtaaaacggggtttacctaggggttaacccgttccgtaaaccgggttaccctaccggttaacgttcccttagggtttaccctaccccgg

SEQ ID NO: 162205 - DNA, 787 bp, Homo sapiens
  misc_feature: GYAE6OF01A61VP.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgaccaatgtgacatccagatcgacccacgtcctccctccaccctgtctgctattcgttaggagacagacgtccacctatccgaccgtcggcccgggaccaaggtactaaaagttacttaacgtaaccgttcggttcggccgttaggtactcgaacggaacaaaacggaccgaggaccgaacggaccgaacccccgtaaacgtccttacctttactccttacgtacgtacgtcctaccctacttaagtttcgaccgtaccggtacgggttccccgggtaacccctaaccggttaaccgttcgacgggaccggacgtaagggtcgtaacgttcggtacgggaaactggtacccttacgtaccgttccctaaccgtaccgtactaccggaacgcccgtacgtccgtaccggacgtacccgtcgtaacggaacggtgttccggtacggttaaccttaactttacgttaccggtaccgaaactaacgttaacgtagttaacggttaacgtttaacggttacgggtttaccggtaacccgggtaccggtaaacgaacgggttaaaccgaagttaaacgtaaaccgtaaaccggtaacgttaaacggacggtcgtaacggtccaacggtaccctaacggttaccttccgttacgttaccgttacccg

SEQ ID NO: 162206 - DNA, 723 bp, Homo sapiens
  misc_feature: GYAE6OF01CWUTC.3.1.A01.1.454.CMB.1.raw
  modified_base (533)..(533): a, c, t, g, unknown or other
  misc_feature (533)..(533): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
  modified_base (550)..(550): a, c, t, g, unknown or other
  misc_feature (550)..(550): n is a, c, g, or t
  modified_base (560)..(560): a, c, t, g, unknown or other
  misc_feature (560)..(560): n is a, c, g, or t
  modified_base (688)..(688): a, c, t, g, unknown or other
  misc_feature (688)..(688): n is a, c, g, or t
  modified_base (706)..(706): a, c, t, g, unknown or other
  misc_feature (706)..(706): n is a, c, g, or t
tcagagacgcactccacgaccggtgctcgatttagacgtctcatcaggggagactcagtcaggacacagcatggacatggtcgggtccccgctcagcctccgtggggcctcctgctgctcgtcggcctccgaggtcgaccaaatgtacgaccatccaagactaccgaccctacgtccctcccctccctacccgtgtctcgtacctattcggttaaggacgtacgaacgacgtaccaacctactacccgtaccgtccgggcccggtaaccgtaagtaaccgtaaaacgttacgttaacgtaaccggttcggttcggtacgttacggtactacgaacggaaccgaaacgacgaacgggaccgaaccggacccaaccccgtaacgtcccttaccgtttaactccgtacgttacgtccgttaccgtacccgttaactttaacggttccacggttaacggtaccggtacccggtaccctaacggtacctcggacggtcgaacgtagggtacgactcggaacgactagtaactcactcnctaacncaacncgtacncgcgcgtacngtatacgtatgtactacgtactactactcgacaacacgtaattaccgaccgtacggtacgtacggtaccgtacgtaacggacggtaacgtaggtacgacttacgaacggtacgtacggtaggtcccgngtaccgaacctctacgtntaccgtcttacgtaccc

SEQ ID NO: 162207 - DNA, 619 bp, Homo sapiens
  misc_feature: GYAE6OF01A86VH.3.1.A01.1.454.CMB.1.raw
  modified_base (399)..(399): a, c, t, g, unknown or other
  misc_feature (399)..(399): n is a, c, g, or t
  modified_base (424)..(424): a, c, t, g, unknown or other
  misc_feature (424)..(424): n is a, c, g, or t
  modified_base (438)..(438): a, c, t, g, unknown or other
  misc_feature (438)..(438): n is a, c, g, or t
  modified_base (587)..(587): a, c, t, g, unknown or other
  misc_feature (587)..(587): n is a, c, g, or t
tcagagacgcactccacgaccggtgctcgatttagacgtctcatcaggggagactcagtcaggacacagcatggacatgtcgggtccccgctcagctccgtggggctcctgctgctctggctcccaggtgaccaaatgtgacatccagatgacccagtcctccctccaccctgtctgctattcttaggagacagagtaccaccatccaccgtcggccgggcctagtacaaaagttacttaacgtaacgttcggttcggccgttggtactcagtacaaacgaccgaggacacgaccgaccccaaacgtccttaccttactcctcgtgactcgcctactacttcgacacgtacggtccgggtaccccaaccgtacgtcgacggcggctaggtaggtctcgnggactagtacgtcacctctacaccntacacgcacgtccngaccacgccaggacgtgtcgtaggtaccttaagtttactaccacgtaaccgaagtagtagtagtaacgtttagtacgttacggtacggtaccggaacgaaaccgggtacaaggtacgaaagtaaacgtaacgtaaacgacgtcgggtanccgtacgtactacgtactctacgtccttaccg

SEQ ID NO: 162208 - DNA, 691 bp, Homo sapiens
  misc_feature: GYAE6OF01ELNP7.3.1.A01.1.454.CMB.1.raw
  modified_base (186)..(186): a, c, t, g, unknown or other
  misc_feature (186)..(186): n is a, c, g, or t
tcagagacgcactccacgaccggtgctcgatttagacgtctcatcagggggagactcagtcaggacacagcatggacatgtgggtccccgctcagctcctggggctcctgctgctctggctcccaggtgccaaatgtgacatccagatgacccagtctccctccaccctgtctgcatctttagganacagagtcaccatcacctgccgggccagtacaaagtattagtaactcgttggcctggtatcagcaaagccaggcagacgaccccaaagtcctaccttatctctgatcgacctctaatttcgactacgtacggttcggggtaccccaaccgtaaccgttccgacggccggactaggtacggaacgtcggtaggggaactaggtacgtttcccaaccgttcctaccctaaccacttaccgacggtactacggtccgtcgaccaccggtccgtacggtaacgacttgggtacggtacctaaacttttacgttaaccgtacgaacctaaacgtaggttactaggttaatttagggtttaacgtttcgggtaacccggtttaccgggacccgttaaacggggaacctaaaggtaaacgtaaaacggtaaactaaaccgtaaaacggtacggttgggtacggtaccgttaacggacccttaaccgtagtttacccttcgtttcgttaaccc

SEQ ID NO: 162209 - DNA, 740 bp, Homo sapiens
  misc_feature: GYAE6OF01C6KBJ.3.1.A01.1.454.CMB.1.raw
  modified_base (675)..(675): a, c, t, g, unknown or other
  misc_feature (675)..(675): n is a, c, g, or t
tcagagacgcactccacgaccggtgctcgatttagacgtctcatcgaggggagactcagtcaggacacagcatggacatgtcgggtcccgctcagctccgtggggctcctgctgctctgctccagtcgacaatgtgacactcagatcgaccctagtcctccctacctacctcgtctcgtctattacgttaggacgacagacgtaccacctactacctaccgtccgggcccgggacctagttaacgtaaacgttagttaacgttaacgttcggtcggtaccgtaggttactaccgaagaacgaaaacgaccgaaggaccgaacgaccgaacccgtaaacgttccttaccgttacttcgtactacggtacttccggtaccttactacgtttgaacctacggtacccgggttaccgaaccccgtaacgttaccggactacgggtcgtacggtacggtaggtacgtacggtaacgggacgtacgttaaccttccctaacgttactacccgaataacccgtcggaaccgtacgtacctaccggtagaacccgtacggtacgtaacggcgttacggtaccgtactaacgttaaccttaacgttaccgtacgtaacgtaacgtacgtacttaggttacttacgttagttccgggtacggttacggaccggaacgtaacgaanaaacgtaagaaactaacgtaacgtacggtagcggtcacgtactaactcgttactcgttacctacg

SEQ ID NO: 162210 - DNA, 683 bp, Homo sapiens
  misc_feature: GYAE6OF01BP4IU.3.1.A01.1.454.CMB.1.raw
  modified_base (189)..(189): a, c, t, g, unknown or other
  misc_feature (189)..(189): n is a, c, g, or t
  modified_base (632)..(632): a, c, t, g, unknown or other
  misc_feature (632)..(632): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgcaaatgtgacatccagatcgacccagtcctccctccaccctgtctgctattcgtttagganacagagtccaacatccaccgtcggcccgggccagtactaaagttattaagtacgttcggttggccttaggtactcgaagacaaacgaccgaggacaacggaccgacccccaaagtccttaccttactcctacgtcgactcgtacccttacctaatttcgacctacgacgggttccgggtaccccaaccgtacgttcacgggtcgcgtaggtggtactcggtagggactaggtacgtttcccacttacctaccgaccctataccgacgtccgaccgtccgtcgccgtacgccgtacggacgtaggttcggtacgtaaccttaacgtttacgtacctcgaacctaacgtaggtactaggttagtttaggttagtttaccggtaccggttaccggaaccggtaaacggtaactaaacgaaagtaacgtaaaactaccggtaaaacnggttacggtacggcgtaaccgctaaccgttacttcgtttactcgttacccg

SEQ ID NO: 162211 - DNA, 858 bp, Homo sapiens
  misc_feature: GYAE6OF01BYDER.3.1.A01.1.454.CMB.1.raw
tcagagacgcactccacgaccggtgctcgatttagacgtctcatcagggggagactcagtcaggacacagcatggacatgtgggtccccgctcagctcctggggctcctgctgctctggctcccaggtgcaatgtgacatccagatcgaccagtcctccctccaccctgtctgctattcgtttaggacgacgagtacgtaccaaccgtataccgacccgtcggacccgggacctaacggtaactaaagttaacttaggttaaccgtcggttcgccgttaggtatacgacgacgaaacgaccgaggacctaacgaacggaacccaaacgtccttaccgttactaccgtacgtggtaacgttcccgtaccgttaccgttaagtttccggaaccgttaaccgtaacgggggttacccgggttaacccctaaacccggtaaaccggtttaccggaaacggtcccgggtaactaacggggtacggtacgttacgggtacgggaacgtacggttacgtacgacccttaccgactaaccgtactacaacggtaccgagtccgtagaccgtaccgtaccgcggtaacggtaagttcggggtaactaacccgtttaaacgtttaacgttaacccggtaggaaacccgtaacttaaacggtcggttaagtttaaccgttaacggttttaaccggtttaacgggggtaaccctttaccggggggaacgttaaaaccccggggacgttaaaaaggtcccgttaaaaaagtaaccggtaaaacggtaaaacccgttccgggaacggttaccgttcgggtaacccacccgggttaaacccactttacccggttgttaccccgtttaaacccg

SEQ ID NO: 162212 - DNA, 670 bp, Homo sapiens
  misc_feature: GYAE6OF01CXVXP.3.1.A01.1.454.CMB.1.raw
  modified_base (277)..(277): a, c, t, g, unknown or other
  misc_feature (277)..(277): n is a, c, g, or t
tcagagacgcactccacgaccggtgctcgatttagacgtctcatcaggggagactcagtcaggacacagcatggacatgtgggtccccgctcagctcctggggctcctgctgctctggctccccaggtgaccaaatgtgacatccagatcgacccagtccctccctccaccctgtctgactagttccgttaggagacagacgtaccaccatccaccgtcggcccggtaccagtactaagtagttagtactgtcgtcgtgtactcgagacgaagccgnggacacgaccgaccccgaagtcctccttatctaccgtgactcgtccctataacgtttcgacacggtcgggtaccgggtacccctaaccgtaccgttacgacggtcgacgtaggtgtactacggttaggaacgtagttacgtacccgtacttcctaccgtaccacgttaccacgtaccgaccgtcccgtagacccggtacgtaccggtacggtacgtacggtacggtacgtaaccgttacgtttaactccgtaccgtacgtaacgtagttaatagtaagtttagttacggttacggtacggtacggtacggaacggtacgtaagaaaccgtagtaaacgtaacgtaagtacgttcgacgtcgacgtactacgtaacttcgtacttcgttacccg

SEQ ID NO: 162213 - DNA, 707 bp, Homo sapiens
  misc_feature: GYAE6OF01BJHB8.3.1.A01.1.454.CMB.1.raw
  modified_base (186)..(186): a, c, t, g, unknown or other
  misc_feature (186)..(186): n is a, c, g, or t
  modified_base (202)..(202): a, c, t, g, unknown or other
  misc_feature (202)..(202): n is a, c, g, or t
  modified_base (474)..(474): a, c, t, g, unknown or other
  misc_feature (474)..(474): n is a, c, g, or t
  modified_base (491)..(491): a, c, t, g, unknown or other
  misc_feature (491)..(491): n is a, c, g, or t
  modified_base (660)..(660): a, c, t, g, unknown or other
  misc_feature (660)..(660): n is a, c, g, or t
tcagagacgcactccacgaccggtgctcgatttagacgtctcatcaggggagacctcagtcaggacacagcatggacatgtcgggtccccgctcagctcctggggctcctgctgctctggcctcccgaggtcgaccaaatgtgacactccagtatcgaccctagtcctacccgtcccaccctgtcncgctattcgttagganacgagacgtccactactccaccgtcggcccggacctagtacctaaagttattaacggtacgttcggttacgtcgtggtacacggaacgtaaccgaaacggccgaggacaaccggacccggtaaccctaaacttccctttaccttacttccgtacgttacgaccgttccgtacccttaactaaggtttccgacgttacgggtcccgggtccggtacccctaacgtacgttcgacggcgtcgtaggcgtacgtcggacggatacgtcgttaccnccgttactccaacttanacgacgccgtacgccgttacgacggtaccgtaccgtaggaccgttacgtcggtaccgttaactacgtttacgttaccacgtaacctacgtagttacgtacgttaagtttacggttacggttacggtaccgtacggggactaaccgggaatacgaagtaacctaacgtanaaccggtaggtcgacgtacacgtactactccttcgttcgcttacccg

SEQ ID NO: 162214 - DNA, 947 bp, Homo sapiens
  misc_feature: GYAE6OF01ARZ2Z.3.1.A01.1.454.CMB.1.raw
  modified_base (196)..(196): a, c, t, g, unknown or other
  misc_feature (196)..(196): n is a, c, g, or t
tcagagacgcactccacgaccggtgctcgatttagacgtctcatcagggggagactcagtcaggacacagcatggacatgtgggtccccgctcagctccgtggggctcctgctgctctggctcccaggtgccagatgtcgaccacccagatcgacccagtcctaccactcctccctgtctgcatcgtaggtggganacgagtagtcatcactcttcgttcggaccgggacaagtcgagtaggttagtttaacgtttaatttttacgtttaaagttggttaattacgtaagttaacgtaaaaccggaacggggaaacctcccctaaaggtcctttaccgtacgtaacgttcctaacgttcgaccgttcgaccgtaccgtttaacggttaacgttttaaaccgggaaaacgggtttccggggttaccccaaaggtttaccgtaaaggggtttccaaaggggttcggtaccggttaaggttacgggggtaacctttcgggtaaccgggggtaacgttaagtaccgttttaccgtaccccgttacctaacccgtaaccgtacgttaaccgtaacggtttaaacgttacccctttaaaccgtaaaccgtttaacggtaaacgggttttaaccttttaacgggtaaaaccctttaaccgtttaaacccgtttaacgggtaaccttaaaccgtaaaccggttaacgttaaccgttaacccggtaccccgtttacccccgtacccgttaccccggtttaccgttaaacccgggtttaccggtacccgggggaaacgggttaacccgggtaaaccgggtaagggtaaaccggtaaaccgttaaaccggtaaacccgggtaacggtttacggggtaacgggttcccgtaacccgggttaacgtaccgtaaaccgttcccggttaacggttttaccctaacggttccccgttaacccg

SEQ ID NO: 162215 - DNA, 757 bp, Homo sapiens
  misc_feature: GYAE6OF01A24M8.3.1.A01.1.454.CMB.1.raw
  modified_base (172)..(172): a, c, t, g, unknown or other
  misc_feature (172)..(172): n is a, c, g, or t
  modified_base (560)..(560): a, c, t, g, unknown or other
  misc_feature (560)..(560): n is a, c, g, or t
tcagagacgcactccacgaccggtgctcgatttagacgtctcatcaggggagactcagtcaggacacagcatggacatgtcgggtccccgctcagctccgtggggcctcctgctcgctcgtcggcctccccgagggtcgacctaaagtgtgacactccgaggactcgacccncgtccctcccctccctaccctgtctgctattcgtttaggagaaccgaggtacgtaccaccgtactacccgaccgtccgggacccgggacctaagttaacgaaaagtttacgttaacgttaacgttccggtttcggtaccgttacggttacaccggaacgaaaccgaaaaccggaaccggacggaccgaacggaacccgaacccccgtaaacgtcccttacctttacgtcctcgtacgtacgtccgtacccttaccgttacgttacggacctaacgggtcgggttacccgggtacccctaaccgtacgtaccggcggacggacgtaggtacgtacgttcgacgggacgtagtaccttccaccgtctaccaactacgtaccgacgtaccncgcctcgcctacgtccgtacgacgtggtcgtacggttaactacgtttacgtaccgtacgtaacgaagtcgttactaagtagtttaggttacgttaccgggttaccggtacggacgtaacggaactaaaggtaaagtaacgaaacgtaccgtaagtacggtcggacgtcctacgactaccgttatcttcgtactcccg

SEQ ID NO: 162216 - DNA, 891 bp, Homo sapiens
  misc_feature: GYAE6OF01B4HJ2.3.1.A01.1.454.CMB.1.raw
tcagagacgcactccacgaccggtgctcgatttagacgtctcatcaggggagactcagtcaggacacagcatggacatgtcgggtccccgctcagcctccgtggggctcctgctgctctcggcctccgaggtcgacctaaagtggtacaactacgtcccgaagtacgtaccgaaccccgtacgttccccttccccctaccctacccttggtaccgtcgtacctaacgtttaccggttaagggaacggactaacggtacgtaacccaacgtacctacccgtacccggtccgggaccccgggtaaccttaacggttaaacgtaaaacgtttaacgtttaacggttaaccgttcgggttacggtccggttaaggtacttacgaacggaacaaacggtaaccagggaccgaacggtaacccgaaccccgtaaacgttcccttacttacgtcgttaacgtggtacctcgtacccttaactagtttacgacgtacggtacggtcccggttaacccgtaaaccgtacgtttaccggacggtacggtacgtaacgggttacggaacgtacggggtaacgtacggtaacgttaccgtactaccgtacctaaaccgacgtaaccgttacgcgtaaccgtacgtccgtcaacggtacggtacccgtaggtaacgtcgtacggtacgtaacgttaacctttacggtaacctacgtaacgtaaacgtaggttaacgttagtaacggtttacggttaacgtccgggttaacggtaccggaaccgtaaacggaacgtaaaggtaaccgtaaagaaacccggttaacggtaaacggtaacggtttaacggccgaacccgttacgtacccttaagtaccgtttaccgtacgtttcccggttaaccccg

SEQ ID NO: 162217 - DNA, 481 bp, Homo sapiens
  misc_feature: GYAE6OF02I4Z3H.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactgtgctgcaccatctgtcttac

SEQ ID NO: 162218 - DNA, 482 bp, Homo sapiens
  misc_feature: GYAE6OF02ICS9I.3.1.A01.1.454.CMB.1.raw
  modified_base (333)..(333): a, c, t, g, unknown or other
  misc_feature (333)..(333): n is a, c, g, or t
  modified_base (403)..(403): a, c, t, g, unknown or other
  misc_feature (403)..(403): n is a, c, g, or t
  modified_base (478)..(478): a, c, t, g, unknown or other
  misc_feature (478)..(478): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccatttgcacagtgggtcccacaacgttcagcgcagtggatcngggacagagttcactctcacatcagcagcctgcagcctgacgatgtggactaacttattactgaccaacngtaatgatagttattggacgtttcggacaagggaccaagatagaatcaaagtactggtagctagcacatctcgtnttac

SEQ ID NO: 162219 - DNA, 494 bp, Homo sapiens
  misc_feature: GYAE6OF02F7UCM.3.1.A01.1.454.CMB.1.raw
  modified_base (394)..(394): a, c, t, g, unknown or other
  misc_feature (394)..(394): n is a, c, g, or t
  modified_base (402)..(402): a, c, t, g, unknown or other
  misc_feature (402)..(402): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtgggtccccacaacgttcagcgcagtgatctgggacagagtcactctcaccatcagcagcctgcagcctgacgatgtgctaacttattacncgaccaanagtatgtattagttattgggacgttcggactaaagggaccaagataagaagtacaaacgtaactgtagctcgactaccatcgtacgtcttac

SEQ ID NO: 162220 - DNA, 563 bp, Homo sapiens
  misc_feature: GYAE6OF02JK537.3.1.A01.1.454.CMB.1.raw
  modified_base (220)..(220): a, c, t, g, unknown or other
  misc_feature (220)..(220): n is a, c, g, or t
tcagagacgcactccacgaccggtgctcgatttagacgtctcatcaggggagactcagtcaggacacagcatggacatgtgggtcccgctcagctcctggggctcctgctgctctggctcccaggtgccaaatgtgacatccagatgacccagtctccctccaccctgtctgcatctttaggagacagagtcaccatcacctgccgggccagtcaaagtnttagtactgttggcctggtatcagcaaagaccaggcagagccccaaagctccttatctctgatgtcctcctaatttcgactacagtcggggtacccaccgtaaaccgttcaacggcggcgacgttggactcgtgggaactaggacgttcaccgtctcgacctactacgacgcacgcctgcagcctagacgatgtggactaacgtttataccgttgacccaaacgtagtaatcgtaagttagtttaagttcggtacgtttcggaccctaaaggggacctaagtagttaagaactaacgaacgtaacgtcgtagggtctaaggccacgtactcttcgttactacc

SEQ ID NO: 162221 - DNA, 741 bp, Homo sapiens
  misc_feature: GYAE6OF02JIRQZ.3.1.A01.1.454.CMB.1.raw
  modified_base (259)..(259): a, c, t, g, unknown or other
  misc_feature (259)..(259): n is a, c, g, or t
  modified_base (286)..(286): a, c, t, g, unknown or other
  misc_feature (286)..(286): n is a, c, g, or t
tcagagacgcactccacgaccggtgctcgatttagacgtctcatcaggggagactcagtcaggacacagcatggacatgtgggtcccgctcagctcctgggctcctgctgctctggctcccaggtgccaaatgtgacatccagatgacccagtctccctccacctgtctgcatctttaggagacagagtcaccatcacctgccgggccagtacaaagtattagaactcgttggcctggtatcagcaaagaccagcagancccaaagctccttactctctcgaatcnccgtaccaaatttcgacaacgtagttggggtacccccgtaacaacggttccaagtcggccaaggttggaacgtcgttggggaaccaggtaagttccacgttcctacaaccctaagttcaacggtccaaggcccgtttacgccgaagccgtttaccggaacggtaacgttacgggtcgggtaccctaaaaccgttttaaccttaaccgtttagacccgtaaacccgtaaaggtttaacgtttaagtacggtttaaaaccggttttttaaggttccggggttaaaccggggttttacccggttaccgaaaaaacgggggttaccccggaaaagttaccggttaaaaggaaaacctttaaccgtaaaaacggtaaacggttaacggttaaccggggtacgtttaacccgggcttaaaccccgacgggttttaacctttggttaacccgttttaaccgg

SEQ ID NO: 162222 - DNA, 483 bp, Homo sapiens
  misc_feature: GYAE6OF02HAWDZ.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagctgacgatgtggcaacttattactgccaacagtactgatagtattgacgttggaccaagggaccaagatagaatcgaaacgaactgtagctagacaccatctgtcttacg

SEQ ID NO: 162223 - DNA, 486 bp, Homo sapiens
  misc_feature: GYAE6OF02I68E8.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaactttattactgaccaacagtatgatagttattggacgttcggcctaagggaccagatagaaactcaaacgactgtagctacgcaccatctgtcttac

SEQ ID NO: 162224 - DNA, 502 bp, Homo sapiens
  misc_feature: GYAE6OF02GM1ZW.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtgggtcccaccaacgttcagcggcagtggatctgggacagagttcactctcaccatcagcagcctgcagcctgacgatgtggacaactttattactgccaacagtatgtatagttagttgggacgtttcggaccgaaagggaccaagtataagaaagtcgaaaacgtaacgtgtcggactgcacctatcttgtccttac

SEQ ID NO: 162225 - DNA, 568 bp, Homo sapiens
  misc_feature: GYAE6OF02JL0L0.3.1.A01.1.454.CMB.1.raw
  modified_base (221)..(221): a, c, t, g, unknown or other
  misc_feature (221)..(221): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtnttagtaactcgttggcctggtatcagcaaagacaggcagagccccaaagctccttatcctctgactcgcctacctaatttcgcacgaggtcgggtacccaccaacgttcagcgcagtgatcgtgggacagtagtcactctcactactcacgcacgcctgcacgctgacgactggtcgactaactttacttactacgtaccaaacgtagtatgtaacttagttagttcggtacgtttaccgggacgaaacgggacctaaaggacttaaacggaaacgtaaccgtaaaacggtacgttacggtaacggtaccgtacgacgaacctaagttctttacggttactttaccg

SEQ ID NO: 162226 - DNA, 549 bp, Homo sapiens
  misc_feature: GYAE6OF02JP457.3.1.A01.1.454.CMB.1.raw
  modified_base (131)..(131): a, c, t, g, unknown or other
  misc_feature (131)..(131): n is a, c, g, or t
  modified_base (189)..(189): a, c, t, g, unknown or other
  misc_feature (189)..(189): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
  modified_base (512)..(512): a, c, t, g, unknown or other
  misc_feature (512)..(512): n is a, c, g, or t
tcagagacgcactccacgaccggtgctcgatttagacgtctcatcaggggagactcagtcagggacacagcgactggacatgtgggtccccggctcagctcctggggctcctgctgctctggctccaggtnccaaatgtgaccatccagatcgacccagtcctccctccacctgtctgcatcttagganacagagtcaccatcacctgccgggcagtacaaagtattagtaactcgttggcctaggtatacagacaaacgaccaggcagacgccccaaagctaccttatcctactgactcgcctacctaatttcgactacgtaggtcgggtccccaacgtaacgttcgacggcggacgaggtggacttcgtaggacagtacgttccactctacacctatcagcagcctgacacgctgactatgcgactaacttntacnacctaatagtatagactagttagttggaccgttcggaaccaaagggtaccagtacgtaagaactacgaaacgtntggtacgtactacgactacctatcgttcgtacttacg

SEQ ID NO: 162227 - DNA, 488 bp, Homo sapiens
  misc_feature: GYAE6OF02FGMMC.3.1.A01.1.454.CMB.1.raw
  modified_base (221)..(221): a, c, t, g, unknown or other
  misc_feature (221)..(221): n is a, c, g, or t
  modified_base (402)..(402): a, c, t, g, unknown or other
  misc_feature (402)..(402): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtnttagtaactcgttgcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttatactgccaanagtatgatagttattggacgttcggaccaagggacccaaagtataagaaatacgaaacgaactgtagctgcacccatctgtcttac

SEQ ID NO: 162228 - DNA, 531 bp, Homo sapiens
  misc_feature: GYAE6OF02I3VTK.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagacgccccaaagctccttatctctgatgcctcaatttgcacagtcgggtcccacctaacgttcacgcggcagtggatcgtgggacagtagttcactctcaccatcagcagcctgcagcctgacgatgtggactaacttattactcgaccaaactagtatagtaattagtttagttcgggtacgttcggaccgtaaagggaccaaggtataagaaactacgaaaacgaacgtggtacggtctacgacctaaccagtccttaggtccttaccg

SEQ ID NO: 162229 - DNA, 634 bp, Homo sapiens
  misc_feature: GYAE6OF02I83IA.3.1.A01.1.454.CMB.1.raw
  modified_base (226)..(226): a, c, t, g, unknown or other
  misc_feature (226)..(226): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtcgccaaatgtgacatccagatcgacccagtcctccctccacctgtctgcattcttaggagacagagtacaccatccacctcgccgggcagtacaaagtnttagtaactcgttgcctggtatcagacaaagaccaggcagacgacccaaagccttccttactctactgactcgtacccttacctaatttcgactacgtacggttaccggggtacccaaccgtaacgttcgaacgcggacgacggtcggtatcggtagggacaggtacgttcacctctaccactatcgacgacacgtctcgcgacgttccgaggacgtatcggtagaaccttaacgttagtttaccgacaacccgaacgtaagttataggttactttaaggttacgtttacgggtacggtttacccggaacggtaaacggggtaccaaagtagtaaagtaaactacgaaaacgtaacgttggtaaccggcgttaccgacgtaacctattaccgttacggttacttaccg

SEQ ID NO: 162230 - DNA, 507 bp, Homo sapiens
  misc_feature: GYAE6OF02GS6CV.3.1.A01.1.454.CMB.1.raw
  modified_base (401)..(401): a, c, t, g, unknown or other
  misc_feature (401)..(401): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcacatcacctgccggccagtcaaagtattagtaactcgttggcctggtatcagcaaagaccaggcagagccccaaagctcctatctctgatgcctccaatttgcacagtgggtcccaccaacgttcagcggcagtggatcgtgggacagagttcactctcacatcagcagctgcagcctgacgatgtgctaacttattactgaccaaanagtatagtattagttagttggacgttcggacctaaagggaccaagtatagaaactcaaacggtaactaggtacggactaggacctaaccagttacctgttcttacc

SEQ ID NO: 162231 - DNA, 531 bp, Homo sapiens
  misc_feature: GYAE6OF02IKA0I.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaaagaccaggcagagccccaaagctccttatctctgatgcctcaatttgcacagtgggtcccacaacgttcagcggcagtggatctgggacagagttcactctcaccatcagcagcctgcagcctgacgatgtggctaactttattactcgaccaacagtatagtattagttattgggaccgtttcggaccctaaaggggaccaaaggtactaaggaaactcgaaaaccgtaacgttaggtaggtaccttaggacctacccgattccgtggttaccttaccg

SEQ ID NO: 162232 - DNA, 502 bp, Homo sapiens
  misc_feature: GYAE6OF02I4J1V.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtcctccctccaccctgtctgcatctttaggagacagagtcaccatcacctgccggccagtcaaagtattagtaactcgttggcctggtatcagcaaagaccaggcagagccccaaagctccttatctctgatgcctccaatttgcacagtcggggtcccaccaacgttcagcggcagtggatcgtgggacagagttcactctcaccatcagcagcctgcagcctagaccgtatggtcgactaactttattacctcgaccaacagtatgattagttattggacgttcggaccaaagggaccaagataagaaagtcaaacgactagtaggctgacacctatctgtcttac

SEQ ID NO: 162233 - DNA, 642 bp, Homo sapiens
  misc_feature: GYAE6OF02JWV6Q.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtacaaagtattagtaactcgttaggcctggtatcagacaaagaccaggcagacgaccccaagctcctatctctgatcgcctccaatttgacacaggtcgggtcccaccgacgttcagcggcagtggacgtcgtaggactagagttcactctacgaccatcgaagccaacgtccgtcgactaccggccgttacggacgtacgttcggtacggtacctaaaccgtttatttaccgtacgtaaccctaaacgtaacgttacgttaagtacgtttaaggtttaacgttacgggttaaccgggtttaccgggaaccggtaaaccggggaacctaaacggagttaacgtaaaacgtccggtaaaaaccgtacggttaacggtacgtacgtacgtacccgaaccgttaccgttacgttaccgttcccgtttaaccg

SEQ ID NO: 162234 - DNA, 503 bp, Homo sapiens
  misc_feature: GYAE6OF02H9R3S.3.1.A01.1.454.CMB.1.raw
  modified_base (304)..(304): a, c, t, g, unknown or other
  misc_feature (304)..(304): n is a, c, g, or t
  modified_base (332)..(332): a, c, t, g, unknown or other
  misc_feature (332)..(332): n is a, c, g, or t
  modified_base (492)..(492): a, c, t, g, unknown or other
  misc_feature (492)..(492): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagacaaagaccaggcagacgaccccaaagcctccttatctctgatgcctcatttgcacngtcgggtcccacacgttcagcgcagtgntcgtgggacagagttcactctacaccactcagcagcctgcacgcagacgagtggtgctaatttacttactcgaccaatagtatagtattagtttattagggtaccgttcggaccaaagggaccaagataagaatacgaaacgactagtgcgtagccactntcttgtcttac

SEQ ID NO: 162235 - DNA, 491 bp, Homo sapiens
  misc_feature: GYAE6OF02IXAS5.3.1.A01.1.454.CMB.1.raw
  modified_base (184)..(184): a, c, t, g, unknown or other
  misc_feature (184)..(184): n is a, c, g, or t
  modified_base (487)..(487): a, c, t, g, unknown or other
  misc_feature (487)..(487): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggngacagagtcaccatcacctgtcgggccagtcaaagtattagtaactcgttggcctggtatcagcaaagaccaggcagagccccaaagctccttatctctgatgcctccaatttgcacagtgggtcccacaacgttcagcgcagtgatcgtggacagagttcactctcaccatcagcagcctgcagcctgaccgtatgtggctaacttattactcgaccaactagtatgatagttattggacgttcggcaaagggccaagatagaaatcaaacgtatgtaggactggaccacgtatcttacgtnttcc

SEQ ID NO: 162236 - DNA, 611 bp, Homo sapiens
  misc_feature: GYAE6OF02HYTDM.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccggccagtcaaagtattagtaactcgttggcctggtatcagacaaagaccaggcagagccccaaagctccttatctctgatgcctccaatttgcacagtcgggtcccacaacgttcagcgcagtggatcgtagggacagacgttcactctcaccatacagcagccctgccagcctaggacgagttggtacggtacctaaactttacttaaccgtcgaaccctaaactagttaaacgtggtaaagtttaagttttaacgtttacggggtaaccggttttaccgggaacccgtaaaacgggggaaccctaaaggtaattaacggaaaattaaccgaaaaccgttaacgtacggttacggtaccgttacgggaccctaacccgtaacgttccttgttaccctttaaccg

SEQ ID NO: 162237 - DNA, 561 bp, Homo sapiens
  misc_feature: GYAE6OF02JCHST.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtgggtcccacaacgttcagcggcagtggatcgtggacagagtcactctcaccatcagcagcctgcagtcctagactgtattttgactaactttattactgacctaactagttaactaaacgtacccgacggttacgtaccggtttaccggaccgtaaacggggaaccaaacggggtaggacgtaagtaccgaacgttaaccggaacgttggttacggtacgttacggacctaccgtacttaccgttcgttccttaccg

SEQ ID NO: 162238 - DNA, 500 bp, Homo sapiens
  misc_feature: GYAE6OF02H88MK.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtgggtcccaccaacgttcagcggcagtggatcgtgggacagagttcactctcaccatcagcagcctgcagcctgacgatggtggctaacttattactgaccaaacagtaatagattagttagttggaccgtttcggaccaaagggaccaagactaagaaatcaaacgaactgtagactgacaccatcttcgtcttac

SEQ ID NO: 162239 - DNA, 481 bp, Homo sapiens
  misc_feature: GYAE6OF02GRIT4.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtgggtcccacaacgttcagcggcagtggatcgtgggacagagttcactctcaccatcagcagcctgcagcctgacgatgtcggctaacttattactgaccaagtagtatgattagttatggacgttcggacgaaggaccaagatagaactcaaacgactgagctgcacatctgtcttc

SEQ ID NO: 162240 - DNA, 498 bp, Homo sapiens
  misc_feature: GYAE6OF02HS7XA.3.1.A01.1.454.CMB.1.raw
  modified_base (368)..(368): a, c, t, g, unknown or other
  misc_feature (368)..(368): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggcagtcaaagtattagtaactcgttggcctggtatcagcaaagaccaggcagagccccaaagctccttatctctgatgcctccaatttgcacagtcgggtcccacaacgttcagcggcagtggatcgtgggacagagttcactctcacatcagcagcctncagcctgaccgatgtgactaacttattactgaccaacagtactgatagttattggacgtttcggacaagggaccaagtataagaatacaaacgtactggtaggctacgacacctagtctcgttcttaccg

SEQ ID NO: 162241 - DNA, 719 bp, Homo sapiens
  misc_feature: GYAE6OF02HB6Q9.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatcgacccagtcctccctccaccctgtctgcattctttaggagacagagtcaccatcacctgccgggccagtacaaagtattagtaactcgttgcctggtatcagacaaagaccgaggcagacgaccccaaagcctacttatctctgactcgtcctacctaatttcgactaacgtacggttccggggtacccctaaccgtaaaccggtttcgaacggcccggacgtaagggttacgggtaacgttccggtaggggaacctaacggttacgtttacctaaccttccgttacccaaccgtaacttaccggacgacccgtaaccggtcccgttacggacccgtaacggcccgttagggaaccgtaagttcggtacggtacttaaacgtttacttaccgtacgtaacccaaagtagttaagtagttaagtttagtttaggttacgggtaaccggtttaccgggaaccgaaacggggtaaccaaaggtaactaaggtaaacgtaacgtaaaaccggtacgttacggtacgggacttacggaccgtaaccgttactaccgtttacggttacctttacccg

SEQ ID NO: 162242 - DNA, 735 bp, Homo sapiens
  misc_feature: GYAE6OF02HEETC.3.1.A01.1.454.CMB.1.raw
  modified_base (223)..(223): a, c, t, g, unknown or other
  misc_feature (223)..(223): n is a, c, g, or t
tcagagacgcactccacgaccggtgctcgatttagacgtctcatcgaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccgatcacctgccgggccagtcaaagtnttagtaactcgttaggcctggtatcagacaaagaccaggcagacgaccccaaagcctaccgttatcctcgtagattcggacccttaccaaattttgacacgtaggttcggggtacccctaaccgtaacggttcacggtcggactacggtagggaacttacgtaggggaactaaggtacgtttaccaaccgttactaccgaacctaattaccgaacggtcctaacggtcccttaggaccgtaacggtcccttaaggaaccggtaagtcggttaacgggacttaaaccgttttagttaccgtacgtaccctaaaacgttacgttaacgttacgtaagtttaaggttttaaggttacgggtaaccgggttttaccgggaaacccgtaaaacgggggtaaccctaaaagggtaacgttaaacggtaaaacttaaccggaaaaaccggttaacggttacgggtacggttaccgtacggtaaccaaccgttacgttccgttacggttcctttaacccg

SEQ ID NO: 162243 - DNA, 552 bp, Homo sapiens
  misc_feature: GYAE6OF02F4BKN.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagcctccttatctctgatcgcctccaatttgcacagtcgggtacccaccaacgttcagcggcagtggatcgtgggacagagttcactctcaccatcagcagcctgcgacgtcctagacgtatggtggtactaaactttacttactcgaccctaaactaacgttatagtattagtttagttacgggtacgttacgggaccgaaaggggaccaaggtataagtaaacgtaacgaaacgtaacgtagtacggtacgtacgaccaacctagttccttcgttcttacc

SEQ ID NO: 162244 - DNA, 485 bp, Homo sapiens
  misc_feature: GYAE6OF02HTYVT.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagccaggcagagccccaaagctccttatctctgatgcctccaatttgcacagtgggtcccacaacgttcagcgcagtggatcgtgggacagagttcactctcaccatcagcagcctgcagcctgacatgtggactaacttattacctgaccaacgtagtatgattagttagttggacgtttcggacaaagggaccaagatagaaatcaaacgtagtgtcgctgcacatctgtctc

SEQ ID NO: 162245 - DNA, 659 bp, Homo sapiens
  misc_feature: GYAE6OF02JXITP.3.1.A01.1.454.CMB.1.raw
  modified_base (187)..(187): a, c, t, g, unknown or other
  misc_feature (187)..(187): n is a, c, g, or t
  modified_base (192)..(192): a, c, t, g, unknown or other
  misc_feature (192)..(192): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtcctgcattctttagganacagngtcaccatcacctgccgggcagtcaaagtattagtaactcgttggaccttggtatcagacaaagaccgaggcagacgaccccaaagctaccttagtactctgactcgacctccaattttcgactaactaggtacggggtcccctaaccgaaccgttacgacggacggccgaaggtcggtatacgtgggaacgtagtacggtttaccacgttccttccgaacctacttacacggacctaacgcccgttacgacgacccgtcgacggtacgtagtacggtcgtaaccttaacgttaacgttaccgtacgaacccttaagtaacttaggtaacttagttaagtttaggtaccggtttaccgggtaccggaacggtaacggtaaccaaggttacgtaagtaaccgtaacggtaaactaggtaacttcgggactaccggttacaaccgtaccgtacgtacgtacggtttacc

SEQ ID NO: 162246 - DNA, 540 bp, Homo sapiens
  misc_feature: GYAE6OF02GU8TO.3.1.A01.1.454.CMB.1.raw
  modified_base (406)..(406): a, c, t, g, unknown or other
  misc_feature (406)..(406): n is a, c, g, or t
tcagagacgcactccacgaccggtgctcgatttagacgtctcatcaggggagactcagtcaggacacagcatggacatgtgggtccccgctcaactcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagacgccccaaagctctatctctgatgcctcaatttgcacagtcgggtcccacacgttcagtcggcagtggatcgtagggacaggagttcactctcaccatacagccagcctgacacgcctagacgatcgcggactaacttattacncgacctaaagagtatacgtaattagtttagtcgggtacgttcggaacccgaaggaaccaagtataagtaaactcgaaaacgtaactggtacggcttacggaccctaaccgtacttcgttcgtacttactaaccg

SEQ ID NO: 162247 - DNA, 526 bp, Homo sapiens
  misc_feature: GYAE6OF02GJ4DI.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagacgccccaaagctccttatctctgatcgcctccaatttgcacaggtcggggtcccaccaacgttcacggcggcagtggatcgtgggacagagttcactctcaccatcagcagcctgcagcctagaccgatggtggactaacttattactgaccaacagtactagtattagttattagggtaccgtttcggaccgaagggaccaagtacgtaagaaagtaccgtaaacgacgtaggtagctacgctaaccgactcttagtcttacg

SEQ ID NO: 162248 - DNA, 591 bp, Homo sapiens
  misc_feature: GYAE6OF02GDGYW.3.1.A01.1.454.CMB.1.raw
tcagagacgcactccacgaccggtgctcgatttagacgtctcatcaggggaggacgtcagtcaggacacagcatggacatgtgggtccccgctcagctcctggggctcctgctgctctggctcccaggtgccaaagtgtgacatccagatgacccagtctccctccaccctgtctgcatctttaggagacagagtcaccatcacctgccgggccagtcaaagtattagtaactcgttggcctggtatcagcaaaagaccaggcagacgccccaaagctccttaatctctgatcgcctccgaatttcgcacagtcggggtccccaactaacgttcaagcggcaggtggatcgtagggacagtagttcactctcaccatcagcagcctagcagccgtgacgtatcggtaggtactaactttattacacggtcctaaacgtagttaattacgtaagttagttttaacgttacgggttaaccggttaccggaccgaaacgggtaacccaagtaacgttaacggaaactaccgaaaaacgtaacgttaggttacggtactacggacccgacctaattccgttacgttcctttaccg

SEQ ID NO: 162249 - DNA, 608 bp, Homo sapiens
  misc_feature: GYAE6OF02GNTO1.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtacaaagtattagtaactcgttggcctggtatcagacaaagaccaggcagacgaccccaaagcctccttatctctgatcgcctacaatttgcagaggtcgggacccaccgtaacgttcacggcggcaggtggactcgtagggacagtagttcactctacaccatcagcagcctgccacgtcctaggaccgtagttacggtcggaccttaaacgtttacttaccgtacgacctaaacgtagttatagtaagtttagtttaagttcgggttaaccggtttaccgggaacccgaaagggtaacccaaaggtacgtaaaggaaacttaaccggaaaacgtaacggtcggttacggaccgttacggacctaaccgtaagttccgttacgttccttaaccg

SEQ ID NO: 162250 - DNA, 576 bp, Homo sapiens
  misc_feature: GYAE6OF02IVI8P.3.1.A01.1.454.CMB.1.raw
  modified_base (185)..(185): a, c, t, g, unknown or other
  misc_feature (185)..(185): n is a, c, g, or t
  modified_base (303)..(303): a, c, t, g, unknown or other
  misc_feature (303)..(303): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttagganacagagtcaccatcacctgccgggccagtcaaagtattagtaactcgttggcctggtatcagcaaagaccaggcagacgccccaaagctccttatctctgatgcctcaatttcgcacnggtcgggtccaccaacgttcagcggcaggtggatcgtgggacagtagttcactctcaccatcagcagcctcgcagccgtagacgagtgtcggactaactttattaaccgtcgacccaacgagtatacgtaagttagtttaagttacggtaccggtttacggaccgtaaacggggaacctaaagggacttaacggaaacgttaaccgtaaaacgtaaccggttaggtacggtacgttacggaccctaactacgttaccgttgtaccctttaccg

SEQ ID NO: 162251 - DNA, 530 bp, Homo sapiens
  misc_feature: GYAE6OF02I1A99.3.1.A01.1.454.CMB.1.raw
  modified_base (421)..(421): a, c, t, g, unknown or other
  misc_feature (421)..(421): n is a, c, g, or t
tcagagacgcactccacgaccggtgctcgatttagacgtctcatcaggggagactcagtcaggacacagcatggacatgtgggtccccgctcagctcctgggggctcctgctgctctggctcccaggtgccaaatgtgacatccagatgacccagtcctccctccaccctgtctgcattctttaggagacagagtcaccatcacctggccggccagtcaaagtattagtactcgtggcctggtatcagcaaagaccaggcagacgccccaaagctccttatctctgatcgcctcctaatttgcacaggtcggggtcccaccaacgttcagcgcagtggatcgtgggacagtagttcactctcaccatcagcagcctgcagcctgacgagtgtggactaactttacttacgtcgaccctaanagttatacgtattagttagttcgggtacgttaccgggaccgaaagggaaccaagacgtaagaaactaacaacgtaactggtaggctacgcacctatccttgtacttacg

SEQ ID NO: 162252 - DNA, 532 bp, Homo sapiens
  misc_feature: GYAE6OF02FSUK6.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagacgccccaaagcctccttatctctgatgcctccaatttgcacagtcgggtcccacaacgttcagcggcagtgatcgtgggacagagttcactctcaccatcagcagcctgcagcctgacgtatggtaggtactaactttattaccgtcgacctaacgagttatagtattagtttagttcgggtacgttacggaccgaagggaccaagtacgtaacgaaacgtacgaaacgtacgtagtacggtacgtacgactacctagtcttgtcttacc

SEQ ID NO: 162253 - DNA, 586 bp, Homo sapiens
  misc_feature: GYAE6OF02FKGQX.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagcccccaaagcctccttatctctgatcgcctccaatttgcacagtcggggtcccaccaacgttcagcggcagtggatcgtgggacagagttcactctcaccatcagcagcctgcagcctagacgatggtcggctaactttattacctcgaccaacgagttaagtgtagttaagtttagttacgggtaccggttttacgggacccgtaaacggggaaccctaaaggtaagtaacggtaaaattaaccggaaaaaccgtaacgttacggttacgggtaccgttacggacccaaacccgttacttaccgttacgttccgtttaaccg

SEQ ID NO: 162254 - DNA, 719 bp, Homo sapiens
  misc_feature: GYAE6OF02IW4FA.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagacgaccccaaagcctaccttatctctgatcgcccttacctaatttcgaccaacgtacggttcggggtacccccaaccgtaaccggtttccgaacggtccggaccgaagggttcggaattccggtaggggaactaaggtacgtttccaaccttcctacctaacccgtaacttccgaacgtaccgaacggtccccttacggacctacggtacccgttacgggaaccggttaacgttcgggttaccgggttaaccttaaaacgttttacgtttaaccgtaccgtaacccctaaaccggtaaggttaacttaggtaaatttaagtttacgtttacgggtaaccggttttaccgggaacccgtaaagggaaccctaaaggtaacgtaaacgtaaacgtaaccgaaaacgtacgttaggtacggtacttacgacctaaccgtacgtcgttacgttaccttaccg

SEQ ID NO: 162255 - DNA, 617 bp, Homo sapiens
  misc_feature: GYAE6OF02JQEU5.3.1.A01.1.454.CMB.1.raw
  modified_base (216)..(216): a, c, t, g, unknown or other
  misc_feature (216)..(216): n is a, c, g, or t
tcagagacgcactccacgaccggtgctcgatttagacgtctcatcaggggagactcagtcaggacacagcatggacatgtggtcccgctcagctcctggggctcctgctgctctggctcccaggtgccaaatgtgacatccagatgacccagtctccctccacctgtctgcattctttaggagacagagtcacatcacctgccggcagtcaaagtnttagtaactgttcggctggtatcagacaaagaccagcagacgacccaagctccttatctctgactcgcctactactttcgactacgtacggtcgggtaccccaaccgtaacgttcgacgcggactagtcggactcgtagggactaggtacttacgactccgtcacctatcgacgactacgacctcgacacggtcctcggaacgtacgtggtacggtacctttaaacgtttcttaaccgtcaaccgtaacctaaggttacgtagttaagttagtttaacggttacggtaccgtttaccgggaccgtaaacggggactaagtagtaacggtaactaaccgtaaacgtaacgtacggtacggtaactacggacctaaccgtagttccgttacgtaccgtttaac

SEQ ID NO: 162256 - DNA, 572 bp, Homo sapiens
  misc_feature: GYAE6OF02IU4LG.3.1.A01.1.454.CMB.1.raw
  modified_base (335)..(335): a, c, t, g, unknown or other
  misc_feature (335)..(335): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcattctttaggagacagagtcaccatcacctgccggccagtcaaagtattagtaactcgtgcctggtatcagcaaagaccaggcagacgccccaaagcctccttatctctgatgcctcaatttcgcacaggtcgggtacccacgaacgttcagcggcagtgntcgtggacagagttcactcacaccatcagcagcctgcacgccgtagacgagtgtacggactaacgtttatactacgacctaacgtagtatagtagttaagtttagttacgggtaccgtttacgggaccgtaaacggggacctaaaggtataaaggtaaacgtaaccgaaaaccgtaacggttacggtacggtacgttacggacctaaccctagttccttacggttacctttaacccg

SEQ ID NO: 162257 - DNA, 583 bp, Homo sapiens
  misc_feature: GYAE6OF02I72ZA.3.1.A01.1.454.CMB.1.raw
  modified_base (365)..(365): a, c, t, g, unknown or other
  misc_feature (365)..(365): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagacgaccccaaagctccttatctctgatgcctccaatttcgcacgagtcgggtcccaaccgaacgttcagcggcagtgatcgtaggacagagttcactctcaccntcagcagcctgcagcctgacgagtggtcggtactaactttacttacctacgtacccaaacgtagttaatagtaagtttacgtttaagtttcgggtaaccggtttccgggaccgtaaacgggaacccgtaaagaattaacggtaaactaaccgtaaaacggtaacgttacggttacggtacgtacggacctaccgattaccgttacgttccgtttaccg

SEQ ID NO: 162258 - DNA, 608 bp, Homo sapiens
  misc_feature: GYAE6OF02G3JXN.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagacgccccaaagctccttatctctgatcgcctccaatttcgcacgacggtcggggtccccaccgaacgttcaggcggcagtggatcgtgggacagagtcactctacaccatcagcagcctgcgacgccgtaggaccgtatcggtacggtacctaaacgtttactacctcgaacccaactaagttataggtaattaggttttaacgttacgggttaaccggttaccgggacccgtaaacggggacctaaaggacttaacggaaactaaccggtaaaaccggtaaccgttaggttaccggtacttacggaccctaacccgtagtttacccgttaggttcccttaacccgg

SEQ ID NO: 162259 - DNA, 495 bp, Homo sapiens
  misc_feature: GYAE6OF02G3NSW.3.1.A01.1.454.CMB.1.raw
  modified_base (221)..(221): a, c, t, g, unknown or other
  misc_feature (221)..(221): n is a, c, g, or t
  modified_base (386)..(386): a, c, t, g, unknown or other
  misc_feature (386)..(386): n is a, c, g, or t
  modified_base (474)..(474): a, c, t, g, unknown or other
  misc_feature (474)..(474): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtnttagtaactcgttgcctggtatcagcaaagaccaggcagacgccccaaagctccttatctctgatgcctccaatttgcacgagtggggtccccaccaacgttcacgcggcagtggatcgtgggacagagttcacttctcaccatcagcagcctgcagcctgacgntgtggcaacttatactgccaacagtatgatagttattggtacgttcggaccgaagggaccaagataagaatcaaacgtactagtcggntcgcaccgatcctgtcttacc

SEQ ID NO: 162260 - DNA, 599 bp, Homo sapiens
  misc_feature: GYAE6OF02H9RZD.3.1.A01.1.454.CMB.1.raw
  modified_base (284)..(284): a, c, t, g, unknown or other
  misc_feature (284)..(284): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagacaaagaccgaggcagacgaccccaaagctaccttanctctgatcgcctactaatttcgctacgtaggtcgggtacccacctaaccgttcacggcggcagtggactcgtaggacagtacgttcactctacacctagtcagcacgcctgcacgtcctagacgtatcggtaggacctaactttacttaccgtcgtacctaactagttattaggtatttaggttacgttacgggtaccgtttaccgggaccggtaaacgggacctaaggaagttaaacggaaacttaaccggaaaaccgtacggttaggtacggtcgtacgacctaaccgttcgtaccgttacgttctttacccg

SEQ ID NO: 162261 - DNA, 544 bp, Homo sapiens
  misc_feature: GYAE6OF02IXQCX.3.1.A01.1.454.CMB.1.raw
  modified_base (185)..(185): a, c, t, g, unknown or other
  misc_feature (185)..(185): n is a, c, g, or t
  modified_base (357)..(357): a, c, t, g, unknown or other
  misc_feature (357)..(357): n is a, c, g, or t
  modified_base (378)..(378): a, c, t, g, unknown or other
  misc_feature (378)..(378): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttagganacagagtcaccatcacctgccggcagtacaaagtattagtaactcgtgcctggtatcagacaaagaccaggcagacgccccaaaagcctaccttatctctgtatcgccctactaatttgcacgacggtcgggtacccacctaacgttcacgcggcagtggatcgtggacagngtcactctaccacctatcacncacgcctcgctacgcctgacgtgtggtcgactaattacttacgcgacctaatagttatagtattaagttagttacggtacggttacggacgtaaaggtaccaagtataagtaacgtaacaaacgtaacgtggtacgactcgacctaccgtactcgttcgtacttac

SEQ ID NO: 162262 - DNA, 783 bp, Homo sapiens
  misc_feature: GYAE6OF02G9R2V.3.1.A01.1.454.CMB.1.raw
tcagagacgcactccacgaccggtgctcgatttagacgtctcatcagggggagactcagtcaggacacagcaatggacatgtgggtccccgctcagctcctggggctcctgctgctctggctcccaggtgccaaatgtgacatccagatgacccagtctccctccaccctgtctgctattcgtttaggagacgagagtcaccatcacctcggccggcagtacaaagtattagtaactcgtggcctggtatcagcaaagctaggacacgacacccaaagctaccttatctctgactcgccgtacaatttgctacgacggtcgggtacccctaccgtaacggttccgacgtccggacgtaggtacggacttacgtcgggtaacagttacgttcaaccgttactacccgaaccgtaactaccgtacgaccgtaaccggtacccttaccggccgtaaaccggttacccgttaacggtaaacccgggttaacgttacggggttaaccgttaaccgttaaaacccgtttttaaacgttacccgtaccgtaaacccgtaaacggttaaacgttaacgttaaacggttaacgttttaaacgtttaaccgggttaaccgggtttaacccgggttaaccgggtaaacccggtaaaccggggtaaactaaacgggttaaacgtaaccggttaaaaacgtttaccgggaaaaaccgttaacgtacgggttaccggttaccgttaaccgggtaccgttaacccgttaggtttccctttaggtaacccgttttcccg

SEQ ID NO: 162263 - DNA, 581 bp, Homo sapiens
  misc_feature: GYAE6OF02IQ3Y7.3.1.A01.1.454.CMB.1.raw
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (348)..(348): a, c, t, g, unknown or other
  misc_feature (348)..(348): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
  modified_base (430)..(430): a, c, t, g, unknown or other
  misc_feature (430)..(430): n is a, c, g, or t
  modified_base (542)..(542): a, c, t, g, unknown or other
  misc_feature (542)..(542): n is a, c, g, or t
tcagagacgcactccacgaccggtgctcgatttagacgtctcatcagggagactcagtcaggacacagcatggacatgtgggtccccgctcagctcctggggctcctgctgctctggctcccgaggtcgccaaatgtgacatccgagatgacccagtcctccctccaccctgtctgcattctttaggacgactagagtccaccatcacctgccggccagtcaaagtnttagactcgtgcctggtatnagcaaanacgagnanacggaccccaaagctaccttatctactgactcgcctcctaattgtccatcggtcggtcccaacaacgttcagcggtcagtgatcgngggacagtagtcactcacacctntcganccgagcctggactacgcgtagacgtatcggtcggaacctaatttacgttaaccncggaaaccctaacgtagttacttaggtaacttaacggttttgttaccgggacgtttccggaaacaacggggacctaagaagtaacgtaaacgtaacgtaaacggacttaggnggacccttaggactaaccgtactttggtaccttcttaac

SEQ ID NO: 162264 - DNA, 571 bp, Homo sapiens
  misc_feature: GYAE6OF02HROVC.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagacaaagaccaggcagagaccccaaagctccttatctctgatcgcctcctaatttcgctacaggtcggggtacccctaaccgtaacgttcacgcggcgtaggtggactcgtagggactaggtacgttcactctaccacactcagcacgcctgccagcctagacgtagtgtacggactaacttattacacgacctaaactagtaactaacgtacccgacgtacgaccgttaccggaccgtaaacgggaccgtaagggtggagtacgtacgaagttaaccgaacgtggtacggctacggacctacctagtccgttcgtaccttaccg

SEQ ID NO: 162265 - DNA, 643 bp, Homo sapiens
  misc_feature: GYAE6OF02HLHT9.3.1.A01.1.454.CMB.1.raw
  modified_base (279)..(279): a, c, t, g, unknown or other
  misc_feature (279)..(279): n is a, c, g, or t
  modified_base (344)..(344): a, c, t, g, unknown or other
  misc_feature (344)..(344): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtcctccctccaccctgtctgcatcttaggagacagacgtcaccatcactggccgggccagtacaaagtattagtaactcgttggcctggtatcagcaaagcaggcagacgacccaagcctcttanctcgtgacttcgacctctaattcgactacgaggttcgggtacccaactaacggttccaggccgtnaaggttgattcggtacgggactaggacgttcacgttctaccgactagtccagcctagcctcgcagtccgtagacgtatgtacggtaccttaaactttcttaaccgcgtaaaccctaagtaaggttactaggttaacgttacgtttacggttacgggttaaccgtttccggggaacgtaaaccgggtaacctaggtaaactaacggttaaacgtaaccggtaaaaccgtaaggtccgggaaccgggtaccttacggacccggtaacccttaggttttacctccggttacctttaacccgg

SEQ ID NO: 162266 - DNA, 635 bp, Homo sapiens
  misc_feature: GYAE6OF02JGGZ2.3.1.A01.1.454.CMB.1.raw
tcagagacgcactccacgaccggtgctcgatttagacgtctcatcagggggagactcagtcaggacacagcatggacatgtgggtccccgctcagctcctggggctcctgctgctctggctcccaggtgccaaatgtgacatccagatgacccagtcctccctccaccctgtcctgcattcgtttaggagacagacgtcaccatcacctggccgggccagtacaagtattacgtaactcgttgcctaggtctcagacaaagacaggcagacgacccaagctacttatctctcgatcgcctaccgtaatttcgactacgtacggttacgggtaccccaaccgtacgttaccgacggccggtacgaggtcggacttacggtagggactaaggtacgttaccacgtcacctacgactcaagccaacgcctcgacacgtccgtagacgtcgtcggtacggtacttaaacgttacttacgacgtacctaacgtacgtaactaggtaacgtttacgttaggtttaccgggtaccgttacgggtaacccggaagggtaacctaaggtagtaacggtaacttaaaccggtaaacgtacgtacggtagtacgtacgtaccaactcgtacgtacgtaccttaccg

SEQ ID NO: 162267 - DNA, 683 bp, Homo sapiens
  misc_feature: GYAE6OF02ILI8P.3.1.A01.1.454.CMB.1.raw
tcagagacgcactccacgaccggtgctcgatttagacgtctcatcaggggagactcagtcaggacacagcatggacatgtgggtccccgctcagctcctggggctccctgctgctctggctcccaggtgccaaatgtgacatccagatgacccagtcctccctccaccctgtctgcattctttaggagacagagtacaccatcacctcgccgggccagtacaaagttattagtaacttcgtgcctggtatcagacaaagaccaggcagacacccaagcctccttatctctagactcgtacccttacctaatttcgactaccgtacgggttaccggggtaccccaacccgtaaccgttcgacggtacggcgtaaggtcggactcgtagggaacgtaggtacgttaccgtacttccgtaccacctactcgacgtccgaacgcctagaccgtacgtcccgtacggtaacgtagtcggttacggtaaccgttaaacttttacttaaccgtacgtaacccgtaaactaggttaactagttaagtttaagttaggttacggtaccggtttaccgggaaccgtaaaaccgggactaagtaacgttaagtaaacgtaacccgtaaaacgtaccggttacggttacggtaccgtacgtacctaaccgttacttcggttctacccgtttaacc

SEQ ID NO: 162268 - DNA, 675 bp, Homo sapiens
  misc_feature: GYAE6OF02F8FAE.3.1.A01.1.454.CMB.1.raw
tcagagacgcactccacgaccggtgctcgatttagacgtctcatcaggggagactcgagtcaggacacagcatggacatgtgggtccccgctcagctcctggggctcctgctgctctggctcccaggtgccaaatgtgacatccagatgacccagtctccctccaccctgtctgcatctttaggagacagagtcaccatacaccgtcgccgggccagtcaaagtattagtaactcgttgcctggtatcgagcaaagacaggacagacgaccccaaagcctaccttatctctgactcgcctcctaatttcgactacgaggtccgggtaccctaaccgtaaccgttccgacggccggtacgtaggtcgggtaactcgtagggacgaggtacgttacgaccgttctacctaaccgtactccgacgacctacgtcctgtacgaaccgctacgaacgtagtcggttacggacttaaccgttttaacggttacctacggtaaccctaaagtaacgttacgtaacgttagtttaaacgggtttacgtttaccggggtacgtttacccgggaaccgtaaaacgggggaccttaaacgagtaaacgtaaaccgtaaccgtaaacggaaccgttcggggtagtacccgtagtaccctaacgtctacggtttacgtccttaacccg

SEQ ID NO: 162269 - DNA, 611 bp, Homo sapiens
  misc_feature: GYAE6OF02G2VN8.3.1.A01.1.454.CMB.1.raw
  modified_base (186)..(186): a, c, t, g, unknown or other
  misc_feature (186)..(186): n is a, c, g, or t
  modified_base (365)..(365): a, c, t, g, unknown or other
  misc_feature (365)..(365): n is a, c, g, or t
  modified_base (542)..(542): a, c, t, g, unknown or other
  misc_feature (542)..(542): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtcctccctccaccctgtctgcattcttagganacgagagtcaccatcaccgtcggccggccagtacaaagtattaacgtacgtcgttcggccttggtatcgagacaaacgacaggcacgacgacccaagcctcttatctctagctcgcctactattcgacacgacggtcggtacccacgtacgtcgacggcggactaggtagacgttcggngggaacacgtacgttccgactcctaccacctactcgaactaccgacgtacgtcgaccgacgcctacggacgtagtcgtacggactaacgtttactacgcgaaactacgagttactacgttacgttaggttacgttacgggttaccgttaccgggaacgtaaaccgggactaaggtanaaacgtaacgtaacgaaacggtacgtcggtacgccgtacgtacctaccgtaatttcttacggtcttacc

SEQ ID NO: 162270 - DNA, 621 bp, Homo sapiens
  misc_feature: GYAE6OF02ILEMD.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatcgacccagtcctccctccaccctgtctcgctattcgttaggagtacagagtccaccatcaccgtcggccgggccagtacaaagttacttagtacgtcggttggccgtggtatcaagacaaagaccaggacagacgaccccaaagtccttaccttatctctcgtatcgacctactaatttcgacacgtacggtccgggtaccctaccgtaacggttcgacggcggtacgtacggtcggtactccggtagggaactaggtacgttacctacgtacctaccgaactcgtcaacgcgtacgtccgtagcctacgtcgtaggacgtaggtcgacgtacttacttactacgtcgaacactagttagtagtagtttagtacggtacggtaccgtcggaacgaacggtaacaagtacgtaacgtaactaacgaacggtacgtaggtcgagtcgactaccgtacgttcgttaccttacgttac

SEQ ID NO: 162271 - DNA, 565 bp, Homo sapiens
  misc_feature: GYAE6OF02II9XS.3.1.A01.1.454.CMB.1.raw
  modified_base (396)..(396): a, c, t, g, unknown or other
  misc_feature (396)..(396): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgctatctttaggagacagagtcaccatcacctgccgggcagtacaaagtatagtaactcggttaggcctggtatcagacaaagaccaggacagacgcccaaagctaccttatctctgatcgcccttactaagtttcgcgacgtaggtccgggtacccaaccgtaacgttcaggcggcgtaggtggactcgtaggacagtagtcactctacaccatcagcacgcngcacgcctgacgtagtcggtaggtactaattacgttactacgacctaactagttatagtagttagttagttcgggtacgttaccggacgaaacgggacaaggtataagtaactaccgtaaacgacgttaggtacgacgtacgacctacctataccgttacgtcttaccg

SEQ ID NO: 162272 - DNA, 615 bp, Homo sapiens
  misc_feature: GYAE6OF02IRFY3.3.1.A01.1.454.CMB.1.raw
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (473)..(473): a, c, t, g, unknown or other
  misc_feature (473)..(473): n is a, c, g, or t
tcagagacgcactccacgaccggtgctcgatttagacgtctcatcagggggagactcagtcaggacacagcatggacatgtgggtcccgctcagctctggggctcctgctgctctggctcccaggtgccaaatgtgacatccagatgacccagtcctccctccaccctgtctgcattcgttagagacagagtcaccatcacctgccgggcagtnaaagtntagtactcgttgctggatcagcaaagccaggcagacgaccccaaagtcctaccgttatctcgtgatccgccttacctaagtttcgactacgtaggttcggggtaccccaacgtaccggttcaacggcggcctaaggtggtacgttcgtacggggtacaaggtagtttccgacgttctccgaccaagttcgaacgcctaacgtacctggccacggtcgtacggtaacgacgtggtcggactaactttagttacncgtaccaactagtatagtattagtttacgtcggttaaccgtcgggtaccgtaacggaacgtaaaggtactaacggtaactaaccgaaaagtaccgtaggtacggtacgtactaaccgaacctacttcggttacttcgttacc

SEQ ID NO: 162273 - DNA, 639 bp, Homo sapiens
  misc_feature: GYAE6OF02FR0PE.3.1.A01.1.454.CMB.1.raw
  modified_base (428)..(428): a, c, t, g, unknown or other
  misc_feature (428)..(428): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtcctccctcccaccctgtctgcatcgtttaggagacagagtccaccatccacctcggccgggccagtacaagtatagtaactcgtggcctggtatcagacaagaccgaggacagaccgacccgaagccttccttactctctgatcgcccttacctatttcgaccgtacgacggtccgggggtacccctaaccgtaccgttacgacgccggacgaggtggtacgtcggtacgggacaggtacgtaccacgtccaccgaccatcgagacgacgtcncgacgtacgccgtacgacgtgtggtacgacttaacttacgtactacgaacctaacgagttacgtagtaagtttaggttaacgttacgggttaccggttacggaaccggtaaacgggtaaccgtaagtacgtaaacgtaaacgtaaacgaaacgtaacggtaggtaccggtacgtaccgaccgtaaccgtacgtacgttacgttccttaccg

SEQ ID NO: 162274 - DNA, 774 bp, Homo sapiens
  misc_feature: GYAE6OF02JUEBL.3.1.A01.1.454.CMB.1.raw
  modified_base (186)..(186): a, c, t, g, unknown or other
  misc_feature (186)..(186): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtcctccctccaccctgtctgcattcttagganacagatcaccatcaccgtgcccggcagtacgaaatattagtacctggttcgcctaggtactcagacaaacgaccgaggacgacgacggaaccctaaagccttacctttaactcttacgtgtactcgcccttactaaagtttcgaccacgtacggttaccggggtaccctaacccgtaaacgtttccgaacggtcccggtacgtacggtagggtaccgttcgggtttacgggaaccggtaggttaacggtttaccctaaccgttaccgtacccgtaaaccctaagttaccccgaaggtccctaaacggtccccttacggacccgaaccgttaccggttacgaaaccggttagtaccggtacgggttaacccttaaacctttaaacgttcccgtacggtaacccctaaattaaccgggttaattacggtaaacgttttacggtttaacggtttacgggttaacccgggtttaccgaaccggttaaaaccgggaccgttaaagagtaataaacggtaaccgtaaacggtaacctcgggttaccgtaagtaccgtacccgtaacttacgtttacgtcgtttaacctttaccg

SEQ ID NO: 162275 - DNA, 714 bp, Homo sapiens
  misc_feature: GYAE6OF02GK588.3.1.A01.1.454.CMB.1.raw
  modified_base (467)..(467): a, c, t, g, unknown or other
  misc_feature (467)..(467): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtcctccctccaccctgtctgcattcttaggagacagagtccaccatccacctggcccgggccagtactaaaagtattacgtaactcggttggcctggtatcagacaaagaccaggacagacgaccccaaagtccttacttactctctgactcgtaccctacctaagtttcgacctacgtacgggttccgggtaccccaaccgtaaccgttcgacggaccggtacgtaggtacggtacgttcggtacgggtaacagggtacgttacctacttacccgtaccgacctactaccgacgtaccgaccgtaccgtacnccgacgtaccgtagaccgtagtcgtacggtacttaactttacgttacctacgaacctaagtacgttagttaagtacgtttaaggtttacggttaaccggttaccgggttaaccggaaccggtaaaacgggtaccgtaaagttacggtaaagtaaaccgttaaacggtaaaaccgtaacggttacggtaacggtaacctacggtaacctaacccgttaacgtttcggtttaccttacccgttaacccg

SEQ ID NO: 162276 - DNA, 783 bp, Homo sapiens
  misc_feature: GYAE6OF02H5VPS.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgaccaaatgtgacatccagatgacccagtcctccctccaccctgtctgcatctgtaggagacggagtccaccatcacttcggcccgggcagtcagagttattacgtaccgtgggttggccgtggtatacagcgagaagaccgaagggaaacgcccctaacctctagtatccgtaatgtactcgacccttcgtaggttcggacgtaacgggtcggggtaccctaagtaccgtaagggttccacggcggtaccgtaggtaggtacgtcggtacgggaacgtaaagttaaccgttaccgtaaccttcccgttaacctaacctactacgtaacgaccgtaccggccccttaggaccctacggtacccgttaggtaacttggtttaacttttaccgtaaccgttttaaacctttagttaacctaaccggtaaccctaaaaccgttaagtttaaaacccgttaacccggttacccgggttaacccggttaccggttaacccgggtttacccgggaaccggtaaaaccgggggtaaccgtaagggggttaacggaacgtaacgttaccggtaaacggttaacccggtaaaggttcgggtttaccggaccgttccggaacccttaaccgtaactttcccggtttaactttacccgtttaacccg

SEQ ID NO: 162277 - DNA, 816 bp, Homo sapiens
  misc_feature: GYAE6OF02JXTJZ.3.1.A01.1.454.CMB.1.raw
tcagagacgcactccacgaccggtgctcgatttagacgtctcatcagggagactcagtcaggacacagcatggacatgtgggtccccgctcagctcctggggctcctgctgctctggctcccaggtcgccaaatgtgacatccagatcgacccagtcctccctccaccctgtctgcattcttaggatacagtacgtcaccatcaccgtcgccgggccagtacgaaagtacttaggtactcggttgccttggtaatctagacaaacgaccaggcaggacgacccaaagccttaccgttactcgtctcgactacgcctacctaactttcgaccacgtaacgggttcggtaccccgtaaccgtaccgtttacgacggaccggtacgtaggttcgagtcgggtacggacggtacgtagttccaaccgttccaacctaccgacttaccgagtacccaaggtcccgtacgtaccggtaccggtaccgttaacggaacgttaaccggttcgggtaaccgggtacccgtaaaacctttttaccgtaaacgttcccgaaaccgttaaaccgtaaacgttaacggtttagtaaacgggttttaaccgttttaaacgggttaaccgggttttacccgggttaacccgggtaaacccggggtaaaaacgggttaaaccccgtaaaagggtttaacgggtaaaacccttaaaaggggttaaaacccgtaaaacggtttaaaaccccggttgggtttaaacccgggtacttaaaccgggttccctaaaaacgttccccggttaaccgtttttaggtaccccttttaaccg

SEQ ID NO: 162278 - DNA, 606 bp, Homo sapiens
  misc_feature: GYAE6OF02INQI7.3.1.A01.1.454.CMB.1.raw
  modified_base (389)..(389): a, c, t, g, unknown or other
  misc_feature (389)..(389): n is a, c, g, or t
  modified_base (409)..(409): a, c, t, g, unknown or other
  misc_feature (409)..(409): n is a, c, g, or t
tcagagacgcactccacgaccggtgctcgatttagacgtctcatcagggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgcccgggccagtacaaagttattacgtaactcgttggcctggtatcagacaaagaccaggcacgacgcccaaagcctccttatctctagatcgacctctaatttcgacacgaggtcggggtacccaaccgtacgttcacgcggacgagtggtagtcgtgggacagtagttacactctaccactanacacgacacgccgtagacgngcctagacgacgtaggtcgtactaactttacttacgtcgaccaagtatagtagtaatttagtttagttacgggtacgttacgggaccgtaaagggaaccctaaggtagtaaacgtaacgtaaccgtaaaccggtaacgttaacggtacggtaacgttaccggaactaccgtacttaccggtacgttacccttaccgg

SEQ ID NO: 162279 - DNA, 604 bp, Homo sapiens
  misc_feature: GYAE6OF02F1HRP.3.1.A01.1.454.CMB.1.raw
  modified_base (185)..(185): a, c, t, g, unknown or other
  misc_feature (185)..(185): n is a, c, g, or t
tcagagacgcactccacgaccggtgctcgatttagacgtctcatcagggggagactcagtcaggacacagcatggacatgtgggtccccgctcagctcctggggctcctgctgctctggctcccaggtgccaaatgtgacatccagatgacccagtctccctccaccctgtctgcatcttagganacagagtcacatcaccgtgccgggccagtacaaagtattagtactcggttggcctggtatcgagacaagaccagcagacgacccaagctacctatctctgatcgcctactatttcgcacgtacggttcgggtacccaccgtaacgttcgacggcggacgaggtggactcgtacgggacagtacgttcactctacacctagtcacgacacgcctacgcacgtccgtgacgtagtacggttacgactaacgtttacttaccgtacgaacctaacgtagttacgtagttaagttacggtttagttacgggtaccgttaccgggaacggtaacggtaacgtaacggtacgtaacgtaaacttaaccgaaacggtacttacggtacggtactacggtacaccgtataccgttcgtccttaaccg

SEQ ID NO: 162280 - DNA, 646 bp, Homo sapiens
  misc_feature: GYAE6OF02G88PI.3.1.A01.1.454.CMB.1.raw
  modified_base (223)..(223): a, c, t, g, unknown or other
  misc_feature (223)..(223): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcattcttaggagacagagtccaccatcacctggccggccagtacaaagtnttagtaactgtgcctgtatcagcaaagaccaggcagacgaccccaaagcctaccttaatcctctgacttcgaccctacctaagtttcgcacgtacgggttcggggtaccccaactaaccggttcgaggccggcgaggtggactcggtgggacaggtacgttcactcctacacctactaccaggcctagtcccgtggacctacggtcccgtaggaccgtagtggttacggaccttaactttacgttactaccgtaacctaagtacgttagttagtaagtttacggttagttacgggttaaccgtttccgggtaacgtaaacggggtacctaaagggattaacggtaaagtaacccggtaaaacgtacggttacggtacgtaacgtacccgaccgtacgtaccgttcgttacgtacctttacccg

SEQ ID NO: 162281 - DNA, 727 bp, Homo sapiens
  misc_feature: GYAE6OF02F1POK.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcattctttaggagacagagtcaccatcacctgccgggccagtcaaagtattaacgtaactcggttggcctggtatcagcaaagaccaggcagacgaccccaaagccttaccttatcctctgactcgccctcctaagtttcgcctacgtaggtcggggttaccccaaccgtaaaccgttcacggcggactaggtacgggattaccgtggggaacaggtacgttccaccttcctaccaacccagtaccacgccacgcccgttgccgtacgccgttgaccgtagtcggtcggtaactaacgttttacgttaccgtccgaaaccctaacgttaacgttaaacgttacggttaagttttacggttttaacggttttacggggttaaacccgttttacccggggaaacccggtaaaaccgggggaaaccttaaaccggtaagttaaaacgtaaacgttaaacccggtaaaaaccggtaaccgtttagggtaccgggttacgttaccggaaccgttaaaccccgttacggtttccgttaccggttttaccctttaaccccg

SEQ ID NO: 162282 - DNA, 613 bp, Homo sapiens
  misc_feature: GYAE6OF02GQWJB.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtcctccctcccaccctgtctgcatctttaggagacagagtcaccatccaccgtcgcccgggccagtacgaaagttattacgtaaccttcggttcggccgttaggtatacgagacaaagaccaggacagacgaccccaaagtcctccttactctctgactcgcctacctaatttcgacctacgtacgggtccgggtacccctaaccgtaaccgttacgaacggccggactaacggtaggtacttcggtagggacaggtacgttacctactcctacacctatcacgcacgtccgtacgacacggcctagacgtagtcggtagtactaacgtttatacctacgaaccaagtacgttatagttagttagttagtacggttacgttccggacgaaacggaccaagtataagaactacgaaacgtaacgtgtacggtacacgaccactacgttctcttactaccg

SEQ ID NO: 162283 - DNA, 961 bp, Homo sapiens
  misc_feature: GYAE6OF02J28FH.3.1.A01.1.454.CMB.1.raw
  modified_base (214)..(214): a, c, t, g, unknown or other
  misc_feature (214)..(214): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatcgacccagtcctccctccgaccctgtctgcattccgttaggacgacgagacgttaccaaccataccnccgtcggcccgggtaccaggtaacctaaaggttacgtttaacggtaaccgttcgggttacggtccgttacggttacacgtaacgaacgaaacggaccgacggaccgaacggacccgtaacccccgtaaaacgtcctttacccttacgttcccgtacttacgtaacgttccgtaccttaaccgttaacgtttccgacccgtaacggttccggggttaccccggggtaacccctaaaccccggttaaccggttccggaacggtacccggacggttacgggtacggggttacggttaccgggtaacggggtaaccgttaaacggtttaccgtttaacccggtaaccctttacccggttaacccctaacccgtttaacgttacccgaacggtaccccggttaccgtccccgttaagaaaccccggtccgggttaacccctacgggtaaacccgggtggtttaccgggttaaacccggttaaacctttaaacccggtttttaccgttacccggtaccgtaaaacccggttaaacgttaaccgttaaaacccgttcccggttaacccgggtccggttaaccgggtaaccgggtttaaccccgggaaacgggtaaacccggttaaaccggggtaggtaaccggtacttaaccggtaaccgtaaccgggtttaagaaccggggttccggttaaccggaccgtaccggaaccttccccgggttaacgttcccggtttacttaccccggtttaaccg

SEQ ID NO: 162284 - DNA, 507 bp, Homo sapiens
  misc_feature: GYAE6OF02JDB5X.3.1.A01.1.454.CMB.1.raw
  modified_base (218)..(218): a, c, t, g, unknown or other
  misc_feature (218)..(218): n is a, c, g, or t
  modified_base (323)..(323): a, c, t, g, unknown or other
  misc_feature (323)..(323): n is a, c, g, or t
  modified_base (355)..(355): a, c, t, g, unknown or other
  misc_feature (355)..(355): n is a, c, g, or t
  modified_base (358)..(358): a, c, t, g, unknown or other
  misc_feature (358)..(358): n is a, c, g, or t
  modified_base (380)..(380): a, c, t, g, unknown or other
  misc_feature (380)..(380): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccggcagtcaagtnttagactcgtgcctgtatcagcaaagaccaggcagacaccccaaagctaccttatctctgactgccctacaatttgcactggtcgggacccaccacgttcagcgnagtggatcgtgggacagtagttcactcacacntcngcacgcctgcacgctagacgtntgtcggtactaactttatactcgaccaagtacgtatagtattagttacgttggtacgttccgacgaaggaccaagactaagaactacaaacgtacgtaggagtccagacctactagtctgttctacg

SEQ ID NO: 162285 - DNA, 953 bp, Homo sapiens
  misc_feature: GYAE6OF02IK00E.3.1.A01.1.454.CMB.1.raw
tcagagacgcactccacgaccggtgctcgatttagacgtctcatcaggggagactcagtcaggacacagcatggacatgtgggtccccgctcagctccgtgggcctcctgctgctcgtcggctcccgaggtcaccaaatgtgacactccgagatcgaccctacgtcctcccctccctaccctcgttctcgacttacgttacgtttaaggagaacgaggtacgtaccacctaactcctacccgtccgggccccgggaccctaacgttaaccgtaaaagtttacgtttaacgttaacggttccgggttcgggtacccgttaggtaacgtacgaacgaaaccgaaaacggacccgaaggaccgaacgaacccgaaccccgtaaacgtcccttacctttacgttaccgtacgttacgtacgtacccgtacccttacgttaacgtttccgaccgtaaccggtaccgggttaccccgggttaacccctaaccgttaacccggttcgaccgggtaccggtacgtagggtacggtacgttacgggaacgggtaacgtaacgttaccgttacccgtacctttaccgtacccgtaacctacgtaacccggacggtacccgtaacccgtacgtccgaacccgtaacggttcccgtaaagggtaccgttacggtttaccggttaaacctaaccgtttaaaccgttttaaccgtccgttaaaccgtaaacccgtaagttaaacgttaagttaacgtttaaacgttttacggtttaaccgggtttaaccgggttaaacccgggttaaccggtaaacccgggtaaacgggtaaaaccgtaaacgttaaacgtaaacggttaaaccgaaaaccgggttaaccgttaaacgtccgggttaacggtttaacccgaaccggtttacccgtaaccggtttaacttcccggtttttacgtaacccctttacccg

SEQ ID NO: 162286 - DNA, 797 bp, Homo sapiens
  misc_feature: GYAE6OF02JDUOI.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatcgacccagtcctccctccaccctgtctgcattcgtttaggagacagacgtcaccatccaccgtcggcccgggacctagtaccgtaaagttacttaacgttaaccgttcggttacggtccgttaggttactccgaacggaccgaaaacgacccgaaggaccgaacggaacccgaacccccgaaaagtcccttaccctttacttccgtacgtgtaacgttccgtccccttaacgttaacgtttccgaccgtaacgtaccgggttccggggtaccccctaaccgtaccgttaccggacggcccggtacgtacggttacggacgttaccggtagggaactacggtacgtttacccgtaaccgttcccgtaacctacccgtaacgtacgacgtaccgtaccgtccgttaccggccgtaccggtaccgtagggaaccgttacggtcggtaaccgtaacgtttaaacctttaacggtaccgtaaccgtaaacctaccgtaagttacgtagttagttttaacgttacggtttacggtaaccggttacgggtaaacccggtaaaggaaccgtaaagtaacgtaacggtaaactaaccggtaaacgtacgtagggtaacgtccgtacgaacgtcctaacggttctacggttaccttaccg

SEQ ID NO: 162287 - DNA, 707 bp, Homo sapiens
  misc_feature: GYAE6OF02I711G.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcaccgtgccggcagtacaagtattagtactcgttaggcctggtatcagacgaagaccaggcagacgacccaagcctctatctctgactcgcctacctaatttcgcacgtacggttaccgggtaccccaaccgtaacgtttcgaacggccggtacgtacggttacgggacgttccggttaacgggacgtaggtaacgttccgtaaccttcgtacccgacctacgtaccgacgtaccgtacggtaccctggaccacggtacccgttagggaccgtacggtcgggttaccggacctttaaacgtttacggttaacccgtccggtaacctaaacggttagttaacgtacgtaaacgttttaacgttacggtttaccgggtacgtttacccgggaaccggtaaacgggtaaccgtaaggttaactaacggtaaacgtaacccggtaaacgtacggttacggtacggtaccgttacgaccgtaaccgtacgtttaccgtcggttaccttaacccg

SEQ ID NO: 162288 - DNA, 769 bp, Homo sapiens
  misc_feature: GYAE6OF02G6M5L.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatcgacccagtcctccctccaccctgtctcgctattcgtttaggagacagacgtccaccactccaccgtcggcccgggcctagtacgtaaagttagttaacgtaacgtcggttcggccgttggtactcgacgacaaaaggaccaggcagacccgaccccgaaagtccttccgttaatccgttctcgtacgtcgacccttacttaactttcgacctaacgtacggggttccgggtaccccaacgtaaccggttcgacggcggtactagggtacggtacgttacgggtacggggaacgtaggtaacggtttaccctaccggttacctaccgtaaccctacgttaccggacgtacccgaccggttcccgtaggacccgtacccggtccgtaacggtaccgtaggttccggtaacggtaaccttaaaccgttttatacccgtaccgaacctaaacgtagttaatacggttaacgtttaggtttaccggttcgggttaaccggtttaccggaaaccggttaaacgggaaccgtaagtacgtaaacgtaacgtaaacccgtaaaggtacggttacggtaccgttacgtaccggtaaccctaccttacggttccttacggttccttaaccg

SEQ ID NO: 162289 - DNA, 1028 bp, Homo sapiens
  misc_feature: GYAE6OF02HZAYX.3.1.A01.1.454.CMB.1.raw
tcagagacgcactccacgaccggtgctcgatttagacgtctcatcaggggagactcagtcaggacacagcatggacatgtcgggtccccgctcagctccgtggggctcctgctgctcgtggctcccgaggtcgaccaaagtcgtgacatccagatcgaccctagtcctccctcccaccgttgtctgctagttccgtttaaggacgtacaggtacgtccaacctactccaccgtccggacccgggacctaacgttaacgtaaagttaagtttacgtaaccgttgggttaccggtccgtaggtaactacgaacgaacgaaacgaccgtaaggacctaacggacccgtaaaccccgaaacgtcccttaacccgttacgttacccttaccgtaacggttacgttacccgtaacccgtttaccgttaacgtttaccggaccgtaaccgggttaaccggggtaccccggggttaaccccttaaccccgttaaacgggttaccgaacgggtacccggtacggttacggttacgggtaacttccgggacggtaaccgttaaggtaaccggttctaaccctacgtaccacctacgtacgacggttaccgacgtccgtacgtaccgtacgtaccgtaacgtaacggtaccggttacgttaaccggttacgtttaaaaccgtttaccgttaaaccggttacccgtaaaccgtaaaaaccgttaacggtttaacggtttaaaacggttaacggttttaaacggtttttaaaccgggtttaccgggtttaacccgggtttaaaccccggggtaaaaccgggttaaaaacccgggtaaaaacccggggttaaaacggttaaaccgggtttaaaaacggtaaaacccggtttaaaccggtaaaaaacccgggtttaccggttaaaccccgggtaaccgggttaaccccgttaaccgggtttaaacccccggttaaacccggtttaacccggttttaacccggttttttaacccggtttaacccccggtttttaaacccccggg

SEQ ID NO: 162290 - DNA, 808 bp, Homo sapiens
  misc_feature: GYAE6OF02F3IQR.3.1.A01.1.454.CMB.1.raw
  modified_base (116)..(116): a, c, t, g, unknown or other
  misc_feature (116)..(116): n is a, c, g, or t
tcagagacgcactccacgaccggtgctcgatttagacgtctcatcaggggagactcagtcaggacacagcatggacatgtgggtccccgctcagctcctggggctcctgctgctcnggctcccaggtgaccaaatggtgacatccagatcgacccagtcctcccctccaccctgtcctgctattctttaggacgacgagagtccacctatccaccgtcggcccgggcctagtacaaagttattacgtaaccgttcggttcggacctggtactacagaccgaaagaccgtaggacacggacgaacccctaaagtccttaccgttactcgtcgtaggtacctaccgtaccctaccttagtttacgaccgtaaccgtacgggttaccggggtacccctaacccggttaaacggttccgaacggtaccggtacgtaaggttcgtaacggttccgggtacgggaaacgttacggttaaccgttacccgttacctttaccgtaaccacccggttaacttaccgacgtaccgtaccggtcgtacgggttacgtacgtaagtaccgtacttcggtactacggttaagttactttacgttcgtaacgtacgttacgtaagtttaacttaacggttaccggttcggggtaccggtttaccggggtacccggtttacccggaaaccggttaacgggaaccggtaagggttaacggtaaacggtaaacggttaaaccgggttaacggttaccgggtaccgtaaccgttaccggtaaccgtacgttacccggtttactaccgtttaccgttacttaccccg

SEQ ID NO: 162291 - DNA, 813 bp, Homo sapiens
  misc_feature: GYAE6OF02FLJSH.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtcctccctccaccctgtctgcatctttaggagacagagtcaccataccacctcggcccgggccacgtaacgaaaacgttaattaacgtaacttcggttcggaccttggttatccgacgtaccgaaaacggaccgacggacgaacggtacgacccccaaaacggtcccttacccttttaacttcccttcgttacggaattacgtccccttaccgtaacgttttcgacgaacgtaacggttaccgggggtaacccctaaccggtaaaccggtttaccgaccggacgggacgtaacggtcgggtacgttccgggtagggaacgtaggtaccgttaccgaccttccgtacccacccgtactccgaagacaccgtccgtacgaccgacgtcccgtaaggaaccgttacgtacgggtaccgttaacgtaaaccgttttaacgttaccctacgtaaccgtaaaccgttaacggttacgtaaggttacgtttaacgggtttaagtttaccggggttaaccggggtttacccggtaaacccggtaaaacgggaacctaaaacggttaagaaagttaaaccggtaaaccgtaaaaacggttaaaccggtggttaaccggtcgtaccggaacctacccgtacctttacgttaccggtttacctaacccgg

SEQ ID NO: 162292 - DNA, 781 bp, Homo sapiens
  misc_feature: GYAE6OF02FIZZZ.3.1.A01.1.454.CMB.1.raw
tcagagacgcactccacgaccggtgctcgatttagacgtctcatcaggggagactcagtcaggacacagcatggacatgtgggtcccgctcagctcctggggctcctgctgctctcggctcccaggtgccaaatgtcgacatccagactgacccagtcctccctccaccctgtcctgcattcgtttaggagtacagagtcaccgatccacctgccgggcagtcaaagtcttagtaactcgttgcctgtactcgacgctaaacgaccaggtacacgacggtacccccaaaaggtccttaccttacgttacctcgtacgacttacgtacccttactaatttccgacgtacgtacgggttaccggggtaccctaaccgtaacggttccaacggtcccggtacgtaacggtacggtacttaccggtacgggaacgtacggtaacgtttaccgtaaccgttaccgtaccctaacccgtacgttacgaacgtccgtaacggtcccgttacggcccgtaacgtcccgtacggacccgttaagtcggttacgggtaacttaaccgtttaactttaaccgtacgtacccgtaaacttaacggttaacgttagtaaacgtttacgtttaacgttacggttaaccggttacccggtaaaccgaaacggggtaacctaagggtaccttaaacgggtaaacgttaaccggtaaaaccggtacgttacgggtaaccgtaccgttaacgggtaccctaacccggttacgttacgttaccgttacttttaaccccgg

SEQ ID NO: 162293 - DNA, 727 bp, Homo sapiens
  misc_feature: GYAE6OF02G9W2H.3.1.A01.1.454.CMB.1.raw
  modified_base (499)..(499): a, c, t, g, unknown or other
  misc_feature (499)..(499): n is a, c, g, or t
tcagagacgcactccacgaccggtgctcgatttagacgtctcatcaggggagactcagtcaggacacagcatggacatgtgggtccccgctcagctcctggggttcctgctgctctggctcccgaggtgccaaatgtgacatccagatgacccagtcctccctccaccctgtctgctattcgtttaggcacgagtagtcaccatccaccgtcgcccggacagtacaaagttacttacgttaaccgttcggttcggccgttaggtactaccgaagaccgaaaacggacccgaggaccgaacggaaccgaacccccgaaaagtcccttaccctttaacttcccgttacgtcggtacgtccgtacccttaccttaacgtttcgaccgtaacgtacgggtacccgggtacccctaccgtacgtcgacggcgacgtaggtggtacgtcggtacgggactacgtacgttccgactcctaccaccgtatacgacgaccgcgtccgngaccgaccgtcgtagacgtagttaccgtcgtaacctttaacgttaaccgttccgtaacgacccgtaagttaagttaactcggttaagttacgttttacggttaccggttaccggttaccggaaccggtaaacggtaaccgtaagaacgttaagtaaaccgtaagaaaccggttccgtaggttaccgtacgtaccgactaccgtacgttcgttacgttcctactacccg

SEQ ID NO: 162294 - DNA, 749 bp, Homo sapiens
  misc_feature: GYAE6OF02GMUBR.3.1.A01.1.454.CMB.1.raw
  modified_base (273)..(273): a, c, t, g, unknown or other
  misc_feature (273)..(273): n is a, c, g, or t
tcagagacgcactccacgaccggtgctcgatttagacgtctcatcaggggagactcagtcaggacacagcatggacatgtcgggtccccgctcagctccgtggggctcctgctgctctggctcccaggtgccaaatgtgacatccagatcgacccagtcctccctccaccctgtctgctattcgttaggacgacagactaccacctatccaccgtcggacccgggaccagtaactaaagttacttaacgtaacgttcgttggccgtaggtacncagacaaacgacgagcagaccgacccaagtcctacttactctcgtagactcgaccttacgtattcgcaggtcggtaccggtacccctaaccgtaacgttccggacggtaccggtacgtacgggtacggtacgttacgggtacgggtaaacgtacgggttaacttaccctaaccgttacccgtaccgtaacccgttaactaaccggtaccgtaccgtaaccggtcccgtacggacccgtaaccgggttcccgtaacggtacgtaaccggttcggtaaccggttaaccttttaaacgtttacgttaacctaaccggtaacctaaacgtaagttacgtagttaacgtttagttaacggttccggtacgggttacccgaacggtaaacgacgtaaagtagtaaacgtaccggtaacgtaaacggtcctagggtacccgtacgtacgtacgtaccgttattaccgttacgtacttacccgg

SEQ ID NO: 162295 - DNA, 821 bp, Homo sapiens
  misc_feature: GYAE6OF02I48F3.3.1.A01.1.454.CMB.1.raw
  modified_base (131)..(131): a, c, t, g, unknown or other
  misc_feature (131)..(131): n is a, c, g, or t
  modified_base (140)..(140): a, c, t, g, unknown or other
  misc_feature (140)..(140): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
tcagagacgcactccacgaccggtgctcgatttagacgtctcatcaggggagactcagtcaggacacagcatggacatgtgggtccccgctcagctccgtggggctcctgctgctcgtggctcccaggtanaccaaatgngacataccagatcgaccctatcctccctccaccctgtctacacaacttcttaaggacacaganaccacagtacactancgccggccaagtacaaagttatacgtaacttcggtagcctaggttacaccaggacaaaagaccaagtacgagaaccgaccgtaaagtcctaccttaagtccactagactacgtaccctaccttaagttacgacgttacgacgggttaccggtaccccgtaacgtaacggttacgaccggcggtacgtacggtacggaacgttacggacggtaaaccgtagtaaccgtttacccacgtacccttaccgaaccctagtaaccgtacggaacgtacccggtaaccttaaccggacgtaaccggtaccgttaaccggaaacgttaccggttacgtaacggttacccgtttaaaacgtttaaccgttaccgtaaccggtaaacccttaaacggaaacgttacgttaacggtaaagtttaacgggttttaacccggttaacgggttaacccggttaaaccgggtaaaccgttaaaaccggggaaaccgtaaccggttaaaggtaaacccgtaaaacgtaaacccggttaaaccggtaaacgttccgggtaaacgtccggttaaacccgaacccggtaaccgtttaaccttacgttaccgtttaaccccg

SEQ ID NO: 162296 - DNA, 864 bp, Homo sapiens
  misc_feature: GYAE6OF02F2LV9.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctccaggtgccaaatgtgacatccagatgacccagtcctccctccaccctgtctgcattcgtttaggagacgagacgtcaccatccaccgtgcccgggccagtacaaagttattagtaacctcggttcgccgtggtactacacgacaaacggaccgaggtaccaggaaccgtacccccaaaaggtccttacccgttatcctacgtaggtactcggtaccctacccgtaaagttttcggacctaaccggtaacgggtttccggggtaaacccccctaaccggttaaaccgggtttccgtaaccggggaccgggtaccgtaacgggttacgggtacgttccgggtaacggggtaaaaccgtagggttaaaccggtttacccaacggttttaccccgtaacccggtaaaccccgtaaccgttaccggaaccgttaccgacccgggtaccgttacggacccgtacgggtaccgtacggtaaaccggtacggtttacgggtccgggttaaaccttaaccgttttaacgttacccgttaacgaaccctaaacgtaacggtttaacttagggttacgtttaaacgggtttaacgttaccggggttaaccgggtttaaccgggaacccggttaaacgggaaaccgttaaggtaacgtaaaggtaaacccgttaaccggtaaaccgttacgggtacggttaccggacgtaccgggtaacctaaccgacgtttaccgttaccgttcttaaccccgg

SEQ ID NO: 162297 - DNA, 721 bp, Homo sapiens
  misc_feature: GYAE6OF02HBHSD.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcattctttaggagacagagtccaccatcacctcggccggccagtacaaagtattaagtaactcggttggcctggtatcagacaaagaccaggacagacgacccaaagtcctccttatctctagactcgacccttacgtaatttcgactaacgtaggttccggggtaccctaaccgtaaccgttcgaacggcccggacgtacggtcggtacgtccggtagggaacgtaacggtacgttacctaccttcctacctacctatacagtcctacgccctgacctacggccgtacgaacgtagtcggtacgtaactttaaacgtttacttaaccgtacgaaccctaaagtacgtaagttacgttaacgttaaggttttaacgttacggggttaaccggttacccggggaaaccggtaaaaccgggtaaccgtaaaagttaaccgtaaaacggtaaaacgttaaacccggaaaacggtaaccggttaacgggttaccgggtaccgttaccggaacccgttaaccgtacgtttaccggttacgttcctttaacccg

SEQ ID NO: 162298 - DNA, 725 bp, Homo sapiens
  misc_feature: GYAE6OF02F1H0O.3.1.A01.1.454.CMB.1.raw
  modified_base (515)..(515): a, c, t, g, unknown or other
  misc_feature (515)..(515): n is a, c, g, or t
  modified_base (696)..(696): a, c, t, g, unknown or other
  misc_feature (696)..(696): n is a, c, g, or t
tcagagacgcactccacgaccggtgctcgatttagacgtctcatcaggggaggactcagtcaggacacagcatggacatgtagggtccccgctcagctacctggggctcctgctgctctggactcccgaggtgacctaatggtagacatccgagatcgaccctagtcctccctaccgacctgtctgtactagttacgttaggagacagtacgtaccacctatcctaccgtcgccggacgtagtaactaacgttagttacgtaacgtcgtacgtcctggtactacaacgtacgaaccgacggacgtacgaacggtaccgaaccccgtaacgtacctttaacccgttactcccggtacgttaacggtacccgtaccgtaaccgttaccttaacggtttacgaaccgtaacgggtacgggtacccggtaccctaaccggtaccgttacgacggtcgtagtacgggtagtacgtcgggtacgaacgttacggtaactccgtacgtccacgtaccgtacncgaacgtcgaccgctacggactaccggtcacggacgtactacggtactaaacttcgttaacttacggaccttaacggactttaacggtactaacgttacgttagttaccgggtacggttaccgacggaccgtaaggtaaccaggtagaacgtaagtaaccgaacggtagtacgtacgtacncggtacacgttactaccgttacgcttacg

SEQ ID NO: 162299 - DNA, 693 bp, Homo sapiens
  misc_feature: GYAE6OF02G9URI.3.1.A01.1.454.CMB.1.raw
  modified_base (503)..(503): a, c, t, g, unknown or other
  misc_feature (503)..(503): n is a, c, g, or t
  modified_base (674)..(674): a, c, t, g, unknown or other
  misc_feature (674)..(674): n is a, c, g, or t
tcagagacgcactccacgaccggtgctcgatttagacgtctcatcagggggagactcagtcaggacacagcatggacatggtgggtccccgctcagctccgtggggctcctgctgctcgtcggctcccgaggtcgacctaaagtgtagacactccagatcgacccagtcctccctccacctgtctcgctattacgttagagacagacgtcaccactccaccgtcggccggacctacgtaacgtaaagttacgttagttaccgttcggttcggtacgttaggtatacgacgaacaacgaccgaggacgaacgaccgacccaacgtcctacttactctcgtacgactccgtaccttactacgttcgacgtacggtacgggtacccggtacccgtaccgtaacggtacgacggtaccggacgtacggtacggtacgtacgggtacggtaacgtacgtacgttacccgtaccttaccgactaaccgtacgtacgaaccgtcgtaccncgtaacgctaaccgtcgtacggaacgttcgtaccgtacgttaaacctaacgtttaccgataaccgaacctaagtagtacctagttacgtaggttacgttacgggtacccgtacggaaccgtaacggaactaacgagaacgtaagtaacgacgtacgcgtagtccacgtacnttacgtctacgttacctcg

SEQ ID NO: 162300 - DNA, 670 bp, Homo sapiens
  misc_feature: GYAE6OF02G5A6Z.3.1.A01.1.454.CMB.1.raw
  modified_base (481)..(481): a, c, t, g, unknown or other
  misc_feature (481)..(481): n is a, c, g, or t
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatcgttaggacgacagagtcaccatccacctggccggccagtacaaagtattagtaactcgttgcctggtatcagacaaagaccaggcagacgacccaaagccttaccttatcctctgacttcgcccttacctaatttcgacgtaacgtacgggtccgggtaccccaaccgtaaccggttcacggccgcgacggtgacgttcgagggacaggtaccgttactactccgtaccaacctagtcacgaccgacgccttaggccaccgcgtacgaagtagtcggtacggacctttaaactttacttaccgngtaaccctaacgtagttaactaggttaatttaacggtttagttacggggtaaccgtttaccgggaacccgtaaacggggtaacctaagggtaacgtttaaacgaaacttaaaccgaaaaccggttaacgttaggtaccggtacgaacgttacccgtaaccgtaacgtttccgttagtacctttaacccg

SEQ ID NO: 162301 - DNA, 683 bp, Homo sapiens
  misc_feature: GYAE6OF02F3A7D.3.1.A01.1.454.CMB.1.raw
tcagagacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtcctgcattctttaggacgactagagtccaccatcacctgccgggccagtcaaagtattacgtaactcgttgcctgtatcagcaaacgccaggcagacgaccccaaagtcctccttacgtctcgtagtactcgtcctacctaagtttcgccaacgtacggtccggggtacccctaaccgtaacgttccgacggccgtacgtacggtacggactaccggtacgggaactacggtaacgtttaccgtaaccctcccgtacaacccgtactaccgtaacgacgaccggtacccttcggaccgtacgccgttacggaaccggtagtcggtcgggttaaccctaaactttacgttaacctacgacccgtaaactacgttacgtagtagttacggtttaagtcgggttaaccgttaaccggaccggtaaacggaaccgtaacgtacggtaactaaacgtaccgaaaacgtacgtacggtacgtacgtcgaccgtaccgtattccgttacgtaccttaccg

SEQ ID NO: 162302 - DNA, 450 bp, Homo sapiens
  misc_feature: GYAE6OF01APO31.4.87.H10.1.454.CMB.1.raw
  modified_base (434)..(434): a, c, t, g, unknown or other
  misc_feature (434)..(434): n is a, c, g, or t
  modified_base (440)..(450): a, c, t, g, unknown or other
  misc_feature (440)..(450): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccagggacagcccccaaactcctcatctatgctaacacattcggccctcaggggtccctgaacggttctctggctccaagtctggcacctcagcctccctggccatcactgggctccaggctgaggatgaggctgattattactgccagtcctatgacagcagcctgagtggttcgggattcggcggagggaccaaactgaccgtcctaagtcagcccaaggctcgcccctcggtcactctcgttccccacctcctctacagtcgctctgagcgggctggcaggcncatagnnnnnnnnnnn

SEQ ID NO: 162303 - DNA, 448 bp, Homo sapiens
  misc_feature: GYAE6OF01D1T9G.4.87.H10.1.454.CMB.1.raw
  modified_base (431)..(431): a, c, t, g, unknown or other
  misc_feature (431)..(431): n is a, c, g, or t
  modified_base (437)..(448): a, c, t, g, unknown or other
  misc_feature (437)..(448): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccagggacagcccccaaactcctcatctatgctaacaacattcggccctcaggggtccctgaacggttctctggctccaagtctggcacctcagcctccctggccatcactgggctccaggctgaggatgaggctgattatactgccagtcctatgacagcagcctgagtggttcggattcggcgaggacaaactgaccgtctaagtcagcccaaggctgcccctggtcactctcgttcccgccctcctcctacagtcgctctgacgcgggctggcaagggcncatagnnnnnnnnnnnn

SEQ ID NO: 162304 - DNA, 443 bp, Homo sapiens
  misc_feature: GYAE6OF01DJ8KJ.4.87.H10.1.454.CMB.1.raw
  modified_base (437)..(443): a, c, t, g, unknown or other
  misc_feature (437)..(443): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccagggacagcccccaaactcctcatctatgctaacaacattcggccctcaggggtccctgaacggttctctggctccaagtctggcacctcagcctccctggccatcactgggctccaggctgaggatgaggctgattattactgccagtcctatgacagcagcctgagtggttcgggattcggcggagggaccaaacgtgaccgtctaagtcagcccaaggctgcccctggtcactctgttcccgcctcctcctacagtgctctgagcggctggcaaggcgcatagnnnnnnn

SEQ ID NO: 162305 - DNA, 454 bp, Homo sapiens
  misc_feature: GYAE6OF01BYKRW.4.87.H10.1.454.CMB.1.raw
  modified_base (442)..(454): a, c, t, g, unknown or other
  misc_feature (442)..(454): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccagggacagcccccaaatcctcatctatgctaacaacattcggccctcaggggtcccctgaacggttctctggctccaagtctggcacctcagcctccctggccatcactggctccaggctgagatgaggctgattatactgccagtcctatgacagcagcctgagtggttcgggattcggcggagggaccaaacgtgaccgtcctaagtcagcccaaggctcgcccctggtcactctcgttcccgccctcctccctacagtgcctctgacgcgggctggcaaggcgcatagnnnnnnnnnnnnn

SEQ ID NO: 162306 - DNA, 454 bp, Homo sapiens
  misc_feature: GYAE6OF01CAWWJ.4.87.H10.1.454.CMB.1.raw
  modified_base (415)..(415): a, c, t, g, unknown or other
  misc_feature (415)..(415): n is a, c, g, or t
  modified_base (438)..(438): a, c, t, g, unknown or other
  misc_feature (438)..(438): n is a, c, g, or t
  modified_base (445)..(454): a, c, t, g, unknown or other
  misc_feature (445)..(454): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccagggacagcccccaaactcctcatctatgctaacaacattcggccctcaggggtccctgaacggttctctggctccaagtctggcacctcagcctccctggccatcactgggctccaggctgaggatgaggctgattattactgccagtcctatgacagcagcctgagtggttcgggattcggcggagggaccaaacgtgaccgtctaagtcagcccaaggctcgcccctggtcactctcgttccccaccctcctcctacagtcnctctgacgcgggctggcaaggcncatagcnnnnnnnnnn

SEQ ID NO: 162307 - DNA, 615 bp, Homo sapiens
  misc_feature: GYAE6OF01CFAV9.4.87.H10.1.454.CMB.1.raw
  modified_base (276)..(276): a, c, t, g, unknown or other
  misc_feature (276)..(276): n is a, c, g, or t
  modified_base (311)..(311): a, c, t, g, unknown or other
  misc_feature (311)..(311): n is a, c, g, or t
  modified_base (338)..(338): a, c, t, g, unknown or other
  misc_feature (338)..(338): n is a, c, g, or t
  modified_base (590)..(593): a, c, t, g, unknown or other
  misc_feature (590)..(593): n is a, c, g, or t
  modified_base (595)..(595): a, c, t, g, unknown or other
  misc_feature (595)..(595): n is a, c, g, or t
  modified_base (597)..(615): a, c, t, g, unknown or other
  misc_feature (597)..(615): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccagggacacgacccccaaatcctcatctatgactaaacaacacttccggcccttcgacgggggtcccctaggtaaccggtttctcgtcggccttaccaagtcgtggcctacctcacgtcccttcccnggccagtcacgtcggcctccgaggctggaggatgngctgtaatttatactgctacgtcctancgacagcagtcctaggtcggttcgggttacgggtagttccggggcgggaacgggaacctaaacgtcggtaacccgtaccttaaggtccgaacgacccgtaaacgggtcctacccggtcccccgttcgggtacctaccgttacctcccgtacccccctaccccttcccgtacccttaccgacgttacgtcccttacgtcggtacgggccgggtacgtcggaaccgaacgggaccgtcgtaacgtacggatgcnnnncncnnnnnnnnnnnnnnnnnnn

SEQ ID NO: 162308 - DNA, 466 bp, Homo sapiens
  misc_feature: GYAE6OF01B165M.4.87.H10.1.454.CMB.1.raw
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (453)..(453): a, c, t, g, unknown or other
  misc_feature (453)..(453): n is a, c, g, or t
  modified_base (455)..(466): a, c, t, g, unknown or other
  misc_feature (455)..(466): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccagggacagcccccaaactcctcatctatgctaaacaacattcggccctcgacggggtccctgaacggttctctggctccaagtctggcacctcacgccctccctggccatcacgtgggctccgaggctggaggatggaggctagatttacttactgcctagtcctatgacagcagctgagtggtcggattcgggaggaggaccaagtcgaccgtctaacgtcacgccaaggcctcgcccctgcactctcgtcccactcctcctctactgtcnctcgngcgcggtcgtcggacgagcgactagngnnnnnnnnnnnn

SEQ ID NO: 162309 - DNA, 473 bp, Homo sapiens
  misc_feature: GYAE6OF01B1ZE7.4.87.H10.1.454.CMB.1.raw
  modified_base (418)..(418): a, c, t, g, unknown or other
  misc_feature (418)..(418): n is a, c, g, or t
  modified_base (458)..(473): a, c, t, g, unknown or other
  misc_feature (458)..(473): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccaggggacagccccccaaactcctcatctatgctaacaacattcggccctcaggggtccctgaacggttctctggctccaagtctggccacctcagccctccctggccatcactgggctccaggctgaggatgaggctgattattactgccagtcctatgacagcagcctgagtggttcgggattcggcggaggaccaaacgtcgaccgtctaagtcacgcccaggctcgccccctggtccactctccgttcccgcccctcctcctacngtcgcctcgtgcggcgggctcggcgaacggcgacagtagnnnnnnnnnnnnnnnn

SEQ ID NO: 162310 - DNA, 454 bp, Homo sapiens
  misc_feature: GYAE6OF01DUR2R.4.87.H10.1.454.CMB.1.raw
  modified_base (448)..(454): a, c, t, g, unknown or other
  misc_feature (448)..(454): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccagggacagcccccaaatcctcatctatgctaacaacattcggccctcaggggtccctgaacggttctctggctccaagtctggcacctcagcctccctggccatcactgggctccaggctgaggatgaggctgatttattactgccagtcctatgacagcagcctgagtggttcgggattcggcggagggaccaaacgtgaccgtcctaaagtcagcccaaggctcgccccctggtccactctcgttccccgccctcctcctacacgtgctctgacgcgggctggcaaggcgcatagnnnnnnn

SEQ ID NO: 162311 - DNA, 613 bp, Homo sapiens
  misc_feature: GYAE6OF01DPK17.4.87.H10.1.454.CMB.1.raw
  modified_base (581)..(581): a, c, t, g, unknown or other
  misc_feature (581)..(581): n is a, c, g, or t
  modified_base (585)..(586): a, c, t, g, unknown or other
  misc_feature (585)..(586): n is a, c, g, or t
  modified_base (589)..(590): a, c, t, g, unknown or other
  misc_feature (589)..(590): n is a, c, g, or t
  modified_base (592)..(594): a, c, t, g, unknown or other
  misc_feature (592)..(594): n is a, c, g, or t
  modified_base (596)..(603): a, c, t, g, unknown or other
  misc_feature (596)..(603): n is a, c, g, or t
  modified_base (605)..(613): a, c, t, g, unknown or other
  misc_feature (605)..(613): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccgagggacacgcccccaaaactcctcatctatgactaacaacattcggccctcgaggggtccctgaacggttctctggctccaagtcgtcgccacctcaccgtccctccgtcggcctatccacgtcgggccttaccgaggcgtaggaaggatggaacggtctagttactttaacgttacgtcgccgtacgtacctagtcgaacgcgcacgtcgtggtaggtcgggttcgggtacgttcgggacggaacggaacctacgcgtacccggtactaacggtccaacgacccgacggtcctcccgtacccccgttggtacctaccgttcccttaccgttaccccctacccttcccttaccgtaacgtacggttccgccgttcggtacggacgggtccgggtcgtacgggacggtaacgggccgtaacgtacgacgtnacgnngcnncnnncnnnnnnnncnnnnnnnnn

SEQ ID NO: 162312 - DNA, 535 bp, Homo sapiens
  misc_feature: GYAE6OF01B7HW5.4.87.H10.1.454.CMB.1.raw
  modified_base (253)..(253): a, c, t, g, unknown or other
  misc_feature (253)..(253): n is a, c, g, or t
  modified_base (309)..(309): a, c, t, g, unknown or other
  misc_feature (309)..(309): n is a, c, g, or t
  modified_base (510)..(535): a, c, t, g, unknown or other
  misc_feature (510)..(535): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccagggacacgcccccaaactcctcatctatgctaaacaacattcggccctcgaggggtccctgaacggttctctggctccaagtctggcacctcacgcctcccnggccatcactggctccagctgagatgagctgattatactgccagtcctagtcgacngcagcctggagtggttacgggagttcgggacggaacggaacctaaacgtcggacccgtacgtaaagtccgacggacccaaggcctaccggcccccgttcggtaccaccgttcccgtccggttcccccgtccccttacctacccgtacgtacgtccgccttcgtcggacggccgggctcgggacgtaaggccactagtagcnnnnnnnnnnnnnnnnnnnnnnnnnn

SEQ ID NO: 162313 - DNA, 549 bp, Homo sapiens
  misc_feature: GYAE6OF01C86LU.4.87.H10.1.454.CMB.1.raw
  modified_base (530)..(530): a, c, t, g, unknown or other
  misc_feature (530)..(530): n is a, c, g, or t
  modified_base (532)..(549): a, c, t, g, unknown or other
  misc_feature (532)..(549): n is a, c, g, or t
tcagagcactgtagcacgaccggtgctcgatttagcagtactgcgttgggtttgggggctgtccccagggcagagggtcgccatctcctgcactgggagcagctccaacatcgggggcaggttatggcgtacagtggtaccagcagcttccagggacacgccccccaaactcctcatctatgctaacaacattccggccctcgaggggtccctgacgttctctgctccagtctgcacctcacgcctcctggccatcacgtgggcctccgaggctggagatgagctgattatactgcctagtcctatagacagcacgtctggaggttgggttcgggagttcgggcgggtaacggggaaccaaacgtcggtaacccgtacgtaagtccaacggccccgaaaggtcctccggtccccccgtacggtcctaacttccccgttccgttccccctacccccttcccctacccttaccgacggttacgccttcgtagaccgggtccggcgttacggacgaacgggctacgaagtagncnnnnnnnnnnnnnnnnnn

SEQ ID NO: 162314 - DNA, 567 bp, Homo sapiens
  misc_feature: GYAE6OF01BEAS0.4.87.H10.1.454.CMB.1.raw
  modified_base (317)..(317): a, c, t, g, unknown or other
  misc_feature (317)..(317): n is a, c, g, or t
  modified_base (540)..(540): a, c, t, g, unknown or other
  misc_feature (540)..(540): n is a, c, g, or t
  modified_base (542)..(543): a, c, t, g, unknown or other
  misc_feature (542)..(543): n is a, c, g, or t
  modified_base (545)..(547): a, c, t, g, unknown or other
  misc_feature (545)..(547): n is a, c, g, or t
  modified_base (549)..(552): a, c, t, g, unknown or other
  misc_feature (549)..(552): n is a, c, g, or t
  modified_base (554)..(567): a, c, t, g, unknown or other
  misc_feature (554)..(567): n is a, c, g, or t
tcagagcactgtagcacgaccggtgctcgatttagcagtactgcgttggggtttgggggctgtccccagggcagagggtcgccatctcctgcactgggagcagctccaacatcggggcaggttatggcgtacagtggtaccagcagcttccagggacacgcccccaaactcctcatctatgctaaacaacattccggccctcgacggggtccctggaacggttctctggctccaagtctggccacctcacgccctccctggccatccactgggcctccgaggctgaggatgaggctgtattatctgcctagtcctangacagcagcctggaggttgggttcgggagttcggggacggacgggaaccaaacgtcgaacccgtcgtaagtccacgaccccgaaggcctccggccccctcggtcctaccgttccgttcccgtccccccgtccccttcccgttaccctaccgtacgttcgcccgttacgtgggacggtccgggtacgtcgggaccggtaacgggcccgtagaaacgtgcgtacngnngnnncnnnngnnnnnnnnnnnnnn

SEQ ID NO: 162315 - DNA, 627 bp, Homo sapiens
  misc_feature: GYAE6OF01C6K6H.4.87.H10.1.454.CMB.1.raw
  modified_base (358)..(358): a, c, t, g, unknown or other
  misc_feature (358)..(358): n is a, c, g, or t
  modified_base (600)..(600): a, c, t, g, unknown or other
  misc_feature (600)..(600): n is a, c, g, or t
  modified_base (603)..(627): a, c, t, g, unknown or other
  misc_feature (603)..(627): n is a, c, g, or t
tcagagcactgtagcacgaccggtgctcgatttagcagtactgcggtttggggtttgggggctgtccccagggcagagggtcgccatctcctgcactgggagcagctccaaacagtcggggcaggttatggcgtacagtggtaccagcagctccagggacacgcccccaaactcctcatctatgactaacaacattcggccctgacggggtccctaggaaccggtttctcgtcggacctaccgaaagttccgtagggcctaccctcacggtccccttccccgtggaccagttccacggtcggggtcctccggagggtctagggacggtagtggacggtctaggtatttaacgttaccngacctagttacctaagtcgaacgagacgtcgccgtaggtacggttgggttacgggagttcgggacggaacgggaaacccaaagtcgtaaccgtactaaggcaccggtaccaacgggtccttccggaccccgtggtacctaccgtccgttcccggttcccccgcccttaccccgtcccttacggactcgtacctcgtagggccgggcggttcgacgggaccacgggccgaccgtagacggtcngtnnnnnnnnnnnnnnnnnnnnnnnnn

SEQ ID NO: 162316 - DNA, 520 bp, Homo sapiens
  misc_feature: GYAE6OF01EC0XI.4.87.H10.1.454.CMB.1.raw
  modified_base (176)..(176): a, c, t, g, unknown or other
  misc_feature (176)..(176): n is a, c, g, or t
  modified_base (182)..(182): a, c, t, g, unknown or other
  misc_feature (182)..(182): n is a, c, g, or t
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (427)..(427): a, c, t, g, unknown or other
  misc_feature (427)..(427): n is a, c, g, or t
  modified_base (462)..(462): a, c, t, g, unknown or other
  misc_feature (462)..(462): n is a, c, g, or t
  modified_base (467)..(467): a, c, t, g, unknown or other
  misc_feature (467)..(467): n is a, c, g, or t
  modified_base (494)..(494): a, c, t, g, unknown or other
  misc_feature (494)..(494): n is a, c, g, or t
  modified_base (498)..(520): a, c, t, g, unknown or other
  misc_feature (498)..(520): n is a, c, g, or t
tcagagcactgtagcacgaccggtgctcgatttagcagtactgcgttgggtttgggggctgtccccagggcagagggtcgccatctcctgcactgggagcagctccaacagtcggggcaggttatggcgtacagtggtaccagcagcttccgagggacacgacccccaaactcctnatctangactaaacaactattccggccctcgacggggtccctggtaacggttctctggcctccaagtcgtgccaccncacgccctccgtggcctatcgactggctccgaggctgagntgagntgatttatcgtcgctagtcctagcgacagcagtccgtgaggttcgggtcggtagtcgggacggacggtaccaaacgtcgaaccgtacgtaacgtcgacgacccgtaggcctaccggtccccgtgtaccncctcgtcccgttcccgccctccgtcctacgcgtcncgtcncggtcgcggcgtacgacgaggcactanagcnnnnnnnnnnnnnnnnnnnnnnn

SEQ ID NO: 162317 - DNA, 459 bp, Homo sapiens
  misc_feature: GYAE6OF02I144C.4.87.H10.1.454.CMB.1.raw
  modified_base (414)..(414): a, c, t, g, unknown or other
  misc_feature (414)..(414): n is a, c, g, or t
  modified_base (446)..(459): a, c, t, g, unknown or other
  misc_feature (446)..(459): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccagggacagcccccaaactcctcatctatgctaacaacattcggccctcaggggtcccctgaacggttctctggctccaagtctggcacctcagccctccctggccatcactgggctccaggctgaggatgaggctgattattactgccagtcctatgacagcagcctgagtggttcgggattcggcggagggaccaaactgaccgtcctaagtcagcccaaggctgccccctgtcactctgttccccaccctcctcctacagtncctctgagcgggctggccaaggcgcagtacgnnnnnnnnnnnnnn

SEQ ID NO: 162318 - DNA, 452 bp, Homo sapiens
  misc_feature: GYAE6OF02GP0EC.4.87.H10.1.454.CMB.1.raw
  modified_base (443)..(452): a, c, t, g, unknown or other
  misc_feature (443)..(452): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccagggacagcccccaaactcctcatctatgctaacaacattcggccctcaggggtccctgaacggttctctggctccaagtctggcacctcagcctccctggccatcactgggctccaggctgaggatgaggctgattattactgccagtcctatgacagcagcctgagtggttcgggattcggcggagggaccaaactgaccgtctaagtcagcccaaggctcgcccctggtcactctgttccccaccctcctcctacacgtcgctctgacgcgggtctggcaggcgcatagnnnnnnnnnn

SEQ ID NO: 162319 - DNA, 446 bp, Homo sapiens
  misc_feature: GYAE6OF02GK6GH.4.87.H10.1.454.CMB.1.raw
  modified_base (439)..(446): a, c, t, g, unknown or other
  misc_feature (439)..(446): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccagggacagcccccaaactcctcatctatgctaacaacattcggccctcaggggtccctgaacggttctctggctccaagtctggcacctcagcctccctggccatcactgggctccaggctgaggatgaggctgattattactgccagtcctatgacagcagcctgagtggtcgggattcggcggagggaccaaactgaccgtctaagtcagcccaaggctgcccctggtcactctgttccccgccctcctcctacagtcgctctgagcgggctggcaaggcgcatagnnnnnnnn

SEQ ID NO: 162320 - DNA, 475 bp, Homo sapiens
  misc_feature: GYAE6OF02JVRF2.4.87.H10.1.454.CMB.1.raw
  modified_base (448)..(448): a, c, t, g, unknown or other
  misc_feature (448)..(448): n is a, c, g, or t
  modified_base (451)..(475): a, c, t, g, unknown or other
  misc_feature (451)..(475): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccagggacagcccccaaatcctcatctatgctaacaacattcggccctcaggggtccctgaacggttctctggctccaagtctggcacctcagcctccctggccatcactgggctccaggctgaggatgaggctgattatactgccagtcctatgacagcagcctgagtggtcggattcggcggaggaccaaatgaccgtctaagtcagcccaaggcctcgcccctgcactctcgttccccaccctcctcctacacgtcgcctcgtgacgccgggctcgggcaacgggtccgacagtagntcnnnnnnnnnnnnnnnnnnnnnnnnn

SEQ ID NO: 162321 - DNA, 464 bp, Homo sapiens
  misc_feature: GYAE6OF02F89VP.4.87.H10.1.454.CMB.1.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (412)..(412): a, c, t, g, unknown or other
  misc_feature (412)..(412): n is a, c, g, or t
  modified_base (425)..(425): a, c, t, g, unknown or other
  misc_feature (425)..(425): n is a, c, g, or t
  modified_base (439)..(464): a, c, t, g, unknown or other
  misc_feature (439)..(464): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccagggacagcccccaaactcctcatctatgctaacacattcggccctcaggggtccctgaacggtttcnctggctccaagtcnggcacctcagcctccctggccatcactgggctccaggctgagatgagctgattattactgccagtcctatgacagcagcctgagttggtcggattcgggcggagggaccaaacgtcgaccgtctaagtcacgcccaaggcctcgcccctgtcactctcgtcccgcctcctctacacgtcnctctgacgcggcncggcaggcgcatannnnnnnnnnnnnnnnnnnnnnnnnn

SEQ ID NO: 162322 - DNA, 657 bp, Homo sapiens
  misc_feature: GYAE6OF02J3BRN.4.87.H10.1.454.CMB.1.raw
  modified_base (250)..(250): a, c, t, g, unknown or other
  misc_feature (250)..(250): n is a, c, g, or t
  modified_base (331)..(331): a, c, t, g, unknown or other
  misc_feature (331)..(331): n is a, c, g, or t
  modified_base (625)..(625): a, c, t, g, unknown or other
  misc_feature (625)..(625): n is a, c, g, or t
  modified_base (630)..(630): a, c, t, g, unknown or other
  misc_feature (630)..(630): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
  modified_base (638)..(657): a, c, t, g, unknown or other
  misc_feature (638)..(657): n is a, c, g, or t
tcagagcactgtagcacgaccggtgctcgatttagcagtactgcgttgggtttgggggcgtgtccccagggcagagggtcgccatctcctgcactgggagcagctccaacatcggggcaggttatggcgtacagtggtaccagcagcttccgagggacacgcccccaaactcctcatctatgactaacaactattccggaccctcaggggtcccctgaaccggtttctcgtgcctcaagtctggcacctncgcctccctgcactcactcggctccgaggctcgaggatcgaggctcgtaattagtactcgacctacgtcctaatcgaaccnggaccacgtccgttaggtaacggtttcggggttacggggtacgtttaccggggacgggtaacgggaaaccgaaaccgttacggtaacccggttaaccctaaaggttccaacgggtaccccgaaacggggtcccttacccgggtaccccccgttggtaccccgtaccgttacccgttcccgtttcccccggacccctttacccgttcccgttaaccgtacggtttccgccttacggtaccggtaacggtcccggggtcgtaccgggtccggaaacgggccgtacgaacgtaacgntacgngagncncnnnnnnnnnnnnnnnnnnnn

SEQ ID NO: 162323 - DNA, 492 bp, Homo sapiens
  misc_feature: GYAE6OF02GJGII.4.87.H10.1.454.CMB.1.raw
  modified_base (384)..(384): a, c, t, g, unknown or other
  misc_feature (384)..(384): n is a, c, g, or t
  modified_base (452)..(452): a, c, t, g, unknown or other
  misc_feature (452)..(452): n is a, c, g, or t
  modified_base (460)..(460): a, c, t, g, unknown or other
  misc_feature (460)..(460): n is a, c, g, or t
  modified_base (465)..(466): a, c, t, g, unknown or other
  misc_feature (465)..(466): n is a, c, g, or t
  modified_base (472)..(473): a, c, t, g, unknown or other
  misc_feature (472)..(473): n is a, c, g, or t
  modified_base (476)..(476): a, c, t, g, unknown or other
  misc_feature (476)..(476): n is a, c, g, or t
  modified_base (478)..(479): a, c, t, g, unknown or other
  misc_feature (478)..(479): n is a, c, g, or t
  modified_base (481)..(483): a, c, t, g, unknown or other
  misc_feature (481)..(483): n is a, c, g, or t
  modified_base (485)..(488): a, c, t, g, unknown or other
  misc_feature (485)..(488): n is a, c, g, or t
  modified_base (490)..(492): a, c, t, g, unknown or other
  misc_feature (490)..(492): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccagggacagcccccaaactcctcatctatgctaacaacattcggccctcaggggtccctgaacggttctctggctcaagtctggcacctcagcctcctggccatcactgggctccaggctgaggatgaggctgattatactgccagtcctatcgacagcagcctgagtgggttcggattcggcggaggaccaaactcgaccgtcctaagtcagcccaaggcctcgcccctggtcnctctcgttccccaccctcctctacgagtcgcctcgtggacgcgggtctggaccaaggccgcagtacgngtcacgtngctannctgacnncgncnncnnncnnnncnnn

SEQ ID NO: 162324 - DNA, 693 bp, Homo sapiens
  misc_feature: GYAE6OF02IE9I8.4.87.H10.1.454.CMB.1.raw
  modified_base (649)..(649): a, c, t, g, unknown or other
  misc_feature (649)..(649): n is a, c, g, or t
  modified_base (663)..(663): a, c, t, g, unknown or other
  misc_feature (663)..(663): n is a, c, g, or t
  modified_base (672)..(672): a, c, t, g, unknown or other
  misc_feature (672)..(672): n is a, c, g, or t
  modified_base (674)..(674): a, c, t, g, unknown or other
  misc_feature (674)..(674): n is a, c, g, or t
  modified_base (680)..(680): a, c, t, g, unknown or other
  misc_feature (680)..(680): n is a, c, g, or t
  modified_base (684)..(684): a, c, t, g, unknown or other
  misc_feature (684)..(684): n is a, c, g, or t
  modified_base (687)..(687): a, c, t, g, unknown or other
  misc_feature (687)..(687): n is a, c, g, or t
  modified_base (690)..(692): a, c, t, g, unknown or other
  misc_feature (690)..(692): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccgagggacacgcccccaaactcctcatctatgctaacaacattcggcctcgacggggtccctgaacggttctctggctcaagtctgcacctcacgcctccctggccatccacgtcgggctccgagtcgtggaggatggaggcttgtaattttacgttactcggaccctacggttacctagtacgaaccacggtctaaccgtccgttggtagggttcggggtttaacgggtaggttccggggacgggtaaaccggggtaaccctaaaaccggttcgggtaaccccggtttaccgttaaacggtacccgaaccggtacccggtaaacgggtcccgttaccccgtccccccggtttccgggtacctacccgttttcccgtacccgtttaccccccgaacccccgtttcccgtacccttaaaccgtacggttccgtacccgttcggttacggaacgggtccggggtcgttacggaacgtaaccgggccgtacacgtagcgtcgntcacgctagcgcgncgctgctcncnctgtcncgcncgngcnnnc

SEQ ID NO: 162325 - DNA, 613 bp, Homo sapiens
  misc_feature: GYAE6OF02G5Z5Q.4.87.H10.1.454.CMB.1.raw
  modified_base (218)..(218): a, c, t, g, unknown or other
  misc_feature (218)..(218): n is a, c, g, or t
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
  modified_base (574)..(574): a, c, t, g, unknown or other
  misc_feature (574)..(574): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
  modified_base (582)..(583): a, c, t, g, unknown or other
  misc_feature (582)..(583): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (593)..(594): a, c, t, g, unknown or other
  misc_feature (593)..(594): n is a, c, g, or t
  modified_base (597)..(597): a, c, t, g, unknown or other
  misc_feature (597)..(597): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (605)..(606): a, c, t, g, unknown or other
  misc_feature (605)..(606): n is a, c, g, or t
  modified_base (608)..(613): a, c, t, g, unknown or other
  misc_feature (608)..(613): n is a, c, g, or t
tcagagcactgtagcacgaccggtgctcgatttagcagtactgcgttgggtttgggggctgtccccagggcagagggtcgccatctcctgcactgggagcagctccaacatcggggcaggttatggcgtacagtggtaccagcagcttccagggacagcccccaaactcctcatctatgctaacaacattcggccctcaggggtccctgacgttctcngctcagtctgcactcagcctcctgcatcactggctcnggctgagntgagctgattattcngccagtcctatcgacngcacgccgtggtacggttgggttacgggtacgttcggggaccggacgggtaaccaaacggtcggaacccgttaccgtaacgccgtaacgaccccgaaagggtccctaccggtcccccccgttcgggtaccctacccgtccgtttacccgggtttccccccgtcccccgttaccccttacccgttaaccgtacgggtttacccgtcccgttccggttaacgggcggggtcccggggacgttccgggggtaaccaaacgggggtccgacgtacggttacggngcgncncnncgcgngngcnngcncgcncngnncnnnnnn

SEQ ID NO: 162326 - DNA, 520 bp, Homo sapiens
  misc_feature: GYAE6OF01BX5GY.11.74.G08.1.454.CMB.1.raw
  modified_base (296)..(296): a, c, t, g, unknown or other
  misc_feature (296)..(296): n is a, c, g, or t
  modified_base (357)..(357): a, c, t, g, unknown or other
  misc_feature (357)..(357): n is a, c, g, or t
tcagcgagagataccacgaccggtgctcgatttagtagctctatcaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacattggtgttataactatgtctcctggtaccaacaacaccagacaaacgcccccaaatcatgatttangaggtcactaagcggccctcgaggggtccctgatcgcttctctggctccagtctggcaacncggcctcctgaccgtctcgtgggcctccgaggtctggacgatgaggctgtattattattgcagctacatatgacaggcagcacctaagtttggtgttcgggcggtacggaccagccgtgacccgtcgtaggtcacgtacccaggcctccgccccgtggtaccc

SEQ ID NO: 162327 - DNA, 593 bp, Homo sapiens
  misc_feature: GYAE6OF01DQGUO.11.74.G08.1.454.CMB.1.raw
tcagcgagagataccacgaccggtgctcgatttagtagctctatcgaggggggggtctcaggaggcagcgctctcaggacgtcaccaccatggcctgggctctgctcctcctcagcctcctcactcagggcacgagggtcctgggcccagtctgccctgactcagccctccctccgcgtccgggtctcctggacagtcagtccaccatcctcctgcactggaacccagcagtgactagttggtagttataactatgtctctcggtaccaacaacacccagacaaacgaccccaaatcatgtatttatagaggtacactaagccggccctcgacggggtccctgactcgtcttctctgctcgaagtctacgcaacgacggccctcctcgaccgtctcgtcgggctccgaggtcctagacgtagtgaggtctagtatttattagttgctagctacaatgtgacgacgcgtacgacctaccgttaagtttcggtaggttaccgggacgggacggtaaccgaaggtccgttacggacccggttccgacggttcgaaccgtacccggaacggtccctccgtccccccggtcgtccccg

SEQ ID NO: 162328 - DNA, 583 bp, Homo sapiens
  misc_feature: GYAE6OF01CUK8E.11.74.G08.1.454.CMB.1.raw
  modified_base (307)..(307): a, c, t, g, unknown or other
  misc_feature (307)..(307): n is a, c, g, or t
  modified_base (436)..(436): a, c, t, g, unknown or other
  misc_feature (436)..(436): n is a, c, g, or t
tcagcgagagataccacgaccggtgctcgatttagtagctctatcgaggggggggtctcaggaggcagcgctctcaggacgtcaccaccatggcctgggctctgctcctcctcagcctcctcactcagggcacgagggtcctgggcccagtctgccctgactcagcctccctccacgtccgggtctcctggacagtcagtcaccatcctctgcactggaaccagctagtgactagttggtagttataacgtatgtctcgtcgtaaccaacaacacccaagacaaaacgccccaaatcatgtatttangaggtcacgtaacgcgccctcgacgggtccctgactccgtcttctcgtgcctacgagtcgtggacaaccgccgtccctcctcgaccgtctcgtggcctcgagtccgtgacgagtgagtctgtattattnttgctagtctactagtatgacgagacgtacgacctacgttaacgtttggtacggttccgggaacgggtaccggaacacggtccgtacgtacccggtacggtacgtaccgagtacccgaacgtcccgtaccgcccccgtcggtacccg

SEQ ID NO: 162329 - DNA, 709 bp, Homo sapiens
  misc_feature: GYAE6OF01BTI1A.11.74.G08.1.454.CMB.1.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
tcagcgagagataccacgaccggtgctcgatttagtagctctatcgaggggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtccaccatcctcctgcactggaaccngcagtnactagttggtaggtttaanaacttatgttcctccgtaggtaaccaaacaaccacccaagaaccaaaccgacccccaaactcaatacgtaatttaacgtggacggtacaacgtaacgcccggtccctacggacgggtccctagtatccgtcttccgtcgtcgtcctaccgaacgttcgtcggtaccaaaccgccggtccctacccgtcgtacccgtctccggtcggtaccgtccgacggtcgttacgaacggtagtaggaacggtccttaggttaactttaagttttacgtacggtaccgtacgtaccgtactaacgttacgttacgacgttaacggacgaacgtaccgttaacgtaaggtttcgggttacggttacgggaccggggtaacgaaccgtaggtaccgtacggtacccggttccctaacgggtccaaccggacccggtaaacggtcccgttcccggtcccccgtcggtacccg

SEQ ID NO: 162330 - DNA, 705 bp, Homo sapiens
  misc_feature: GYAE6OF01DZEPF.11.74.G08.1.454.CMB.1.raw
  modified_base (687)..(687): a, c, t, g, unknown or other
  misc_feature (687)..(687): n is a, c, g, or t
tcagcgagagataccacgaccggtgctcgatttagtagctctatcgaggggggggggtctcaggaggcagcgctctcaggacgtcaccaccatggcctgggctctgctcctcctcagcctcctcactcgagggcacagggtcctgggcccagtctgccctgactcacgcctccctccggccggttcccgggtctccgtggacacgtcacgtccaccactcctcctgctacgtacggaaccagcagtgaactagtttcgggttagtttaactaacttagttcgtcttccgtacggtaaccaaacaaaccaccgaacgaaccaaaccgacccccaaaacgtctaacgttagttatttacgtacggaacggtacaacgtaacggccggtccgtacggtacggggtcctagtactcgtcttctcgtcgtctacgagtcgacgacgaaccgtaccgcccttcccgtacgtacccgtcttccggttacggcccgttacgacgggttcgtacggaacggtagttacgggaacggtcttaacggtttaacttttacgttacggttctacgtacggtacttacgtaagtagtcgaacgcggtacgacgtactaacggtttacgttcggggttacggtcggacgggacgaacggactcggtaccgtcggtacgccggtacaccggaccgacgtaccncccggtcccgtggtaccc

SEQ ID NO: 162331 - DNA, 592 bp, Homo sapiens
  misc_feature: GYAE6OF02G01KE.11.74.G08.1.454.CMB.1.raw
tcagcgagagataccacgaccggtgctcgatttagtagctctatcagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctctgcactggaaccagcagtgactattgggtagttataactatgtctcctgtaccaacaacaccagacaaacgccccaaactcatagattatgaggtcactaagccggcctcgacggggtccctgatccgtcttctctcggcctaccaagttctcggacaaaccgccggtccctcccgtacgacccgtctcgtcgggtcctaccgtacggctacgacgagtgaggctagtattattatttgactagtctactatatcgacaggacacgactaacgtaagtttcggttcggttacgggacgggacgggaaccgaaggtccgtacggtacccgtccgtacggtaccgacggtacccgaacggtccgtaccgtcccccgtaggtacccg

SEQ ID NO: 162332 - DNA, 720 bp, Homo sapiens
  misc_feature: GYAE6OF02HZUOU.11.74.G08.1.454.CMB.1.raw
tcagcgagagataccacgaccggtgctcgatttagtagctctatcagggggggggtctcaggaggcagcgctctcaggacgtcaccaccatggcctgggctctgctcctcctcagtcctcctcacctcgagggcaaccgaggggtcccttacggggcccagtcctcgcccctgacctcacgcctcccgtccggcgttccgggtcctccgtaggactagtcacgtcacctactctccgtcgctactacggaaccagcagtcgactgttggtagttaatactatcgtctccgtacggtaccaacgaaccaccaacgaaccaaaccgaccccaaacttccgattagtattacgtggtaacgtactaacgtaaccggtccggacctacggcgggttacccaggtaccgtccgttcttacgtcgtaccgtccgttaacgacgtcgtacgaccaacgaccgtaccctccgtaccggtacctcggtcggtcggtctacccggtgcgtacgaacgttcgtcgtaggtctacggtttatttatacggttcactaacggtctaagttgtaactacggcgaacgtcaaacggtccgtaacgtttaaggttcggtcggtaacgggaccgggaacgtaaccgggtacgtaccggttacccgacgggtttccgtaaacgtccgtaccgggtacccgttacgaacccggttccccggtacccgttcccggtaccg

SEQ ID NO: 162333 - DNA, 510 bp, Homo sapiens
  misc_feature: GYAE6OF01DV67E.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctccggctacaatgcagggacaacagtcacgttgaccatcagtggagtccaggcagaagacgaggctgactatcactgccactcagcggacctcagtggtaggtgggtgttcgggcggagggaccaaggttggaccgtcctaggtcagcccaaggctgccccctcggtcacgtccg

SEQ ID NO: 162334 - DNA, 531 bp, Homo sapiens
  misc_feature: GYAE6OF01BU3GD.33.78.H01.1.454.CMB.1.raw
tcagtacacacactcacgaccggtgctcgatttagtgtgagtagtttgggtttgggggtccaggaggcagaactctgggtgtctcaccatggcctggatccctctacttcctcccctcctcactctctgcacaggctctgcggcctcctacgagctgacacagccaccgtcggtttctgtgtcactgggacagacggccaggatcacctgctctggagatgcattgccaaaagcaaatacgcttattggtaccagcagaagccaggccaggcccctgtactgataatatacaaagagaatgagaggccctcagggatccctgagcgattctccggctacaatgcagggacaacagtcacgttgaccatcagtgagtccaggcagaagacgaggctgactatcactgccactcagcggactcgagtggtaggtgggtgttcgggcggtagggaccgtaaggttcgaccgttaccgtagggtccaggcccgaaggcgtcgccccctggtccaccttctcgttccccgtccccg

SEQ ID NO: 162335 - DNA, 527 bp, Homo sapiens
  misc_feature: GYAE6OF01DPJ5Z.33.78.H01.1.454.CMB.1.raw
  modified_base (373)..(373): a, c, t, g, unknown or other
  misc_feature (373)..(373): n is a, c, g, or t
  modified_base (502)..(502): a, c, t, g, unknown or other
  misc_feature (502)..(502): n is a, c, g, or t
  modified_base (514)..(514): a, c, t, g, unknown or other
  misc_feature (514)..(514): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaaagagaatgagaggccctcgagggatcccgtgagcgattcgtccggctaacaatcgacagggaacaacagtcacgttnaccatcagtggacgtacgaggacaagaagacgaggctagactatcactgccactcagcgacctacgaggtggtaggtgggtgttcgggcggaggacctaggtcgaccgtcgtaggcacggcccaaggcncgcccctcgacnctcgtcgtccccg

SEQ ID NO: 162336 - DNA, 510 bp, Homo sapiens
  misc_feature: GYAE6OF01AK81L.33.78.H01.1.454.CMB.1.raw
  modified_base (504)..(504): a, c, t, g, unknown or other
  misc_feature (504)..(504): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctccggctacaatgcagggacaacagtcacgttgaccatcagtggagtccaggcagaagacgaggctgactatcactgccactcagcgacctcagtggtaggtgggtgttcggcggagggaccaaggttcgaccgtcgtaggtccagcccaaggctcgccccctcggtcncgtccg

SEQ ID NO: 162337 - DNA, 524 bp, Homo sapiens
  misc_feature: GYAE6OF01DG0TL.33.78.H01.1.454.CMB.1.raw
  modified_base (309)..(309): a, c, t, g, unknown or other
  misc_feature (309)..(309): n is a, c, g, or t
tcagtacacacactcacgaccggtgctcgatttagtgtgagtagtttgggtttggggggtccaggaggcagaactctgggtgtctcaccatggcctggatccctctacttctcccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctnagggatccctgagcgattctccggctacaatgcagggacaacagtcacgttgaccatcagtggagtccaggcagaagacgaggctgactatcactcgccactcacgccggacctcgagtggtaggtgggttgttcgggcggagggaccaaggttcgaccgtcgtaggtcagcccgaaggcctcgccccctcggtccacttctcgttcccgtcccc

SEQ ID NO: 162338 - DNA, 524 bp, Homo sapiens
  misc_feature: GYAE6OF01DWKPM.33.78.H01.1.454.CMB.1.raw
  modified_base (360)..(360): a, c, t, g, unknown or other
  misc_feature (360)..(360): n is a, c, g, or t
tcagtacacacactcacgaccggtgctcgatttagtgtgagtagtttggggtttggggggtccaggaggcagaactctgggtgtctcaccatggcctggatccctctacttctccccctcctcactctctgcacaggctctgcggccttcctacgagctgacacagccaccgtcggtttctgtgtcactgggacagacggccaggatcacctgctctggagatgcattgccaaagcaatacgcttatggtaccagcagaagcaggccaggccctgtactgataatatacaaagagaatgagaggccctcgagggtactcccgtgagcgattctccggctacaatgacgaagggacaaacngtcacgtgaccatcagtgagtccagcagaacgagagactagactatcacgtcgacactcagcgacctcagtggtagggtggtggttcggaggacggcaagttcgaccgtactagggtcagcccgaaggtccgtcgcccctggtccacgtcctcgtccccgtccc

SEQ ID NO: 162339 - DNA, 567 bp, Homo sapiens
  misc_feature: GYAE6OF01EEZXE.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaaagcaatacgcttattggtaccagcagaagccaggccaggcccctgtactgataatatacaaagagaatgagaggccctcagggatcccctagccgacgattcgtccggctaacaagtgacgaagggacaaacgagtacacgttcgaaccatcagtggacgtccgaggcaaggaagaacgaggctagactatacaactcgaccactcacgccgacctcgaggttgggtagggtgggttgttcgggacgggacgggaccgtaggttcgacccgtcgtacggtacacggcccgaaggtcctccgcccccgtcggaccacgttcgtcgttaccccc

SEQ ID NO: 162340 - DNA, 505 bp, Homo sapiens
  misc_feature: GYAE6OF01D5HQ9.33.78.H01.1.454.CMB.1.raw
tcagtacacacactcacgaccggtgctcgatttagtgtgagtagtttgggtttggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggccctgtactgataatatacaaagagaatgagaggccctcagggatccctgagcgattctccggctacaatgcagggacaacagtcacgttgaccatcagtggagtccaggcagaagacgaggctgactatcactgccactcagcgacctcagtggtaggtgggtgttcggcggagggacaagttgaccgtctaggtcagcccaaggctcgccccctggtcactctcgtcccgccc

SEQ ID NO: 162341 - DNA, 647 bp, Homo sapiens
  misc_feature: GYAE6OF01BEXS8.33.78.H01.1.454.CMB.1.raw
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
tcagtacacacactcacgaccggtgctcgatttagtgtgagtagtttgggtttggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaaagcaatacgcttattggtaccagcagaagccaggccaggccctgtactgataatataacaaagagaatgagagccctnagggatccctgagcgattcnccggctacaatgcaagggacaacagtacagttcgaccatcagtggacgtccgaggcaaggaagacggagcgtagaactatccactcgacctacctacgacggacccggtacctcgaggttacgggttaggggttggggttacggttccggggacgggtaacggggtaaccctaagggtttccggaaacccggttacccggttaaagggtccgtaaccgggacccccgtaaacggggcccgttaccccggtaccccccggtttccggggtacccttaacccgtttcccggtttccccggttccccccgttaccccccg

SEQ ID NO: 162342 - DNA, 516 bp, Homo sapiens
  misc_feature: GYAE6OF01CK3PE.33.78.H01.1.454.CMB.1.raw
  modified_base (509)..(509): a, c, t, g, unknown or other
  misc_feature (509)..(509): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaaagagaatgagaggccctcgagggatccctgagcgattctccggctacaatgcagggacaacagtcacgttgaccatcagtggagtccaggcagaagacgaggctgactatcactgccactcagcggacctcgagtggtaggtgggtgttcggcgggagggacctaagttcgaccgtcgtaggtcacgcccgaaggctcgcccctcggtcncgttccg

SEQ ID NO: 162343 - DNA, 522 bp, Homo sapiens
  misc_feature: GYAE6OF01D74IJ.33.78.H01.1.454.CMB.1.raw
  modified_base (238)..(238): a, c, t, g, unknown or other
  misc_feature (238)..(238): n is a, c, g, or t
  modified_base (505)..(505): a, c, t, g, unknown or other
  misc_feature (505)..(505): n is a, c, g, or t
  modified_base (512)..(512): a, c, t, g, unknown or other
  misc_feature (512)..(512): n is a, c, g, or t
tcagtacacacactcacgaccggtgctcgatttagtgtgagtagtttgggtttgggggtgggtccaggaggcagaactctgggtgtctcaccatggcctggatccctctcctgctccccctcctcactctctgcacagtctctgtggcctcctatgagctgagacagccatcctcagtgtcagtgtctccgggacagacaaccaggatcacctgctcaggagatctattgacgaaagntcatgttcggtggttccagcagaagcccggccaggccccctgtgttggtgatttatgaagattttcaacggggctcagggatccctgagcgattctccgcctccatctcaggccactgtcaccttgaccatcagcggggcccaggttgaggatggagctgactattattgttactctgcgactgacgacaagttggggttttcggcgggagggacctaggtctgaccgtcctaagtcacgccaaggctcgccccctggtccactctnttccccnccctcctacg

SEQ ID NO: 162344 - DNA, 522 bp, Homo sapiens
  misc_feature: GYAE6OF01D2XOJ.33.78.H01.1.454.CMB.1.raw
tcagtacacacactcacgaccggtgctcgatttagtgtgagtagtttgggtttggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttatggtaccagcagaagccaggccaggccctgtactgataatatacaaagagaatgagaggccctcagggatccctgagcgattctccggctacaatgcagggacaaacagtcacgttgaccatcagtgagtccaggcagaagacgaggctgactatcactgccactcagcgacctcagtggtagggtgggtgttcggcgggagggaccgtaaggtcgaccgtccgtaggtcagcccgaaggcctcgccccctcggtccaccttctcgttccctaccccg

SEQ ID NO: 162345 - DNA, 575 bp, Homo sapiens
  misc_feature: GYAE6OF01DV5UJ.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaaagcaatacgcttattggaccagcagaagccaggccaggccctgtactgataatataacaaagagaatgagacggccctcgagggactcccgtgacgcgattcgtccggctacaatgacgagggacaaacagtacacgttgaccatcagtgacgtccaggcaagaagacgaggctagactatcactcgaccactcgacgccggtacctcgaaggtgggtaagggtgggttacggttcgggacggagggaacctaaggttcgacccgtcgtaagggtccaaggcccgaagggccctccggcccccgtcgggtacccaccgttccgttccgttcccccgtccccg

SEQ ID NO: 162346 - DNA, 740 bp, Homo sapiens
  misc_feature: GYAE6OF01AQCAT.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacgagctctgcgcctcctacgagctgacacacgccaccgttcgtttctgtgtcacgtggacaggacggccaggactcacctgctcgtggagatgctatcgaccaaagcaagtacgtcttagttcggtacccagcaagaacgccacggccacggcccctagtactgaataataataacaaagagaaatgagtacggccctacgagggactcccgtgacgcgtattccgtccggctaacaagtgacgacgggaacaacgagtaccaacggtttacgaacccatccgaaggttcgggaacgttaccgacgggacaaagggaaaacgacggtaagggcgttaacggaaccttaacgacctaaccgtcgaccccaacgtccgaacggcccggtaacccttcgaagggtttcggggttaacgggggttggggttcggttacccgggggacggggtaaccgggtaaccggtaaacgggtttccgggaaccccggttcccggttaagggttaccccgaaccgggtacccccgaaaggggtccccttccccggggaccccccccgtttacggggtacctaaccccggtttccgttccccggtttcccccccccgg

SEQ ID NO: 162347 - DNA, 655 bp, Homo sapiens
  misc_feature: GYAE6OF01EB78H.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatcccgtctacttctccccctcctcactctctgcacaggctcgtgcggcctcctacgagctgacacagccaccgtcggtttctgtgtcacgtgggacaggacggccaggatcacctgctctggagatgcctattgaccaaagcaatacgcttaattggtaccagcagaagccaggccacggcccctgtactgataatatacaaagagaatgagacggccctagagggactcccgtgacgcgattcgtccggatacgaagtgacgacgggacaaacgagtacaacgtttgaacctatacgaaggtcggagtccgagggacaagaagacggaggtacttagacttatcactgaccactacacgaccggtacctcgtagttgggttagggtcggggttacggttaccggggacgggtaacgggtaccgtaaagggtttaccggaaccccggtttaccggttaacgggttcccgaaacgggtacccccgaaaacggggtccccgtacccggtaccccccccggtttacgggttccccgtaacccgtttcccccgg

SEQ ID NO: 162348 - DNA, 514 bp, Homo sapiens
  misc_feature: GYAE6OF01BQHEI.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctccggctacaatgcagggacaacagtcacgttgaccatcagtggagtcaggcagaagacgaggctgactatcactgccactcagcggacctcaggtggtaggtgggtgttcggcggagggaccaaggttcgaccggtctaggtcacgcccgaaggtcctcgccccctcggtcacgtccg

SEQ ID NO: 162349 - DNA, 552 bp, Homo sapiens
  misc_feature: GYAE6OF01CGR7D.33.78.H01.1.454.CMB.1.raw
  modified_base (301)..(301): a, c, t, g, unknown or other
  misc_feature (301)..(301): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttatggtaccagcagaagccaggccacggcccctgtactgataatataacaaaganaatgaagaggccctagagggactcccgtgacgcgattccgtccggactaacgaatcgacgaagggaacaacgagtacacgttgaccatcagtggacgtcgaggcaagaagacgaggctagactatcactcgaccactcgaacgccggaacctcgaggtgggtaggtgggtgttcgggcggacggactaagtcgaccgtccgtaggtcacgcccgaaggccttccggcccctggccacgtcgtcgttccccg

SEQ ID NO: 162350 - DNA, 506 bp, Homo sapiens
  misc_feature: GYAE6OF01EE2MI.33.78.H01.1.454.CMB.1.raw
tcagtacacacactcacgaccggtgctcgatttagtgtgagtagtttgggtttggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaaagcaatacgcttattggtaccagcagaagccaggccaggccctgtactgataatatacaaagagaatgagaggccctcagggatccctgagcgattctccggctacaatgcagggacaaacagtcacgttgaccatcagtggagtccaggcagaagacgaggctgactatcactgccactcagcgacctcagtggtaggtgggtgttcggcggagggaccaagtgaccgtctaggtcagcccaaggctgccccctggtcactctgtcccgtccc

SEQ ID NO: 162351 - DNA, 544 bp, Homo sapiens
  misc_feature: GYAE6OF01D5RLI.33.78.H01.1.454.CMB.1.raw
  modified_base (428)..(428): a, c, t, g, unknown or other
  misc_feature (428)..(428): n is a, c, g, or t
  modified_base (536)..(536): a, c, t, g, unknown or other
  misc_feature (536)..(536): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattcgaccaaagcaatacgcttattggtaccagcagaagccaggccaggcccctgtactgataatatacaaagagaatgagacgccctacgagggactcccgtgagcgtattcgtccggctacaatgacagggacaacgagtcacgttgaccatacaggtggagtccaaggcaagaacgacggaggctagactatcacncgacccactcacgcgacctcgagtggtagggtggtggtcgggacggaggaccgtaaggttcggaccgtcgtacggtcacgcccgaacggtcctcgacccctcggtccncgttcccg

SEQ ID NO: 162352 - DNA, 525 bp, Homo sapiens
  misc_feature: GYAE6OF01DK5CQ.33.78.H01.1.454.CMB.1.raw
tcagtacacacactcacgaccggtgctcgatttagtgtgagtagtttgggtttggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttatggtaccagcagaagccaggccaggccctgtactgataatatacaaagagaatgagaggccctgagggatccctgagcgattctccggctaacaatgcagggacaacagtcacgttgaccatcagtggagtccaggcagaagacgaggctagactatcactgccactcacgccgactcgagtggtagggtgggtgttcggcgggaggacctaaggttcgaccgtcgtaggtcagcccgaaggcctcgcccccgtcggtcaccttctcgttcccctaccccg

SEQ ID NO: 162353 - DNA, 639 bp, Homo sapiens
  misc_feature: GYAE6OF01BFAJS.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacagactctgcggcctcctacgagctgacacagccaccgtcggtttctgtgtcactgggacagacggccaggatcacctgctctggagatgcattgaccaaagcaatacgcttattggtacagcagaagcaggccagcccctgtactgaataatataacaaaagagaatgaagacggccctagaagggaactccccgtaggacggacgtaacttccgtacccggtactaacctaaagtcggacgaacggggaacaaaacgtacggtacctaacggtttacgaaccctataccgaaggtagggtacgtacccgagggacaaggaaacgaacggaggaccgtaggaacctatacctaacgtcgaccacctacgacgaccggacctacgtaggtcgggttaaggttcggggtacgtcgggacggagggtaccgtaaaggttcggaccgtacgtacggtcacgaccccgaaggtccgtaccggcccccttcgggcctcgttacccg

SEQ ID NO: 162354 - DNA, 529 bp, Homo sapiens
  misc_feature: GYAE6OF01CTEJY.33.78.H01.1.454.CMB.1.raw
  modified_base (456)..(456): a, c, t, g, unknown or other
  misc_feature (456)..(456): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttatggtaccagcagaagccaggccaggcccctgtactgataatataacaaagagaatgagaggccctcgagggatccctgagcgattctccggctacaatgcgaaggacaacagtcacgttgaccatcagtggagtccaggcagaagacgaggctgactatcactcgccactcgagccggaacctgaggtgggtaggtgggttgttcgggnggacgggacctaaggttcgaccgtcgtaggtcacggcccgaaggctcgcccctcggtcactcgtcgttccccg

SEQ ID NO: 162355 - DNA, 678 bp, Homo sapiens
  misc_feature: GYAE6OF01DAP3F.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgttcggtttctgtgtcacgtgggacagacggccaggatcacctgctcgtggagatgcattcgaccaaagactaatacgtactttagttcggtaccagcaagaacgccaggccacgccctgtactagaataatataacaaagagaatagagacggccctagacgggactcccgtaggacgcgtaactttccgaccggtacctaactaagtacgaccgaagggaacaaaccgaccggacctaacggtttaccgaaacccgtagtaccgtaacggtagggtaaccgtaccggaacgggaacgaaacggaaaacggtacgggaaacggtaccgtaggtaaaccttaacgtaccgaaccgttcgacccaacgtacgaccggaccgtacctcggtaacggtgggttaagggtcgggttcggtcgggagggtacggaccgtaaggttcgaccggttagtacggtccgacgcccgaacgtccgtaccgtccccgtcggtcctcggttcccg

SEQ ID NO: 162356 - DNA, 529 bp, Homo sapiens
  misc_feature: GYAE6OF01DMUI6.33.78.H01.1.454.CMB.1.raw
  modified_base (291)..(291): a, c, t, g, unknown or other
  misc_feature (291)..(291): n is a, c, g, or t
  modified_base (307)..(307): a, c, t, g, unknown or other
  misc_feature (307)..(307): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggccctgtactgataanatacaaagagaatganaggccctacagggatccctgagcgattctccggctacaatgcaggacaacagtcacgttcgaccatcagtggacgtcaggcaagaagacgaggctgactatcactgaccactacgacgaccgacctcgtagtggtaggtgggttggtcggcgggacgggacgaagttcggaccgttcgtaggtcagcccgaacggtctcgcccccgtcggtccgcgttcccg

SEQ ID NO: 162357 - DNA, 591 bp, Homo sapiens
  misc_feature: GYAE6OF01CMBMY.33.78.H01.1.454.CMB.1.raw
  modified_base (201)..(201): a, c, t, g, unknown or other
  misc_feature (201)..(201): n is a, c, g, or t
tcagtacacacactcacgaccggtgctcgatttagtgtgagtagtttgggtttgggggaaacctcattcctcctctaaagaagcccatgggagcacagcgcatcaccatggactggacctggaggttcctctttgtggtggcagcagctacaggtgtccagtcccagttccaactggtacaatctgggtctgaggtgaagnggcctgggtcctggtgagggtctcctgcagtgtctcgtgggagccgtccttcagcacctatcgccatcacctgggtgcgacgacggcccccggacgaagggcttgaggtggagtgggggtatcgactccctctcttcgcacaatacagtacgccaacaaatttcaagacagagtgactaagtttcgacgaaacgaactacaacgaccaacagtaccaacgactggagttgaaggacgcctagacatacagtaagacgacgaccgtataagttactgtcgacgaagagaatacgaaatggtaggacgtagaaaggttcgggttaacgggtttagaccgttcggtacgggacccggtaacgggtacccgtagggtacctgtccggttacccg

SEQ ID NO: 162358 - DNA, 550 bp, Homo sapiens
  misc_feature: GYAE6OF01E3B5B.33.78.H01.1.454.CMB.1.raw
  modified_base (332)..(332): a, c, t, g, unknown or other
  misc_feature (332)..(332): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttattggtaccagcagaagccaggccaggcccctgtactgataatatacaaagagaatgagaggccctcagggatccctgagcgattcnccggctacaatgcgagggacaacagtcacgttgaccatcagtgagtccgaggcagaagacgaggctgactatcactgccactcgacgcggacctcgagtgggtagggtgggtcgttcgggcggacgggacctaaggttcgaccgtcgtacggtcaggcccgaaggccctccggaccccccgttcgggtacctaccgttccgttcgtccccctaccccg

SEQ ID NO: 162359 - DNA, 589 bp, Homo sapiens
  misc_feature: GYAE6OF01DR6TQ.33.78.H01.1.454.CMB.1.raw
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (416)..(416): a, c, t, g, unknown or other
  misc_feature (416)..(416): n is a, c, g, or t
  modified_base (442)..(442): a, c, t, g, unknown or other
  misc_feature (442)..(442): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaaagcaaatacgtcttattggtaccagcagaagcaggccaggccctgtacngataanataacaaaganaatgagaggccctgagggactcccgtgagcgtattccgcggactaacaatcgacgagggaacaacagtcacgttagacatcagtggactcgagcaagaagacgagctagactancatcgcctatcgacgacgtacctagnggtagggtaggtgggtcgtcgggacgggacggaactaggttccgacccggttaccggtaggtaccaacggtcccccggtaagggccctaccccgggtccccccgttgggtacccttacccggttcccgttcgggtttaccccccccg

SEQ ID NO: 162360 - DNA, 549 bp, Homo sapiens
  misc_feature: GYAE6OF01DP76U.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcaagaagccaggccaggccctgtactgataatataacaaagagaatgagaggccctgagggatccctagagcgattcgtccggctaacaatgacgagggacaaacgagtcacgttgaccatcagtggagtccgaggcaagaaagacgaggactagactatcactcgccactcagccgactcgaggtggtagggtgggtgttcgggacgggagggaccgaagttcgaccgttcgtacggtcacgcccgaaggcctcgcccccgtcggtaccaccttccgtccgttccccgtcccc

SEQ ID NO: 162361 - DNA, 504 bp, Homo sapiens
  misc_feature: GYAE6OF01BB0HU.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctccggctacaatgcagggacaacagtcacgttgaccatcagtggagtccaggcagaagacgaggctgactatcactgccactcagccgactcgagtggtaggtggtgttcggcggaggaccagtcgacgtcgtaggtcagcccagctcgcccctcgtcactctcgtccctaccc

SEQ ID NO: 162362 - DNA, 647 bp, Homo sapiens
  misc_feature: GYAE6OF01DA919.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttattggtaccagcagaagccaggccaggcccctgtactgaataatatacaaaagagaatgagacggccctgagggactcccgtgagcgtattccgtccggactaacaagtgacgaaggacaacgtacgtctacgttagaaccatacgtagtggacgtaccgaggacgaaggaacggaacggacggacgtagactacgtactacgtacgacccactacgtacggaccggtaccgtacgtacggttagggtagggttcggggttcgggttacgggacggggtaacgggtaaccggtaacggttacggtaacccggttccggttaaaaacgggtccgaaccggtacccggaacgggtccgtacccggtacccccgttcccggtccgtacccgttaccccgg

SEQ ID NO: 162363 - DNA, 521 bp, Homo sapiens
  misc_feature: GYAE6OF01EDAFA.33.78.H01.1.454.CMB.1.raw
  modified_base (514)..(514): a, c, t, g, unknown or other
  misc_feature (514)..(514): n is a, c, g, or t
tcagtacacacactcacgaccggtgctcgatttagtgtgagtagtttgggtttgggggggtccaggaggcggaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggccctgtactgataatatacaaagagaatgagaggccctagagggatcctgagcgattctccggctacaatgcaggacaacgagtcacgttgaccatcagtggagtccgaggcagaagacgagctagactatcactgaccactcagcgactcgaggtggtaggtgggtcgtcggcggaggaccaagttcgaccgtcgtaggtcacgcccgaggcctcgccccgtggtccactcctcgttccccnccgtccg

SEQ ID NO: 162364 - DNA, 517 bp, Homo sapiens
  misc_feature: GYAE6OF01AFO3Q.33.78.H01.1.454.CMB.1.raw
tcagtacacacactcacgaccggtgctcgatttagtgtgagtagtttgggtttggggggtccaggaggcagaactctgggtgtctcaccatggcctggatccctctacttctcccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggccctgtactgataatatacaaagagaatgagaggccctcagggatccctgagcgattctccggctacaatgcagggacaacagtcacgttgaccatcagtgagtcaggcagaagacgaggctgactatcactgccactcagccgactcagtggtaggtgggtgttcggcggaggacctagttcgaccgtcgtacggtcagacccgaggcctcggccccctcggtctattccgtcgttccccgtccccg

SEQ ID NO: 162365 - DNA, 590 bp, Homo sapiens
  misc_feature: GYAE6OF01DER9J.33.78.H01.1.454.CMB.1.raw
  modified_base (582)..(582): a, c, t, g, unknown or other
  misc_feature (582)..(582): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctagagggactcccgtgagcgtattccgtccggactaacaaatcgacgaacggggaacaaacgtacgtccgaacgtttacggaacccaagtacgaaggtgggaacgttccgaagggaccaaggaaacggaacggaggactagaactatccactcgaccacctcgaacgccggacctgacggtggtagggttgggtgttacgggcggagggacctaggttcgaccggtacctagggtcaggtacccgaaggtcctcgcccccgtcgtccncgttcccg

SEQ ID NO: 162366 - DNA, 528 bp, Homo sapiens
  misc_feature: GYAE6OF01BP1OC.33.78.H01.1.454.CMB.1.raw
  modified_base (339)..(339): a, c, t, g, unknown or other
  misc_feature (339)..(339): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaaagagaatgagaggccctcagggatccctgagcgattctccggntacaatgcagggacaacagtcacgttgaccatcagtggagtccaggcagaagacgaggctagacgtatcactgccactcagcgacctcgagtggtaggtggtgttcgggcggaggaccgaagttcgaccgtccgtaggtcacggcccgaaggcctcggccccctcggtccaccttcgtcgttacccccg

SEQ ID NO: 162367 - DNA, 538 bp, Homo sapiens
  misc_feature: GYAE6OF01DJCVA.33.78.H01.1.454.CMB.1.raw
  modified_base (310)..(310): a, c, t, g, unknown or other
  misc_feature (310)..(310): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggccctgtactgataatatacaaagagaatgagaggccctnagggatccctgagcgattctcggctacaatgcagggaacaacagtcacgttgaccatcagtggagtccaggacaggaaagacgaggctagactatcactcgccactcgagccggactcgaggtcggtagggtgggttgttcgggcggagggacctaaggttcgaccgtccgtaggtcacgcccgaaggcctcgccccctcggtacccagtcctcgttcccctaccccg

SEQ ID NO: 162368 - DNA, 663 bp, Homo sapiens
  misc_feature: GYAE6OF01CRRRS.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgccggcctcctacgagctgacacagccaccgttcggtttctgtgtcacgtgggacaggacggccaggatccacctgctctggagatgctattcgaccaaagcaatacgtctttagttcggtaccagacaagaacgccacggccacggccctgtactgaataatataacaaagagaagtgagacggccctagacgggactcccgtagagcgtacttcgtccggactaacaagtcgacgaagggaaccaaacgtagtaccgtacgttacgaacctagtacgaggttcgggaacgtccgaacggacgaaggaaacggacggaggtactacggacttactaccaacgtcgaccctaccgtacgacggccggacctcgagggttgggtagggtcgggttcggttcgggacgggacgggaaccgtaaggttccggaccgttacggtacggtaccgaaccggacccggtaggcccgtcccggcccccgttccgggtacctaccgtttccctccgttccccctaccccg

SEQ ID NO: 162369 - DNA, 656 bp, Homo sapiens
  misc_feature: GYAE6OF01B53OU.33.78.H01.1.454.CMB.1.raw
  modified_base (237)..(237): a, c, t, g, unknown or other
  misc_feature (237)..(237): n is a, c, g, or t
tcagtacacacactcacgaccggtgctcgatttagtgtgagtagtttgggtttgggggggtccaggagggcagaactcgtgggtgtctcaccatggccgtggattccctcttacttcctccccctcctcactctctgccacaggctctggccggcctcctacgagctgaccacacgccaccgttcggtttcgtgtgtccacgtgggacaggacggccaggatcacctgctctagganatgctagttcgaccaaagcaaatcgcttagtcggaccagcagaacgccaggccgacggccctgtacctgataagtactaacaaaggagaatcgaaggacggcccgtagaacgggtactcccgtggacgcgtacgttccgtaccggactaacaagtcgaccgacgggaaccaaacgacgtacgtacggttacgaaccctagtaccgtaggttcggacgtaccgaggtacaaggtaacggacggaggtctagaacttacgtaccacgtcgacccactccgaggcccggacctacggaggtgggtagggttggggtcgttacgggacgggtacggaccgtaaggttcgacccgtacgtaggtcacggacccgtaggcctccgcccccgttcggtcctaccgttccgtcccgtcccctacccg

SEQ ID NO: 162370 - DNA, 570 bp, Homo sapiens
  misc_feature: GYAE6OF01EFNFQ.33.78.H01.1.454.CMB.1.raw
  modified_base (415)..(415): a, c, t, g, unknown or other
  misc_feature (415)..(415): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttattggtaccagcagaagccaggccacggccctgtactgaataatataacaaagagaatgagacggccctcgagggactcccgtgagcgtattccgtccggactaacaatgacgaggacaacagtcacgttgaccatcgagtggacgtcaggcagaagacgagctgactancacgcgccacgtcacggcccgactcgaggtgggtacgggtgggttcggtcgggcgggaacgggaccgtaaggtcggacccgtaccgtaggtccgacggcccggaaacggccctccggcccccgtcggtaccaccgttcgttccgtccccgtcccg

SEQ ID NO: 162371 - DNA, 546 bp, Homo sapiens
  misc_feature: GYAE6OF01ADB1O.33.78.H01.1.454.CMB.1.raw
  modified_base (182)..(182): a, c, t, g, unknown or other
  misc_feature (182)..(182): n is a, c, g, or t
  modified_base (531)..(531): a, c, t, g, unknown or other
  misc_feature (531)..(531): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacagctctgcggcctcctacgagcctgacacagccaccgtcggtttcngtgtcactgggacagacggccaggatcacctgctctggagatgcattgaccaaaagcaatacgcttattggtaccagcagaagccaggccaggcccctgtactgataatatacaaagagaatgagacggccctacgagggactcccgtgacgcgattccgtccggctaacaatcgcaggacaacgagtcacgttgaccatcgagtgacgtccgaggcagaagacgtaggctagactatcactgaccacgtcagccggtacctcgaggtggtaggtgggtacgttacgggacggaacgggactaggttcgaccgtcgaggtcacgcccgaagtctccgcccctcgtaccnctcgtcgttaccccc

SEQ ID NO: 162372 - DNA, 672 bp, Homo sapiens
  misc_feature: GYAE6OF01BGY0O.33.78.H01.1.454.CMB.1.raw
  modified_base (222)..(222): a, c, t, g, unknown or other
  misc_feature (222)..(222): n is a, c, g, or t
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgcggcctcctacgagctgacacagccaccgtcggtttctgtgtcacgtgggacagacggccaggatcacctgctctgganatgcattgaccaaagcaatacgcttattcggtaccagcagaagccaggccacggccctgtactgataatataacaaagagaatgagacggccctagaagggactcccgtgacgcgtacttccgtccggactacaagtcgacgagggaacaaacgtagtacctaacgttacgaaccctagtaccgaggtcgggtaacgtccgaggacgaaggaaacggacggaaggctaggaactacgtccaacgtcgacccacgtacgacggtaccgtacctcgaagggttcgggtagggttggggttcggttacggggacgggtacggggtaaccctaagggttccgaacccggttaccgtacgggttaccgaacccggaccccgtaaagggtcccctaccccgggtaccccccgttcggtaccctaccgtttcccgttcccgttccccctaacccccg

SEQ ID NO: 162373 - DNA, 638 bp, Homo sapiens
  misc_feature: GYAE6OF01DQRWT.33.78.H01.1.454.CMB.1.raw
  modified_base (227)..(227): a, c, t, g, unknown or other
  misc_feature (227)..(227): n is a, c, g, or t
tcagtacacacactcacgaccggtgctcgatttagtgtgagtagtttgggtttggggctgtgggtccaggaggcagaactctgggtgtctcaccatggcctggatccctctacttctccccctcctcactctctgcacaggctctgcgcctcctacgagctgacacagccaccgtcggtttctgtgtcactgggacagacggccgaggatcaccgtgcctcgtgganatgcattcgaccaaagcaatacgtcttattggtaccagcaagaagccgagccacggcccctagtactcgaataatataacgaaagagaatggagacgaccctgagggactccctagacggtacgtacttccgtaccggacttaacgaatacggaccgaacgggaaccaaacgtacggtacctaacggttacgaaccctactaccggaaggttacgggacgtacccgagggaccgaaggaaaggacggaaggctacggtaactacgtaccacgtacgcccacgtccaggtccggacctcgtaggtacggtagggtggttcgggtcggcgggaacggtaccgtaaggttccggaccgtacgtaggtaccacggtacccgagtacctcccggtaccccgtgtccgtcgttcccg

SEQ ID NO: 162374 - DNA, 523 bp, Homo sapiens
  misc_feature: GYAE6OF01B5YPK.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctccggctacaatgcagggacaacagtcacgttgaccatcagtggagtccagcagaagacgaggctgactatcactgccactcagcgacctcaggtgggtaggtgggtgttcggcgggagggaccgaaggttcgaccgtccgtagggtcacggcccgaaggcctcgccccctcggtccactctcgttccccc

SEQ ID NO: 162375 - DNA, 500 bp, Homo sapiens
  misc_feature: GYAE6OF01EOS7H.33.78.H01.1.454.CMB.1.raw
  modified_base (328)..(328): a, c, t, g, unknown or other
  misc_feature (328)..(328): n is a, c, g, or t
tcagtacacacactcacgaccggtgctcgatttagtgtgagtagtttgggtttggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttatggtaccagcagaagccaggccaggccctgtactgataatatacaaagagaatgagaggccctcagggatccctgagcgattcnccggctacaatgcagggacaacagtcacgttgaccatcagtggatccaggcagaagacgaggctgactatcactgccactcagcgactcagtggtaggtgggtgttcggcggaggaccaagtgaccgtctaggtcagcccaggctgcccctggtacactctcgtccctaccc

SEQ ID NO: 162376 - DNA, 618 bp, Homo sapiens
  misc_feature: GYAE6OF01AHPO4.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggccctgtactgataatatacaaagagaatgagacggccctcagggactccctggacgcgtattccgtccggactaacgaagtgacgaacgggaacaacgacgtacgacgttacgaccatcagtggagtccgaggcaagaagacgagcgtagactactacacgtcgcctactcgagaccgtacgtcgtagggtagggtagggttcgggttcggttcgggacgggacgggtaaccgtaaggttccggtaacccggttaccgtacgggtaccgtaccggacccggaacggtcccgtcccggtaccccccgtcgggtaccctaacccgttcccgttcccgttcccctacccg

SEQ ID NO: 162377 - DNA, 619 bp, Homo sapiens
  misc_feature: GYAE6OF01BBMIZ.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaaagcaatacgcttattggtaccagcagaagccaggccacggccctgtactgataatataacaaagagaatgagacggccctcgaagggactcccgtaggacgcgtacgttccgtccggactaacaagtcgacgaagggaacaacgacgtaccgtaacggttacgaacctagtacgtaggtacgggtaacgtcccgaagggacaagggaaacgacggaggctagaactatccactcgaccacgtcgacggccgacctgaggttgggtagggtgggtcggtcgggacggacgggaccgtaaggttcggacccgttacgtaggtccgacgacccggacggcctcccggcccccgtggtaccctccgttccttccgttccccctaccccg

SEQ ID NO: 162378 - DNA, 525 bp, Homo sapiens
  misc_feature: GYAE6OF01CSIB3.33.78.H01.1.454.CMB.1.raw
tcagtacacacactcacgaccggtgctcgatttagtgtgagtagtttgggtttgggggtggggtccaggaggcagaactctgggtgtctcaccatggcctggatccctctacttctccccctcctcactctctgcacaggctctgcggcctcctacgagctgacacagcccaccgtcggtttctgtgtcacgtgggacagacggccaggatcacctgctctggagatgcattgccaaagcaatacgcttatggtaccagcagaagccaggccaggcccctgtactgaataatataacaaagagaaatgagacggccctacgagggactcccgtgacgcgattccgtccggctacaatgacgagggacaacgagtcacgttgaacctatcagtggacgtccaggcaaggaacgacgaggctgactatcactgccacgtcagcgactgagtggtggtggtgttcggcgaggccagttcgaccgtcgtaggtcacgccaggctcgcccctggtcacctctcgtacccc

SEQ ID NO: 162379 - DNA, 530 bp, Homo sapiens
  misc_feature: GYAE6OF01CZLGC.33.78.H01.1.454.CMB.1.raw
  modified_base (506)..(506): a, c, t, g, unknown or other
  misc_feature (506)..(506): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatataacaaaagagaatgagaggccctcgagggactccctggaagcgattcctccggactaacaaagtgcaagggacaacgagtcacgttgaaccatcagtggagtccaggcaagaagacgaggctagactatcactcgccactcagcgtacctgaggtggtagggtgggtgttcgggcggaggaccgaagttcgaccgtcgtaggcacggccaggtcncgtcccctgactctctcgtacccc

SEQ ID NO: 162380 - DNA, 594 bp, Homo sapiens
  misc_feature: GYAE6OF01C8JPE.33.78.H01.1.454.CMB.1.raw
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
  modified_base (441)..(441): a, c, t, g, unknown or other
  misc_feature (441)..(441): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttattagtaccagacagaagccaggccacggccctgtactgataatataacaaaganaatgagacggccctgaggactccctgacgcgtattccgtccggtntaacaaatcgacgaagggaacaacagtacgacgttagacctatcgaggtggacgtccgaaggacgaagaacggaacgagggtctaggacttaanaccacgtcgacccaactcgaacggccggtaacctgaaggttgggtaggggtacgggtgttcgggcgggaagggtacctaaggttcggaccgtcgtagggacacggacccgagtccgtccgccccgtcgtaccaccttcgtccggttacccccc

SEQ ID NO: 162381 - DNA, 565 bp, Homo sapiens
  misc_feature: GYAE6OF01EN6IS.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggccctgtactgataatatacaaagagaatgagaggccctgagggactccctgagcgattccgtccggctaacaatgacgagggacaacgagtcacgttgaccatcgagtggagtccaggcagaagacgaggctgactatcactcgaccactcgacgcggacctcgaggtggtagggttgggttggttcgggcgggtacgggaccgtaaggttcggacccgtccgtagggtccacggacccgaaggcctccgccccccgttcggtacccaccgttccgtccgttccccgtcccccg

SEQ ID NO: 162382 - DNA, 749 bp, Homo sapiens
  misc_feature: GYAE6OF01ED5N9.33.78.H01.1.454.CMB.1.raw
  modified_base (221)..(221): a, c, t, g, unknown or other
  misc_feature (221)..(221): n is a, c, g, or t
tcagtacacacactcacgaccggtgctcgatttagtgtgagtagtttgggtttgggggggtccgaggaggcagaactcgtgggtgtctcaccatggcctggatccctctacttctccccctcctcactctctgcacaggctctgcgcctcctacgagctgacacagccaccgtcggtttctgtgtcactgggacagacggccaggatcacctgctctgganatgcattgccaaagcaatacgcttatcggtaccagcagagccaggccaggccctgtactgataatataacaaagagaatgagacggaccctagagggtactcccgtaggacgcgtacttccgaccgggtactaacgtaagtcggacgtaacggggtaacctaaacgtacggtactaccggtttacgaaccgtagtcgaacgggttacggacgttacccgaagggaccaaggtaacggaccgacgggtacctacggaaccttacgtaccgacgttcgaccctaccgtacgaaccggcgggtaaccctacgtagggttacgggttaaggggttcgggttacgggtttaccgggggacgggttaacggggaacccgttaagggtttcccgggtaccccgggtttaccggttacgggtacccggtaaccggtaccccggtaaacgggttccccgtaccccgggtacccccccggttacgggttacccctaacccggtttaccgttccccgggttcccccccttaacccccgg

SEQ ID NO: 162383 - DNA, 736 bp, Homo sapiens
  misc_feature: GYAE6OF01C9D5P.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcacgtgggacagacggccaggatcacctgctctggagatgcattgaccaaagcaatacgcttattggtaccagacagaagccaggccaggccccctgtactgaataatataacaaagagaatagagacggccctacgagggactcctgacgacgtacttccgtacccggactaaccgaaagtcgacgaaggggaaccaaacgacggttaacacggtttacgacctaatcgaagttaggaacgtaccgagggacaaggaaacggtacggaaggcttaggaacttactaccgactccggacctaaccgtacgaccggtacccggacccttacggtaagggtttcgggtaaggggtttcggggtacgggttaccgggggacgggtaacgggggtaacccttaaagggttccgggttacccccgggttaaccggttaacggggttaccccgaacccgggtaaacccccgggtaaacgggtccccggtttacccccccggggtaccccccccggttccggggtttacccgtaacccccggtttttcccccgg

SEQ ID NO: 162384 - DNA, 501 bp, Homo sapiens
  misc_feature: GYAE6OF01DXLOP.33.78.H01.1.454.CMB.1.raw
  modified_base (312)..(312): a, c, t, g, unknown or other
  misc_feature (312)..(312): n is a, c, g, or t
  modified_base (492)..(492): a, c, t, g, unknown or other
  misc_feature (492)..(492): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttatggtaccagcagaagccaggccaggcccctgtactgataatatacaaagagaatgagaggccctnagggatccctgagcgattctccggctacaatgcagggacaacagtcacgttgaccatcagtggagtccaggcagaagacgagctgactatcactgccactcagcgacctcgagtggtaggtgggtgttcggcggaggaccagtcgaccgtcgtaggcagccaagctcgcccctcgcactntcgtccccg

SEQ ID NO: 162385 - DNA, 528 bp, Homo sapiens
  misc_feature: GYAE6OF01AM2CJ.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatataacaaagagaatgagaggccctcgagggatccctgagcgattctccggctacaatgacagggacaacagtcacgttgaccatcagtggagtccaggcagaagacgaggctgactatcactcgccactcagccggactcgaggtggtagggtgggtggttcggcggaggacaggtgaccgtcgtacggtcagcccgaggcctccgcccccgtcggtcaccgtctccgttcccctaccccg

SEQ ID NO: 162386 - DNA, 787 bp, Homo sapiens
  misc_feature: GYAE6OF01D93QU.33.78.H01.1.454.CMB.1.raw
  modified_base (222)..(222): a, c, t, g, unknown or other
  misc_feature (222)..(222): n is a, c, g, or t
tcagtacacacactcacgaccggtgctcgatttagtgtgagtagtttgggtttggggggtccaggaggcagaactctgggtgtctcaccatggcctggatccctctacttctccccctcctcactctctgcacaggctctgcggcctcctacgagctgacacagccaccgttcggtttctgtgtcacgtgggacagacgaccaggatccacctgctctgganatgcattcgaccaaaagcaaatacgcttaagttggtaccagcagaagccaggccaggccctgtactgataatataacaaagagaatgaggacggccctcgagggactcccgtagacgacgtattctaccggctaacgaaatgacgtacggggaacaaaccgtagtaccgtaacgtttagaaccctaagtaccgacggtacgggaacggttaccccgaagggacccaaagggaaaggaaccgggaaggtaccgtacggaaccgttacgtacctaaccgtacggacccaccttaccgacggcccgggtaacccgtcgtaacgggttacgggttaacggggttcggggttacgggtttccggggaccgggggtaacggggtaacccggtaaaacgggttttccgggtaaaccccgggttacccggtttaacgggggttacccggtaaacccgggttacccccggtaaaaccggggtcccgtttaccccgggtacccccccgtttaccggggttacccctaaccccggtttcccgttaaccccggtttccccccggttaccccccccgg

SEQ ID NO: 162387 - DNA, 513 bp, Homo sapiens
  misc_feature: GYAE6OF01CI9W7.33.78.H01.1.454.CMB.1.raw
  modified_base (505)..(505): a, c, t, g, unknown or other
  misc_feature (505)..(505): n is a, c, g, or t
tcagtacacacactcacgaccggtgctcgatttagtgtgagtagtttgggtttgggggccgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaaagcaatacgcttattggtaccagcagaagccaggccaggcccctgtactgataatataacaaagagaatgagaggccctcagggatccctgagcgattctccggctacaatgcagggacaacagtcacgttgaccatcagtgagtccaggcagaagacgaggctgactagtcactcgaccactacagcgacctgaggttggtaggtgggtggtcggcggagggacgaagttgaccgtcgtaggtcagcccgagctcgcccctggccncgtctccg

SEQ ID NO: 162388 - DNA, 639 bp, Homo sapiens
  misc_feature: GYAE6OF01DJ088.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcacgtgggacagacggccaggatcacctgctcgtggagatgcattgaccaaagccaatacgcttattggtaccagcagaacgccaggccacggccctgtactgataatataacaaagagaatgagacggccctagagggactcccgtgacgcgtacttccgtaccggactaacgaagtgacgaagggaacaacgacgtacaacgttcgaaccctagtccgaggtacggacgtcccgaagggacaaggaacggacggaacggtctacgaacttacgtaccacgtcgacccacgtcgacggaccgtaccgtcgaggttagggtagggtgggtcggttcgggacgggacgggtaccgtaaggttcggacccggttaccgtacgggtccacgtacccggacggtcccgtcccgcccccggttggaccctaccgttcccgttcccgtcccccgtaccccg

SEQ ID NO: 162389 - DNA, 529 bp, Homo sapiens
  misc_feature: GYAE6OF01D0AZF.33.78.H01.1.454.CMB.1.raw
  modified_base (310)..(310): a, c, t, g, unknown or other
  misc_feature (310)..(310): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggccctgtactgataatatacaaagagaatgagaggccctnagggactccctgagcgattctccgctaacaatgcagggacaacagtcacgttgacatcagtggagtccaggcagaagacgaggctgactatcactcgaccactcgagccgactcgaggtggtaggtgggtgttcgggcggacgggaccgtaagtcgaccgtcgtaggtcgagcccgaggccgtcgcccccgtcgtacacttccgtcgttccccgtcccc

SEQ ID NO: 162390 - DNA, 646 bp, Homo sapiens
  misc_feature: GYAE6OF01CTZDS.33.78.H01.1.454.CMB.1.raw
  modified_base (248)..(248): a, c, t, g, unknown or other
  misc_feature (248)..(248): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgnttattggtaccagcagaagccaggccaggcccctgtactgataatatacaaagagaatgagacggccctacgagggactcccgtagagcgtattcgtccggactacaatcgacgagggacaacgacgtacacgttacgaacccatacgaggtggaacgttacccgaagggcctaaaggaaacggtaaccgggaggtcctacggaaccttaactacctaacgttcggacccaaccgttccgaacggccggtaacccgttcgtagggttcgggttaggggttcggggttggttccggggacgggtacggggacctaagggttcgaacccggttccgtagggtccgaccggacccgaacggtcccgttaccgccccccggttcggtccgtaccgttccccg

SEQ ID NO: 162391 - DNA, 509 bp, Homo sapiens
  misc_feature: GYAE6OF01EB2YI.33.78.H01.1.454.CMB.1.raw
  modified_base (313)..(313): a, c, t, g, unknown or other
  misc_feature (313)..(313): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctnagggatccctgagcgattctccggctacaatgcagggacaacagtcacgttgaccatcagtggagtccaggcagaagacgaggctgactatcactgccactcagcgacctcgagtggtaggtgggtgttcgggcggagggacctaagttcgaccgtcgtaggtcagcccaaggctcgcccctggcactctgtcccc

SEQ ID NO: 162392 - DNA, 526 bp, Homo sapiens
  misc_feature: GYAE6OF01BBE19.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctccggctacaatgcagggacaacagtcacgttgaccatcagtggagtccaggcagaagacgaggctgactatcactgccactcacgcggacctcagtggtaggtgggtgttcgggcggacgggaccgtagttcgaccgtccgtaggtcacgcccaaggcctcgcccccctcggtccaccttcgtcgttcccccg

SEQ ID NO: 162393 - DNA, 562 bp, Homo sapiens
  misc_feature: GYAE6OF01EX3JC.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctcccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatataacaaagagaatgagaggccctacgagggactcctgagcgattctccggctacaatgacaggacaacagtcacgttgaccatcagtggagtcaggcagaagacgagctgactatcactcgaccactcgacgccggacctcgtaggtgggttagggtggggtcggttcgggacgggacgggtaccgtaaggttcggacccggttccgtacgggtccgacggacccgaacggtccgtaccggccccccgttcggtccgtaccgttcccg

SEQ ID NO: 162394 - DNA, 609 bp, Homo sapiens
  misc_feature: GYAE6OF01BETH6.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactcagggcacagggtcctgggcccagtctgccctgactcaacctgcctccgtgtctgggtctcctggacagtcggtcaccatctcctgcgctggaaccagtagtgacgttgggagctatgactatgtctctgtaccaacaacactgacaacgcccccaattactgtatttctgatgtcactaatcggcctcgtaggggtttctcatcgcttctctggctccaagtctggcagccacggccctcccgtcgacctactcctcgtgggcctcgaggctggacggacgaggtcttgtttatactgctcgccgttatactatcagcagcttctccgtacgtacgttcgggacgggaacggaccgtaagggtcgtaaccggttacgttaaacgtccgtacgccccgtaaggtccctacccggtccccccgttacgggtccctaccgttacccgttacccgtttcccccctaccccgttcccgttaccgg

SEQ ID NO: 162395 - DNA, 786 bp, Homo sapiens
  misc_feature: GYAE6OF01BX0MA.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagcccaccgttcggtttctgtgtcactgggacagacggccaggatcacctgctctggagatgcattgaccaaaagcaatacgcttattggtaccagcagaagccaggccacggcccctgtactgataatataacaaagagaatggaagacggccctgagggtactccctaggacgcgtaatttccgtccggactaacaagtcgacgtaagggaaccaaacgagttaccgacggtttacgaacctagtaccgtaaggtcgggtaacgtaccgaacgggtaccgaaaggaaacgggaaccggaagggtcctaagggtaaccttaacgttaccgaccgtttaccgaacccctaacccgttacgaaccgggtaccccgggtaaaccccgtttacggtaacgggttacgggggtttaacgggggttcgggggtttacggggtttaacccgggggaccgggggttaaaccggggaaacccggtttaaacggggtttaccgggtaaccccggtttaaccgggttaaccggggtaccccgtaaaccgggacccccggtaaacggggttcccgttaccccggaccccccccggtttcgggttacccccgttaaccggtttcccccgg

SEQ ID NO: 162396 - DNA, 725 bp, Homo sapiens
  misc_feature: GYAE6OF01AJ5HS.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagcccaccgtcggtttctgtgtcactgggacagacggccaggatcacctgctctggagatgcattgaccaaagcaatacgcttattggtaccagcagaagccaggccaggccctgtactgataatataacaaagagaatgaagacggccctagaggactcccgtagacgcgtacttccgtccggtactaacaagtcgacgaacggaacaacgacgtactacgttacgaacctatcgaggtacgacgtaccgaggaccgaaggaacggacggaggtctaaacgtactactaccacgtccacctactacggacgtacccgtaccgtcgaagggttacgggtaggggttcggggtttacgggttaccggggaacggggtaaccggggtaaaccgttaacgggtttaccggtaaccccggtttaccgggttaaaccgggtacccgtaaccgggtaaccccgggtaaaccgggttccccgtacccccgggttaccccccggttaccgggttaacccctacccggttttccccggttacccccggtttaccccccgttaaccccccgg

SEQ ID NO: 162397 - DNA, 835 bp, Homo sapiens
  misc_feature: GYAE6OF01CUK25.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgttcggtttctgtgtcactgggacagacggccaggatcacctgctctggagatgcattgaccaaagcaatacgatttattggtacagacaagaagccgaggccacggcccctagtactagaataataataacgaaagaagaatggaaggacggaccctacgaagggactcccgtaggagccgtattccgtaccggtactaacaagtcgacgaacgggaaccaaacgtacgtaaccgtaaccggtttacgaaccgtagtacgtaacgggtacgggtaaccggttacccggaaaggggtaaccgaaacgggaaacgggaaccgggtaacgggtaccggttaacggtaaaccgtttaacctacccgtaacccggtttaccggaacccctaaccgttaacccggaaacgggtacccccggggtaacccgtttacgggtaacgggggtttacgggggtttaacgggggttacggggggtttaccgggtttacccggggggaaccgggggtaaacgggggtaaacccggttaaacggggtttaccggtaacccccgggtttaacgggtttaaccggggtacccgtaacccgggaaccccggtaacggggtccccgttaccccgggtacccccccggttcgggttaccccttacccggtttaccccg

SEQ ID NO: 162398 - DNA, 597 bp, Homo sapiens
  misc_feature: GYAE6OF01BS6H6.33.78.H01.1.454.CMB.1.raw
  modified_base (437)..(437): a, c, t, g, unknown or other
  misc_feature (437)..(437): n is a, c, g, or t
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgcggcctcctacgagctgacacagccaccgttcggtttctgtgtcactgggacagacggccaggatcacctgctctggagatgcattgaccaaaagcaatcgctttattggaccagcagaagccaggccaggccctgtactgataatataacaaaagagaatgagacggccctagagggactcccgtagagcgtagttccgtccggactacgaatgacgaagggaacaaacagtaccgtacgttacgaaccagtacgagtggagtccgaggacgaagaagacgaggctagactancgactcgaccactcacgccgacctcgaggtggtagggtgggtcgttcgggacgggaggaccgtaaggttccgtaccggttcgtacggtccgacgaccccggtaaggcccgtacccggcccccgttcggtaccaccttcccgttccgttccccctaccccg

SEQ ID NO: 162399 - DNA, 788 bp, Homo sapiens
  misc_feature: GYAE6OF01CO5EZ.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttatggtaccagcagaagccaggccaggcccctgtactgataatataacaaagagaatgagacggccctgagggactcccgtgacgcgtattccgtccggactaacaagtgaccgaacgggaacaaacgacggttaccgtaacggtttacgaacccagttaccgagggttagggtacgttacccgaagggaccgaaagggaaacggaacggaacgggaccttacggaacctaacttaccgaaccgtcggacccctaaccgtcgaaacgggtcccgggtaaaccccttacggtaacggggtttacgggggttaacggggtttcgggggtttacgggttttacccggggggaccgggggtaaacggggggtaaacccgttaaaacggggtttccgggtaaccccgggtttacccggttaaacggggttacccgaaacccggggtaaccccccggtaaaacggggtccccgttacccgggtacccccccccgtttacggggttacccctaaacccggtttcccgtttaccccggtttaccccccccg

SEQ ID NO: 162400 - DNA, 579 bp, Homo sapiens
  misc_feature: GYAE6OF01BCRNO.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttattggtaccagcagaagccaggccacggccctgtactgataatataacaaagagaatgagacggccctagagggatcccgtgagcgattccgtccggctaacaatgacgagggacaacgagtacacgttgacctatacgagtggacgtccgaggcaaggaacgacgaggctagactatcactcgaccactcgacgccggactcgaggttgggtagggttgggttcggttcgggacgggaagggaccgtaggttccggaaccgtcgtacgggtcacggcccgaacggccgtaccggtcccccgtcggtacctacctccgttccgtaccccccg

SEQ ID NO: 162401 - DNA, 648 bp, Homo sapiens
  misc_feature: GYAE6OF01DV4P7.33.78.H01.1.454.CMB.1.raw
  modified_base (456)..(456): a, c, t, g, unknown or other
  misc_feature (456)..(456): n is a, c, g, or t
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgcggcctcctacgagctgacacagccaccgtcggtttctgtgtcactgggacagacggccaggatcacctgctcgtggagatgctattcgaccaaagcaatacgtcttattggtaccagacaagaacgccaggccgacggccctgtactagaataatataacaaagagaagtgaagacggccctacgaggactcccgtgacgcgtacgttccgtaccggactaacaagtgacgaagggaacaacgagtactacgttacgaaccatacgaggtcggacgtccgaaggacgaaggaacgacggagtctagaactancactcgacctacgtacgacgccgtactcgaggttacgggtagggttggggttcgttcggggaccgggtaacgggtaccgtaaggttaccggtacccgtacggtacggtccgaaccggacccgaacgggtccccgtcccggccccccgttcgggtaccctaccgtttccgttccccgttaccccgtacccccg

SEQ ID NO: 162402 - DNA, 543 bp, Homo sapiens
  misc_feature: GYAE6OF01BISCB.33.78.H01.1.454.CMB.1.raw
  modified_base (379)..(379): a, c, t, g, unknown or other
  misc_feature (379)..(379): n is a, c, g, or t
  modified_base (534)..(534): a, c, t, g, unknown or other
  misc_feature (534)..(534): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagacggccctcgagggactccccgtagacgcgtattcgtccggctaacaatgcgaaggacaacagtcacgttnaccatcagtggagtccgaggcaggaagacgaggctgactatcatcgccactcagccgacctcgagtggtaggtgggtagtcgggcggacggaccgaagttcggaccgttcgtaggtccgacgaccccgaaggtcctcgaccccccgttcggtccnccgttcccg

SEQ ID NO: 162403 - DNA, 704 bp, Homo sapiens
  misc_feature: GYAE6OF01D17ML.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggttttctgtgtcacgtgggacagacggccaggatcacctgctcgtggagatgctattcgaccaaaagcaaatacgtactttagttcggtaaccagacaagaacgccgacggccacggtccctgtactagaataataataacgaaagaagaatgagacggccctagacgggtactccgtagacgtcgtacgttccgtaccggactaacgaagtcgacgaacggaaacaacgtacgtacgtacgttacgaacctagtacgaggtggacgtaccgaggaccgaaaggaaacggacggaggtccttaacgaacttaacgcctacgtacgaccctacgtacggaccgtccggtacctacggaggttggggttagggttacggggttcggttacggggacgggtaacgggaaccgtaacgggttccgaaccggttaccggtaacggttaccaaccggtacccgtaagggtccccgttaccccggtcccccggttacggtacccttacccgttcccgttccccggttcccccccg

SEQ ID NO: 162404 - DNA, 628 bp, Homo sapiens
  misc_feature: GYAE6OF01B5TP7.33.78.H01.1.454.CMB.1.raw
  modified_base (248)..(248): a, c, t, g, unknown or other
  misc_feature (248)..(248): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgnttattggtaccagcagaagccagccacggcccctgtactgataatataacaaagagaatgagacggccctagagggactccctaggacgcgtacttccgtccggtactaaccaatcggacgaagggaaccaaacgtagtactacgttacgaacctatacgaaggtggaacgtcccgaagggcaaggaaagacggaggactgaactatcactcgaccacgtcgacgccggacctcgtaggtgggttacgggtgggttcggttacgggacgggtaacgggaccgtaaaggttcggtaacccggttaccgttacgggtccaacggtaccccgaaacgggtccgttaccccggacccccgttcgggtaccgtacccgttcccgg

SEQ ID NO: 162405 - DNA, 836 bp, Homo sapiens
  misc_feature: GYAE6OF01AMYW2.33.78.H01.1.454.CMB.1.raw
  modified_base (223)..(223): a, c, t, g, unknown or other
  misc_feature (223)..(223): n is a, c, g, or t
tcagtacacacactcacgaccggtgctcgatttagtgtgagtagtttgggtttggggggtccaggaggcagaactctgggtgtctcaccatggcctggatccctctacttcctccccctcctcactctctgcacaggctctgcggcctcctacgagctgacacagccaccgttcggtttctgtgtcacgtgggacagacggccaggatcacctgctcgtgganatgctattgaccaaaagcaaatacgctttaagttcggtaaccagcaagaacgccaggccaggccctgtactgataatatacaaagagaatgagtacggccctacgagggactccctgacgcgtattccgtccggtactaacgaagtcgacgaacgggaactaaacgacgtaccgtaaccgttcgaaacccgtataccgaaggttacggggtaacgtacccgaacggggaaccgaacgggtaaaaccggaaccgggtaacgggtaccttaacgggtaaaccgttaaccgttacccgtaaacgttcccggaacccccttaaccgttaccggaacggtaccccgggttaacccttaccggtaacggggtttacgggggtttaacggggttcgggggtttaaccgggtttccggggggaacccgggggtaaacggggtaacccgttaaacggggttttaccggaaacccccgggtttccggtaacgggttaccccggaacccggtacccccgggtaaaacgggtccccgttaccccggaaccccccccgggtttccgggttacccgttaaccccgtttcccggtttaccccgggtttccccccccttaaccccccgg

SEQ ID NO: 162406 - DNA, 686 bp, Homo sapiens
  misc_feature: GYAE6OF01D2CRR.33.78.H01.1.454.CMB.1.raw
tcagtacacacactcacgaccggtgctcgatttagtgtgagtagtttgggtttgggggctgtgggtccagggaggcagaacgtctgggtgtctcaccatggcctggatccctctacttctccccctcctcactctctgcacaggctctgcggcctcctacgagctgacacagtccaccgtcggtttctgtgtcactgggacaggacggccaggactcacctgctctggagatgcattgaccaaagcaaactacgacttaattggtaccagcagaagccaggccaaggcccctgtactgaataatataacaaagagaatgagacggccctacgaacgggtactccccgtagacgcgtaattccgtccggctaacgaagtcgactacgggacaacacgtccaacgttcgaaccatcgagtggacgtccgaggacaggaagtacggacggcttagtaacttacgtacaccgtcgacccacgttacgaacgtcccggtaaccgttccgtaggttacgggttagggtcggggttacggttaccggggacgggtaaccggggtaccgtaaacgggtttaccggtaaaccccggttaccggttagggtacccgtaaccgggtacccccgtaaaacgggtcccgttacccgggaccccccccgtttacgggtacccgtacccgtttacccccgg

SEQ ID NO: 162407 - DNA, 607 bp, Homo sapiens
  misc_feature: GYAE6OF01DLHIM.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgttcggtttctgtgtcactgggacagacggccaggatcacctgctctggagatgcattgaccaaagcaatacgcttattggtaccagcagaacgccaggccaggccctgtactgataatataacaaagagaatgagacggcctcgagggactcctgacgcgtattcgtccggactaacaagtcgacgaagggaacaaacgacgtaccacggtttacgaaccgtatacgaggtcgggtaacgtacccgagggaccgaaggaaaggacggacggctacgacttactcactcgaccaactcgacgcgacctacgaggttcgggtaggttgggtggttcggacgggacggacgtaggttcgaccgtcgtacggtcgaccgaccgaacggtccgtcccggcccccgttcggtaccctacgttcccgttcgtccccgtccccg

SEQ ID NO: 162408 - DNA, 518 bp, Homo sapiens
  misc_feature: GYAE6OF01AKI7W.33.78.H01.1.454.CMB.1.raw
  modified_base (336)..(336): a, c, t, g, unknown or other
  misc_feature (336)..(336): n is a, c, g, or t
  modified_base (453)..(453): a, c, t, g, unknown or other
  misc_feature (453)..(453): n is a, c, g, or t
  modified_base (510)..(510): a, c, t, g, unknown or other
  misc_feature (510)..(510): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattcnccggctacaatgacagggacaacagtcacgttgaccatcagtcggagtccaggcagaagacgaggctgactatcactcgccactcagcgacctcgagtggtaggtgggtgttcgggnggaggacgagttcgaccgtcgtaggtcacgcccgaacggcctacgccccgtcggtcnccgttccg

SEQ ID NO: 162409 - DNA, 530 bp, Homo sapiens
  misc_feature: GYAE6OF01B6EP2.33.78.H01.1.454.CMB.1.raw
  modified_base (332)..(332): a, c, t, g, unknown or other
  misc_feature (332)..(332): n is a, c, g, or t
  modified_base (402)..(402): a, c, t, g, unknown or other
  misc_feature (402)..(402): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaaagcaatacgcttattggtaccagcagaagccaggccaggccctgtactgataatatacaaagagaatgagaggccctcgagggatccctgagcgattcnccggctacaatgcaggacaacagtcacgttgaccatcagtggagtccaggcagaagacgaggctgactancactcgccactcagccgactcgagtggtaggtgggtggttcggcgggagggaccaggttgaccgtccgtaggtcaggcccgaaggcctccgcccccgtcgggtaccactccgtcgttcccctaccccg

SEQ ID NO: 162410 - DNA, 533 bp, Homo sapiens
  misc_feature: GYAE6OF01BCBW0.33.78.H01.1.454.CMB.1.raw
  modified_base (509)..(509): a, c, t, g, unknown or other
  misc_feature (509)..(509): n is a, c, g, or t
  modified_base (525)..(525): a, c, t, g, unknown or other
  misc_feature (525)..(525): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttatggtaccagcagaagccaggccaggcccctgtactgataatatacaaagagaatgagacggcctcgagggatccctgagcgattctccggctacaatgcagggacaaacagtcacgttgaccatcagtggatccgaggcaagaagacggaggctagactatcactgccactcagccgacctcgagttgggtaggtgggtgttcgggcgggacgggaccgaaggttcggaccgttccgtaggtcacggcccgaaggtccnccgacccctcggtccncgttcccg

SEQ ID NO: 162411 - DNA, 632 bp, Homo sapiens
  misc_feature: GYAE6OF01ED8YY.33.78.H01.1.454.CMB.1.raw
  modified_base (246)..(246): a, c, t, g, unknown or other
  misc_feature (246)..(246): n is a, c, g, or t
tcagtacacacactcacgaccggtgctcgatttagtgtgagtagtttgggtttgggggaaaacctcattcctcctctaaagaagcccctgggagcacagcgcatcaccatggactggacctggaggttcctctttgtggtggcagcagctacaggtgtccagtcccagttccaactggtacaatctgggtctgaggtgaagaggcctgggtcctcggtgagggtctcctgcagtgtctcgtgggancgccttcagccacctatcgccatcaccgtgggtgcgacacggcccccggacgaagggcttggagtggaggtgggggtatcgactccctctccgttcggcacaatacacgtaccgacccaactaaatttcaagacagagtgacgtaagtttcgacgaacgaactacaacgaccacacgtacccaacagtggagttaggaggacgtcctagacagtcgtagaacgacgacggtacgtatacttacgtgtcgacgtagagtactaacgaaagttggtacggacgtacgtaaagggtttcgggttaacgggttttacggaccggttccggtacggggtacccgtaaccggggtaacccgttcggttacgtacgttccgttcgtaccccgg

SEQ ID NO: 162412 - DNA, 585 bp, Homo sapiens
  misc_feature: GYAE6OF01A1XBA.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatataacaaagagaatggagacggccctacgagggactccccgtagacgcgtacttccgtacccggactacaagtcgacgaagggaaccaacgagtaccaacgttcgaaccatcgaggtcgagtccgaggcagaagacgaggctgactatcactcgcctacgtcacgccggcctacgaggttgggtagggttgggttcggttcgggacgggagggacctaggtcgaccgtacgtacggtcacggcccgaaggtcctcccgtcccccgtacggtacctaccttccgtccgttacccccg

SEQ ID NO: 162413 - DNA, 586 bp, Homo sapiens
  misc_feature: GYAE6OF01ACHKJ.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctcccctcctcactctctgcacaggctctgcggcctcctacgagctgacacagcccaccgtcggttttctgtgtcacgtgggacagacggccaggatcacctgctctggagatgcattgaccaaagcaatcgcttatcggaccagcagaagccaggccaggccctgtactgataatatacaaagagaatgagaggccctagacgggactccctaggagcgtattccgtccggactacaagtgacgagggacaacagtcacgttcacatcagtggagtccaggacagaagacgagctagaactatcaactcgacctacgtacacggccgacctcgtacggtgggtacgggttgggttcggttcggaccggggaaggtaccgtaaggttcggtaacccgtcgttacggtcgacggacccgaaggtccctaccggcccccttacgggtcctaccgttccttacggtcccccgtacccg

SEQ ID NO: 162414 - DNA, 516 bp, Homo sapiens
  misc_feature: GYAE6OF01A6NP5.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaaagcaatacgcttattggtaccagcagaagccaggccaggccctgtactgataatatacaaaagagaatgagaggccctcagggatccctgagcgattctccggctacaatgcagggacaacagtcacgttgaccatcagtggagtcaggcaagaagacgaggctgactatcactcgccactcagccggacctcgagtggtagggtgggtgttcggcggaggacagttgaccgtcgtaggtcagcccgaagcctcgcccctcggtcactctcgttccccgtccc

SEQ ID NO: 162415 - DNA, 568 bp, Homo sapiens
  misc_feature: GYAE6OF01D9CAK.33.78.H01.1.454.CMB.1.raw
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaaagcaatacgcttattggtaccagcaagaagccaggccacggccctgtactgataatataacaaagagaatgagacggccctcgagggatcccgtagacgcgtattccgtccggctacaagtgacgaggacaacagtcacgtgacatcagtggacgtcgaggcaagaagacgagctgactatcacncgccacncacgcgacctcgaggtggtagggtgggtcggtcgggcgggacgggtaacgagttcggaccgtacgtacgggtacacggacccgaacggccgtccggccccccgttcggtacccaccgttcccgtcccggttccccgtcccccg

SEQ ID NO: 162416 - DNA, 694 bp, Homo sapiens
  misc_feature: GYAE6OF01A6OW5.33.78.H01.1.454.CMB.1.raw
  modified_base (199)..(199): a, c, t, g, unknown or other
  misc_feature (199)..(199): n is a, c, g, or t
  modified_base (248)..(248): a, c, t, g, unknown or other
  misc_feature (248)..(248): n is a, c, g, or t
  modified_base (272)..(272): a, c, t, g, unknown or other
  misc_feature (272)..(272): n is a, c, g, or t
  modified_base (497)..(497): a, c, t, g, unknown or other
  misc_feature (497)..(497): n is a, c, g, or t
tcagtacacacactcacgaccggtgctcgatttagtgtgagtagtttgggtttggggctgtggggtcccaaggaggccagaacgtctgggtcgtctcaccatggcctggatcccctctacttcctccccctcctcactctctgtcacaggctctgccggcctccgtacgacgctcgacacacgccaaccgtcggtttcnggtgtcacgtgggacaggaccggcctagggactccacctggctctgganatgctattgaccaaagcaatacgnttatgtaccagcagagccagccacggccctagtactgataatataacgaaagagaatcgaagacggccctagaaggactacctagagcgtaactttccaccggactaacaagtcgacgaacgggaacaaacgtacgttacgaagtttacgaaccacgtacgtaacggtacggacgttacccgaacgggaccaagggaaacgacggaacggtctaacggacttaanaccgtaactcggacccaacgttaccgaaggtacccggaaccttacggaacgggttacggggttaggtacgggggttcgttaccggggagggtaaccggtacggtaacgggttaccggacccgggttacgtaacggttacgaccggtacccgaacgggtcccgtccggtaccccccgttggtccgtaccgttcccggg

SEQ ID NO: 162417 - DNA, 621 bp, Homo sapiens
  misc_feature: GYAE6OF01DA251.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgctttagttggtaccagcaagagccagccaggccctgtactgataatataacaaagagaatgagacgcctcgagggactcccgtgacgcgacttcgccggactaacaatgacgaggaacaacgagtacacgttacgaccatacgaggttacggacgtccgaggaccgaaggaaacgacggtaggacgtagactatacactcgaccacctcgacggtaccgacttacgaggttgggtaaggttgggttacggttcggggacgggacgggtaaccgtaaggttccggacccggttacgtacggtaccgaacggacccgaacgggtcctcccggcccccgttacgggtaccctacccgtttccgtcccgttcccccgtccccg

SEQ ID NO: 162418 - DNA, 754 bp, Homo sapiens
  misc_feature: GYAE6OF01EBYPW.33.78.H01.1.454.CMB.1.raw
  modified_base (252)..(252): a, c, t, g, unknown or other
  misc_feature (252)..(252): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagcccaccgttcggtttctgtgtcacgtgggacagacggccaggatccacctgctcgtggagatgctagttcgaccaaagcaatacgtntttattcggtaccagcagaacgccgaggccacggccctagtactgaactaataataacgaagaagaagtgagacgcctcgacgggtactcccgtgacgcgtactccgtccgactaacaatcgacgagggaaccaacgtacgtccgtaacggtttccgaacctatacgtaggtacgggtacgtaccggaggacgaaggaaacggacggaacgggactacggtaccttactaccgtacgtaccgaccctacgtaccggaaccggtaccggaacccgttacggtaggggttacggggttagggggtttaggggttaccgggtttaccgggggaaccggggtaaccggggtaaccgttacgggttacccggttacccgggttaccggttaccgggttaacccgaccgggtaaccccggttaacgggcccccgttacccggtccccccccgttcgggttacccctacccggtttccctttccccgggttccccccgttaccccccgg

SEQ ID NO: 162419 - DNA, 872 bp, Homo sapiens
  misc_feature: GYAE6OF01CABC7.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgcggcctcctacgagctgacacacgccaccgtcggtttctgtgtcacgtgggacaggacggccaggactcacctgctcgtggagatgctattcgaccaaagcaatacgtctttagttcggtaccagacaagaacgccgaggccacggtcccctagtactgaattaaataataacaaagagtaagtagacgacggccctagaacgggtactcccgtaggacgtcgtactttccgtacccggtactaaaccgaagttcgggaacgaacggggaaaccaaacgtaacggttaccgtaaccggtttacggaaccgtaacgtacggtaagggttacggggaaccgttacccggaagggaccgaaagggaaacgggaaacccgggtaacgggtacgttaaacggtaacccgttaacgttaaccgtacccgttacggaacccctacgttacccggaacggtacccgggtaacccttacgggtaagggttacgggggttacggggtttcgggggttaccgggttcgggggaaccggggtaccgggttaaaccggttaacggggtttaacccgggtaacccgggttacccggttaaccggggttaacccgaaccgggtaacccccggttaaacggggtccccgtttacccccgggtacccccccgggtttacccggtttaccccggtaaaccccgtttttcccggtttccccccgggtttccccccgtacccccccggg

SEQ ID NO: 162420 - DNA, 573 bp, Homo sapiens
  misc_feature: GYAE6OF01D644Y.33.78.H01.1.454.CMB.1.raw
  modified_base (415)..(415): a, c, t, g, unknown or other
  misc_feature (415)..(415): n is a, c, g, or t
tcagtacacacactcacgaccggtgctcgatttagtgtgagtagtttgggtttgggggggtccaggaggcagaactctgggtgtctcaccatggcctggatccctctacttctcccctcctcactctctgcacaggctctgcggcctcctacgagctgacacagccaccgtcggtttctgtgtcactgggacagacggccaggatcacctgctctggagatgcattgaccaaagcaatacgcttatggtaccagcagaagccaggccacggccctgtactgataatatacaaagagaatgagaggcccgtggggactcccgtgacgcgtagttcgtccggactacaatcgcgaaggacaacagtacacgttacgacctatcagtggacgtcgaggcaagagacgagctagactancactcgacctactcagcgacctcgaggtaggtagggtcgggtcgttacggcgtacgggacggacgtaaggttcgaccgtacgtacggtccgacgacccggaacggtccgtccgtcccccgttcggtacctaccgttcccgttccgtccccgtaccccg

SEQ ID NO: 162421 - DNA, 809 bp, Homo sapiens
  misc_feature: GYAE6OF01D60SB.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccggtcggtttctgtgtcacgtgggacaggacggccgaggactccacctgctcgtggagatgctattcgaccaaagcctaaatccgtactttagttacggtaacccagacgaaggaaacgcccgaacggcccgaaccggccccttaggtaacctaggtaattaaaagttaactaaacgaaaaaggaagtaaacgtaggaacggtaccggtaccccgtacgaacggggtacctcccgtaggaacggtacgtacgttccgtaccggtactaacgaacgtcggaacgaacggggtaacaaaccgtacggtaccgtaccggttacgaaccgtacgtacggtaggtacgggtaaccgtccggaagggaccgaaggtaaaccgggacggacggtacgtacgtaactacgtacccgacgtcgtaccctacgtaccgacgggacccgtaccgtacgtagggtacgggttaggggttcgggtttcggtacgggggtaccgggtaagggaacccggttacgggttcccggtacccggtacccggttacgggtaacccgaccgggacccgtaaacggggtccccgttaccccggtcccccggttaccggtcctacccgtttcccgttccccggttccccccgttaacccccg

SEQ ID NO: 162422 - DNA, 624 bp, Homo sapiens
  misc_feature: GYAE6OF01EWK6U.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttcctgtgtcacgtgggacagacggccaggatcacctgctctggagatgcattgaccaaagcaatacgtcttattggtaccagcaagaagccaggccacggcccctgtactgaactaatataacgaaaagagaaatggaagacggccctagacgggactcccgtaggacgcgtattccgtccggactaacaacgtcgacgaacgggacaaacgtacgtaccgacggttcgaacctaagtccgaagggtcggaacgtaccgaaggacaaaggaaggacgagcgtagacttatccacgtcgaccactacgacgccgtacctagaggtggtaggtcgggttagtacgggacggaacgggtaccgtaaggttccggaaccgttccgtaggtaccgacggtcccgaacggcgtcccgtccccgttcggacctaccgtccgtcccgtacccc

SEQ ID NO: 162423 - DNA, 680 bp, Homo sapiens
  misc_feature: GYAE6OF01BA684.33.78.H01.1.454.CMB.1.raw
  modified_base (251)..(251): a, c, t, g, unknown or other
  misc_feature (251)..(251): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcacgtgggacagaccggccaggatcacctgctcgtggagatgcattgaccaaagcaatacgnttattggtaccagcagaagccaggccaggcccctgtactgataatataacaaagagaatggaagacggccctcgagggacttaccccgtgacgcgtaattcctccggctaacaatgacgaacgggaacaaccgaagtctacggttacgacctaagtacgagtacgggtacgtaccgacgggtacaaaggaaacggaaccggacggtacgtacggtaactacgtacccaacgtcggaaccctacgtaccgaacggacccggtaccgtaccgtacggttcggggttagggttcgggttacgggttccgggcgggtaaccggggtaaccgtaacgggttacggtacccggttaccggtaacgggtaccgaaccggacccgtaacgggtacccgttaccggaccccccggttcggtcccgtaccgttaccccg

SEQ ID NO: 162424 - DNA, 576 bp, Homo sapiens
  misc_feature: GYAE6OF01D6SPP.33.78.H01.1.454.CMB.1.raw
  modified_base (221)..(221): a, c, t, g, unknown or other
  misc_feature (221)..(221): n is a, c, g, or t
  modified_base (436)..(436): a, c, t, g, unknown or other
  misc_feature (436)..(436): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcacgtgggacagacggccaggatcacctgctctgganatgcattgaccaaaagcaaatacgctttagttcggtaccagacaagaacgccaggcccacggccctagtactgaataatataacaaagagaatgacgacggaccctagaagggactccgtgagcgattcgccggctacaatcgacgaggaacaacagtcacgtcgaaccatactaggtggacgtaccgaaggcaaggaacgacgagctagactancactcaccactcagcgactgaggtggtaggtggtcggtcgggacggtacggacaagtcgtacggaccgttcgtacgggacacggacccgaaggtccctcccggtcccccgtggtaccctccgttccgttccgtacccccg

SEQ ID NO: 162425 - DNA, 643 bp, Homo sapiens
  misc_feature: GYAE6OF01CCKCC.33.78.H01.1.454.CMB.1.raw
  modified_base (222)..(222): a, c, t, g, unknown or other
  misc_feature (222)..(222): n is a, c, g, or t
  modified_base (301)..(301): a, c, t, g, unknown or other
  misc_feature (301)..(301): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcacgtgggacagacggccaggatcactgctctgganatgcattgaccaaagcaatcgcttatggtaccagcagaagccaaggccaggcccctgtactgaataatataacaaaganaatgagaggtccctcgaagggtactcccgtagaggccgtaattccgttaccggacttaacaaagtcggacaacgggaacaacgacgttacacgttacgacctagttcaggttacggacgtccgaaggacaaggaaagacgaaggcctagactatcactacgaccactcgaacgcggtaacctacgagggttacgggtagggttcgggttaggttaccgggacggaaggggtaccgtaaggttccggtaccggttccggtaacggtccgaacggccccgaaagggtcccgtaccggtacccccgttcggtacctaccgtttcccgtccggttttaaccccccg

SEQ ID NO: 162426 - DNA, 684 bp, Homo sapiens
  misc_feature: GYAE6OF01D9NK5.33.78.H01.1.454.CMB.1.raw
  modified_base (291)..(291): a, c, t, g, unknown or other
  misc_feature (291)..(291): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgaccacacgccaccgtcggtttctgtgtcactgggacagacggccaggtatcacctgctctggagatgcaattcgaccaaagcaatacgctttagtggtaccagcagaagccaggccacggcccctgtacngaactaatataacaaagagtaatgagacggccctagaggtactccctagagcgattccgccggactacaagtcgacgaggtacaacgagtacgacgttacgaacctagtacgaggtcggactacccgagggacaaagggaaacgaccggaagtcgtacggaactacgttaccacgttacgaccctaacgtaccgaacggtacccggtaaccgtacggacgggttttcggggtaaggggttcgggttacgggttacccggggagggtaacgggtaaccgtaggggttacccgacccggttacggttaccggacgaacccggtacccgtacgggtaccccgtccccggtacccccgtacgggttacccaccgttcccggttcccggtaccccccg

SEQ ID NO: 162427 - DNA, 544 bp, Homo sapiens
  misc_feature: GYAE6OF01CXROU.33.78.H01.1.454.CMB.1.raw
  modified_base (422)..(422): a, c, t, g, unknown or other
  misc_feature (422)..(422): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttatggtaccagcagaagccaggccaggcccctgtactgataatatacaaagagaatgagaggccctcagggactccctgagcgattcctccggactacaatgcgagggacaacgagtcacgttacgaccatcgagtggaacgtccgaaggcaagaagacggaggactgactatcacngccactcagcgacctgaggtggtaggtgggtgttcgggcggaggacctaaggtcgaccgtcgtacggtcacggcccgaaggcctccgtcccccgtcggacctacgtccgtccgttacccccg

SEQ ID NO: 162428 - DNA, 573 bp, Homo sapiens
  misc_feature: GYAE6OF01EJ126.33.78.H01.1.454.CMB.1.raw
  modified_base (407)..(407): a, c, t, g, unknown or other
  misc_feature (407)..(407): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaaatacgcttaattggtaccagcagaagccaggccaggcccctgtactgattaatataacaaagagaaatgaggacggccctcgagggactcctgagcgtattcgtccggactacaagtgacaagggacaaacagtcacgttgaaccatacaggttggacgtccgaggnaaggaagacggacggctagactagttaccagtcgacccactcgagccggaaccttcgaagtgggtagggttgggtcgttcgggacggacgggtacctaggttcgacccgttccgtaggacaccggccaacggcctccgcccctcggtaccacgtccgtcgttcccc

SEQ ID NO: 162429 - DNA, 723 bp, Homo sapiens
  misc_feature: GYAE6OF01A6Q6K.33.78.H01.1.454.CMB.1.raw
tcagtacacacactcacgaccggtgctcgatttagtgtgagtagtttgggtttggggaaaacctcattcctcctctaaagaagcccctgggagcacagcgcatcaacatggactggacctggaggttcctctttgtggtggcagcagctacaggtgtccagtcccagttccaactggtacaatctgggtctgaggtgaagaggcctgggtcctcggtgagggtctccgtgcagtgtctcgtgggacgccgcctttcacgccacctatcgcccatcacctgggtgcgacacggccccggacaagggcttgagtggagtgggggtatcactccctctcgttcggcacaatacacgtacgcccaactaaatttcaacgacacgagtgctaagtttcgacgaaacgaataccaaacgaccacacgtacccaacagtaggacgttaggaacggacgtaccgtagaccagttccgtaagaacgacgaaccggtccgttaattacttaacgttgtacgacgggtaagaacggtaactaaccgtaaaagtcgggtacgggtacggtaaccgttaaaacgggtttaccggggttttaaccggggttttacggtaccccggtttacccggggttaacccggggggtacccccggttaaaacccggggggttaaacccccctttgggggtttaacccgttaaccggtttccccggtttcccgtttaacccccgg

SEQ ID NO: 162430 - DNA, 753 bp, Homo sapiens
  misc_feature: GYAE6OF01C7F5I.33.78.H01.1.454.CMB.1.raw
  modified_base (251)..(251): a, c, t, g, unknown or other
  misc_feature (251)..(251): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcacgtgggacagacggccaggatcacctgctcgtggagatgcattcgaccaaagcaatacgnttattgtacagcagaagccagccacggccctgtactgataatataacaaagagaagtgagacggccctacgagggactcccgtgacgtcgtacttccgtccggtactacaagtcgacgaacgggaactaacgagtactaacggtttacgaacctaactcgtaggtaggtaacgtaccgaggggacaacgggaaacggaacgggtacggacgtacggtaacttacgtaccctacttacggacccctaccgttaccgaacggtacccggtaccgttacggtagggttacggggttaggggttcgggggtttacgggtttccgggggtaacggggtaaaccggggtaaacccgttaaacgggtttacccgggtaaccccgggtttacccgggttaacgggttaaccccgaaacccgggtacccccggtaaacgggtccccggttacccccgggtacccccccgggtttacccggggttaccccgtaacccggttttccccccggg

SEQ ID NO: 162431 - DNA, 545 bp, Homo sapiens
  misc_feature: GYAE6OF01AHDL1.33.78.H01.1.454.CMB.1.raw
  modified_base (435)..(435): a, c, t, g, unknown or other
  misc_feature (435)..(435): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttattggtaccagcagaagccaggccacggccctgtactgataatataacaaagagaatgagacggccctacgagggactcccgtagacgcgtacttccgtccggactaacaagtgacgagggacaacgagtccacgttacgacctagtacagtgagtccaggcagaacgacgaggctagactactactacncgaccacgtcgagccgactcgaggtggtggtggtgtcggacggaggacgtagtcgaccgtagtcggtcacgaccgacggctccgccccgtcgtacactctcgtcccctcc

SEQ ID NO: 162432 - DNA, 723 bp, Homo sapiens
  misc_feature: GYAE6OF01DWDVH.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgttcggtttctgtgtcacgtgggacagacggccaggatcacctgctctggagatgctattgaccaaagcaatacgctttattggtaccagcaagaacgccaggccacggcccctgtactgataatataacaagagaatgagacgccctacgagggactcccgtgacgcgtacttccgtccggacttaacgaacgtcgaccgtaacgggaacaaacgtacgttaccgtaaccgtttacggaaccctagtacgaagggttcgggaacgttcccggaaacgggacaaaggaaacggaacgggtacggaccttaggaaccttaagtaccgaaccttcggaccctacgtaccgaacgggtacccgggtaaccctacggtagggtttacggggttagggttcgggggttacgggtttccggggaccggggaaacggggttacccgtaaaggtttccgggtaacccggttacccggttagggtacccgaacggtaccccgaaacgggtcccgttaaccccggtccccccgttacgggttccaacccgtttccccg

SEQ ID NO: 162433 - DNA, 542 bp, Homo sapiens
  misc_feature: GYAE6OF01ANL1X.33.78.H01.1.454.CMB.1.raw
  modified_base (225)..(225): a, c, t, g, unknown or other
  misc_feature (225)..(225): n is a, c, g, or t
  modified_base (533)..(533): a, c, t, g, unknown or other
  misc_feature (533)..(533): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctgganatgcattgccaaagcaatacgcttattggtaccagcagaagccaggccaggcccctgtactgataatatacaaagagaatgagaggccctcgagggatccccgtgagcgattctccggctacaatgcagggacaacagtcacgttgaccatcagtggagtccaggcagaagacgaggctagactatcaactcgaccactcacgaccgacctcgaggttggtaggttgggtacgttcgggcggaggaccgaaggttcgaccggttccgaggttccacggtcccaacggtcctacgcccccgtcggtccnccgttcccg

SEQ ID NO: 162434 - DNA, 615 bp, Homo sapiens
  misc_feature: GYAE6OF01EC1A3.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgctattgaccaaaagcaatacgcttattcggtaccagcaagaacgccaggccacggccctagtactagaataatataacaaagagaatgagacggccctacgagggtactcccgtagacgtacgtacttccgtaccggactaacaagtgacgaagggaccaaacgacgtactacgtacgaaccagtcgaggtcggacgtccgaaggacaaggaacggaacgaggctagtaactatccactcgaccactcgagccggactacgtaggttgggtaggggttgggtcggtcgggacgggacgggaccgtaaggttcgacccggtcgtacggtcacggaccgacggcctcccggcccccttcgggtaccctaccgttccttccgttcccctaccccg

SEQ ID NO: 162435 - DNA, 575 bp, Homo sapiens
  misc_feature: GYAE6OF01DYP2L.33.78.H01.1.454.CMB.1.raw
  modified_base (227)..(227): a, c, t, g, unknown or other
  misc_feature (227)..(227): n is a, c, g, or t
  modified_base (452)..(452): a, c, t, g, unknown or other
  misc_feature (452)..(452): n is a, c, g, or t
  modified_base (569)..(569): a, c, t, g, unknown or other
  misc_feature (569)..(569): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgttcggtttctgtgtcacgtgggacagacggccaggatcacctgctctgganatgcattcgaccaaagcaatacgctttattcggtaaccagcaagaagccgaggccacggcccctgtactgaataatataacaaaagagaatgagacggccctgagggactcccgtgacgcgtacttccgtccggactaacaatcgacgaagggacaacgagtacgtacgttacgaccatcgaggtacggagtaccgaggacaaggaacgacggagtctagactanacactcgaccacgtcgaacggccgactcgaggttgggtagggtggtcggtcgggacggacggaccgtaggtcgaccgtcgtaggtcacggaccgacggtcctaccgccccgtcgtcncgtccg

SEQ ID NO: 162436 - DNA, 728 bp, Homo sapiens
  misc_feature: GYAE6OF01DONQF.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgttcggtttctgtgtcactgggacagacggccaggatcacctgctctggagatgactattcgaccaaagcaaatacgtctttaattggtaaccaaggcaagaacgccgacggacccgacggccccttagtaactagaacttaataataacgaaaagaagaatggaagacggccctaggacgggtactcccgtagacgcgtattccgtccggactaacaagtcgacgaacgggacaaacgtacgtaccgtacgtacgaccaatcgtaggtacggacgtaccgacggaacgaaggtaaacggacggacgtcgtaagtacctaacgtacaacgtccgaccctaaccgtcgacgggcccgtaaccgtacgtacggggttagggttaaggggttcggggttacgggttacggggacgggtaacgggtaacgtaacggtttaccggacccggttaaccggtcgggtaaccctaccggaccccggtaaacgggtccccgttaacccggtccccccggttacggtaccctacccgtttcccgttccccggttcccccgtacccccg

SEQ ID NO: 162437 - DNA, 707 bp, Homo sapiens
  misc_feature: GYAE6OF01EIZCW.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttcctcccctcctcactctctgcacagctctgcggcctcctacgagctgacacagccaccgttcggtttctgtgtcacgtgggacagacggccaggatcacctgctcgtggagtatgactagttcgaccaaaagctaaatacgtctttagttcggtaaccaggacaaggaacgcccgaacggcccgacgggccccttagtaaccttaggaattaaattaaacgtaaaccgaaaaaggtaaggtaaaagttaggaaacggacggtaccccgtacggaacgggtacttccccgtaggacgtacgtactttccgaccggtataacgaagtcgacgaggtaaccaacgtagtacctacgttacgaacctagtaccgtaggtcggaacgtccggaaggacgaaggaaggacggaggactagaacttacgccaacgtcgacctactcgacggccgtaactcgagggttaggtacgggtgggttcggtccgggagggtacggaccgtacggtcgaccggttacgtacggtcgaccgacccggtaagccccggtacccgtaccccgttcggtacctaccccgttccgttcccgtccccgtaccccg

SEQ ID NO: 162438 - DNA, 688 bp, Homo sapiens
  misc_feature: GYAE6OF01CQL3E.33.78.H01.1.454.CMB.1.raw
  modified_base (223)..(223): a, c, t, g, unknown or other
  misc_feature (223)..(223): n is a, c, g, or t
  modified_base (351)..(351): a, c, t, g, unknown or other
  misc_feature (351)..(351): n is a, c, g, or t
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgcggcctcctacgagctgacacagccaccgtcggtttctgtgtcacgtgggacagacggccaggatcacctgctcgtgganatgctattcgaccaaagctaatacgtctttagttcggtaccagcaagaacgccaggccacggccctgtactgaataataataacgaaagagtaatgaagacggaccctacgacggactcccgtagacncgtacttcgtccggactaacgaaagtcgacgaagggaacaacgtacgtaccgtacgttacggaacctagtacgtaggtacggtacgtaccgaaggacgaaacggaacgggaacggtacggacgtaacggaatacctactacgtaccgccaaccgttacgaacgaccggtacctacggagggttagggttacggggttcggggttcgggttccgggtacggggacgggtacccggtaagggttccgacccggtacgtacggtccgaccggacccgtacgggccccgtaccgtcccccgtcggttaccctaccgttcccgtcccggttccccgtccccg

SEQ ID NO: 162439 - DNA, 637 bp, Homo sapiens
  misc_feature: GYAE6OF01CZGRG.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctcgtggagatgcattgaccaaagcaatacgcttattggtaccagcaagaacgccaggccacggccctgtactgataatataacaaagagaatgagacggccctagaggactcccgtgagcgtattccgtccggactactaatcgcgaaggaacaacgagtctacggttcgaacacgtcgaggtcggacgtcgaggtacgaaggaacggacggacgcgtacgtactatcgaactcgacccactacgacgtaccggtaccttacggaggttcgggttagggttcggggttcggttcggggtaccgggaacggggtaacccgtagggttaccggtaccccggttcgttaacgggtaccgaccgggtaccccggaacggtcccgtacccggcccccgttacggtcccgtacccgtttccccgg

SEQ ID NO: 162440 - DNA, 752 bp, Homo sapiens
  misc_feature: GYAE6OF01BXTVG.33.78.H01.1.454.CMB.1.raw
  modified_base (224)..(224): a, c, t, g, unknown or other
  misc_feature (224)..(224): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagcccaccgttcggtttctgtgtcacgtgggacagacggccaggatcacctgctcgtgganatgctattcgaccaaaagcaagtacgtctttagtcggtaccagacaagaacgccgacggcccgacggccctagtactagtaataatataaacaaagaagaataggagacggcccgtagacggactcccgagacgacgtacgttccgccggtactaacgaagtcgacgaacgggaacaacgacgtacgtacgttacgaacctagtacgagggtcgaacgtaccggaaggacgtaagggaaacgggaccggaggtaccgtaacgtaaacgttaccgtaccgtaaccgttaccggaaccctaacggttccggaaccgggtacccggtaacgttaccgggtaggggtttaacgggggttaggggttccggggttaggggttacccggggacggggtaaccgggtaccggttaaaaccgggttccggtaacccccggttaggtaaccgggacgtaacccggacccggtaacgggtccctacccggcccccggttcggaccctaccgtttcccgtaccccgttcccctaccccg

SEQ ID NO: 162441 - DNA, 665 bp, Homo sapiens
  misc_feature: GYAE6OF01ERUGR.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaaagcaaatacgtcttaattggtaccagcaagaagccaggccaaggcccctgtactgaataatataacaaagagaatggagacggccctgagggactccctgacgacgtattccgccggctaacgaagttcgacaacgggtacaaacgagtacgaacggtttagaacctagtacgtaggtaggacgtaccgaagggacaaggaaacgtacggaaggtcgtaacggaacttaacgtcgaacctacgtacccacgtaccgacggaccggtaccctacgacggttacggggttagggttggggttcggttacgggcggggtaacgggtaccgtaaggttccggaaccggttaccggtaggtaccgtacggaccccgtaacgggtctacccggtcccccgtacggtaccctccgttcccgttcccgttacccccg

SEQ ID NO: 162442 - DNA, 670 bp, Homo sapiens
  misc_feature: GYAE6OF01EJ5AM.33.78.H01.1.454.CMB.1.raw
  modified_base (327)..(327): a, c, t, g, unknown or other
  misc_feature (327)..(327): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgtcttattggtaccagcagaagccaggccaggccctgtactgaataatataacaaagagaatgagaggccctgagggactccgngacgcgtattccgtccgactaacaagtcggacgaacgggaaccaacgtacgtaccgtacgttacggaaccctataccgaaggttacgggaacgtacccgaagggacaaagggaaacgacggaacggtcgtagtaaccttataccaacgtcgaccctactccgacggccggtacctacggtaggtggggttagggttcggggttcggttccggggacgggtaacggggaaccgttaacgggttaccggtacccgttccggtacgggttaccgaacggtccccgaaggtcccgtacccggtcccccgttacgggtaccctacccgtttccgtcccggttcccccg

SEQ ID NO: 162443 - DNA, 723 bp, Homo sapiens
  misc_feature: GYAE6OF01CWQV8.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttcctccccctcctcactctctgcacaggctctgccggcctcctacgagctgacacacgcccaccgttcggtttctggtgtcacgtgggacaggacggccaggactccacctgcctcgtggagatcgctattcgaaccaaagcaagtaccgtactttagttcggtaaccagacaagaacgaccgacggccaccggtcccctagtacctagtaataatataacgaaagagaatggaacggacggccctaggacgggtacctcccgtaggacgacgtacttccgccggactaacagtcggacgaacgggaaccaacgtagtaccgtacggttaccgaacctagtacggtaggtcgggtacgtaccggaggacgaaggaacggacggaggcgtagaactactaccacgtcgacctacgtccgacggaccggtaccgtcggtagggttcggggttaggggttcggggttcggtacggggaccgggaacgggtaacccgttagggttacccgggtacccggttaccggttaacgggtcccgacccgggtacccggtaaccgggtcccgttaccccggtaccccccggttcggtccccgtacccgtttccccggg

SEQ ID NO: 162444 - DNA, 718 bp, Homo sapiens
  misc_feature: GYAE6OF01DF6K2.33.78.H01.1.454.CMB.1.raw
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcgcctcctacgagctgacacacgccaccggttcggtttctgtgtcacgtgggacaggacggccaggactcacctgctcgtgganatgcagttcgaccaaagcaatacgtnttagtcgtaccagcaagacgccgacggccacggtcccctgtacctagaattaaatagtaaacgaaagaagaagtaggaacggaccggtccctaggacgggtacctccgtagacgcgtacttccgacgtactaacgtagtcgacgaacggaacaacgtacgtaccgtaacggttacgaaccgtaataccggtaaggtacgggtaaccgtaccggaaggacgaaagggaaacggtacggacggtacgtagtaaccgtactaccgtacgtccgaacctaaccgtcggtaaccgtccggtaacccgttaggtagggttacggggttagggttcggggttcgggttaccggggaacgggtacgggtaaacccgttaaggtcccggtaacccggttagttacgggtcccgaacggtacccgtaagtccggtacccgtccccggtcccccgttcggccgttaccccgg

SEQ ID NO: 162445 - DNA, 793 bp, Homo sapiens
  misc_feature: GYAE6OF01EDM57.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgttcggtttctgtgtcacgtgggacagacggccaggactcacctgctcgtggagatgcattcgaccaaaagcaaatcgctttattcggtaccagcagaacgccaggccacggcccctgtactgataatataacaaagagaatgagacggccctagagggactccgtggacgtcgtacgttccgtaccggactaacgtaacgtcgaccgaacgggaaccaaacgtacggtaccgtaacggtttacgaaccctagttacgaagggttacgggaacgttacccggaagggacgaaacgggaaacgggaaccgggtaacggaccgttaacggtaaccttaacgtaccgtaaccgtccgacccttaaccgtaccgaaccgggtaacccgggtacccgttacgggtaacggggtttagggggttaacggggttcgggggtttaccggggttaccggggggtaccgggggtaaaccgggggtaaacccggttaaaggggtttacccgggtaaccccgggtttacccggttaacggggtacccgaacccgggtacccccggtaaacggggtccccgttaccccgggtacccccccggtttcgggttaccctacccggtttcccccg

SEQ ID NO: 162446 - DNA, 728 bp, Homo sapiens
  misc_feature: GYAE6OF01AS1IS.33.78.H01.1.454.CMB.1.raw
tcagtacacacactcacgaccggtgctcgatttagtgtgagtagttttgggtttgggggctgtgggtccaggaggcagaactctgggtgtctcaccatggcctggatccctctacttcctccccctcctcactctctgcacaggctctgcggcctcctacgagctgacacagccaccggttcggtttctgtgtcacgtgggacagacggccaggatccacctgctctggagatgctattcgaccaaaagcaaatacgtctttagttcggtaaccagacaagaagccgaggccgacggtcccctagtacctagaataaatactaaacaaaagagaataggaggacggcccctaggacgggtactccgtagacgtacgtactttccgtaccggacttaacgaacgtcggacgaagggaaccaaacgtacgtacgtacggttacaacctattacgaggtacggtacgtaccgagggacgaagggaacgaaccggagtacgtaacgtaacgtactaccgacgtaccgacctacgtaccgaacggtccggtaccgtacggtacgggtaggggttacggggtttacggggtcgggtttaccggggacgggggtaacgggtaaccggtaaacgggttccggtaaccccgggttacggttaaccggccgaacccggtacccggaacggttcccggtccccggtacccccgttccggtaccgttacccgtttcccgg

SEQ ID NO: 162447 - DNA, 766 bp, Homo sapiens
  misc_feature: GYAE6OF01BIFRS.33.78.H01.1.454.CMB.1.raw
  modified_base (253)..(253): a, c, t, g, unknown or other
  misc_feature (253)..(253): n is a, c, g, or t
tcagtacacacactcacgaccggtgctcgatttagtgtgagtagtttgggtttggggctgtgggtccaggaggcagaactctgggtgtctcaccatggcctggatccctctacttctccccctcctcactctctgcacaggctctgcggcctcctacgagctgacacagccaccgttcggtttctgtgtcacgtgggacagacggccaggatcacctgctctggagatgcattcgaccaaaagcaaattacgnttattggtaccagcagaagccaggccaggcccctgtactgataatataacaaagagaatgagacggccctcgagggactcctgacgcgtatttccgtccggactacaagtggacgaacgggaacaaacgacgttcgaacgtttgaaccctatacgtaagggtggtaacgtccgaagggactaaaggaacggaacggaacggcgtacggtaaccttaacgtacctaccgttaccggacccctaaccgttaccgaaccgggtaccccggttaaccccgttacggttaacggggtttacggggttaacggggggtttcgggggtttacgggttacccgggggtacgggggttaaaccggggtaaacccggttaacggggtttacccggttaaacccccgggtttccgggttaaaccggggttcccgttaaaccggggacccccgtaaacggggttccccgttaccccgggacccccccgggtttccgggtaccccgtttaacccggtttcccccgg

SEQ ID NO: 162448 - DNA, 654 bp, Homo sapiens
  misc_feature: GYAE6OF01DI8JH.33.78.H01.1.454.CMB.1.raw
  modified_base (409)..(409): a, c, t, g, unknown or other
  misc_feature (409)..(409): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctctcactctctgcacaggctctgcggcctcctacgagctgacacagccaccgtcggtttctgtgtcacgtgggacaggacggccaggactcacctgctcgtggagatgctattcggaccaaaaggccaaagttaccgtcttagttcggtaccagacagaacgccaggccacggcccctgtactgaataatataacaaagagaatggagacggtccctacgagggtacctccgtagacgtcgtaacgttccgccggtactaacgaagtcgacgaaggaactaaacgngtacgtacgtacactacgtacgagtaggacgtaccgaggacaacggaacgacggacggtctacgacttacgacgtactcggaccacgtccgacggaccgtacccgtaggtaggtacggggttagggttcgggtacgggttccgggagggtaccgggtaaccgtaggttaccggtaccggtcgttacgggtccaccgggacccgaacggtccctacccgggtccccctcgggtccaccgtttcccg

SEQ ID NO: 162449 - DNA, 645 bp, Homo sapiens
  misc_feature: GYAE6OF01CF6JB.33.78.H01.1.454.CMB.1.raw
  modified_base (202)..(202): a, c, t, g, unknown or other
  misc_feature (202)..(202): n is a, c, g, or t
  modified_base (247)..(247): a, c, t, g, unknown or other
  misc_feature (247)..(247): n is a, c, g, or t
tcagtacacacactcacgaccggtgctcgatttagtgtgagtagtttgggtttgggggaaaacctcattcctcctctaaagaagcccctgggagcacagcgcatcaccatggactggacctggaggttcctctttgtggtggcagcagctacaggtgtccagtcccagttccaactggtacaatctgggtctgaggtgaagnggcctgggtcctcggtgagggtctcctgcagtcgtctcgtggganccgtccttcagcacctatcgccatcaccgtgggtgcgacgacggaccccggacaagggtctggacgtggagtgggggtatcacgtccctactctcgtacacaatacacgtaccgaccaactaaattacaagtacagagtcgactaagtttcgacgtaaacgtaactacaaacgtaccacacgtaccatacgtggtaacgttagaggtacacgttagactatagtaacgaacaacgacggtacctaagttaactaccgtaggtacgaccggtaagagtaataacgaaagtaggtacggtacgaaggtaaaggttcgggtttaacgggttacggtacggtccggtacggggaccgtaaccggggtaaccctacggtaccgtacgttcgtcccgttacccg

SEQ ID NO: 162450 - DNA, 696 bp, Homo sapiens
  misc_feature: GYAE6OF01A9XBR.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagcccaccgttcggtttctgtgtcacgtgggacagacggccaggatcacctgctcgtggagatggcattcgaccaaagcaaatacgtcttattacgggtaccagcaaggaagcccgaggcccacgggccccctagtacctagaattaataataacgaaaagaagaaagtggaacggaccggaccctagaacggggtactccgtggacggcgtacttccgtccggactaacagtacgcgaggaacaacagtaccgtacgtcgacctatcgaggtacggtacggtacgaggacgaaaggaacggacggacggtacgtacggtaactacgtaccgaacgtacgacccaccgtacgaaccgggtacccggtacccgtacggtaaggttggggttaggggttggggttcgggtaccggggtacgggaacgggtaaccgtaagggttcccggtaaccggttacggttacgggtccgaccgggaacccggtacggtccggtaccccggtccccggtcggtccgtccgttacccgg

SEQ ID NO: 162451 - DNA, 769 bp, Homo sapiens
  misc_feature: GYAE6OF01D4MH5.33.78.H01.1.454.CMB.1.raw
  modified_base (156)..(156): a, c, t, g, unknown or other
  misc_feature (156)..(156): n is a, c, g, or t
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgcggcctcctacgngctgacacagcccaccggttcggtttctgtgtcacgtgggacaggaccggccaggatccacctgctcgtggagatgctagttcgaccaaagcaatcgtactttagttcggtaccagcgaagaacgcccgaggcccgacgggccccttagtaaccgtagaaattaacttaataaacgaaaagagaaatggaacggaccggccctacggagggtaccttacccgtaggacgtaccggtacttcccgtaccggtacttaaacgaggtacggaaccggaacggggaaacccaaaacgtacggttaaccgtaacccggtttacgaacccctagtaccgtaagggttcggaaccgttaccgacggaaccgaaggaaacggacggacggtctaacgaactacgtaccaccgtacgaccctacgtacgacggaccgtaacctcggtaggttacggggttagggttgggttaccgggttcgggacggggtaacggtaccgttaacggttacggtacccggttacggttaacggtccgaaccggtacccggaacggtcccgtccccggacccccgtttcgggtacccttaccggttcccgttccccgttacccccgtaccccg

SEQ ID NO: 162452 - DNA, 555 bp, Homo sapiens
  misc_feature: GYAE6OF01BNZZQ.33.78.H01.1.454.CMB.1.raw
  modified_base (316)..(316): a, c, t, g, unknown or other
  misc_feature (316)..(316): n is a, c, g, or t
  modified_base (424)..(424): a, c, t, g, unknown or other
  misc_feature (424)..(424): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgctattgaccaaagcaatacgcttaattggtaccagcagaagcaggccaggccctgtactgaataatatacaaaagagaatgagagccctanagggactccctgaacgcgtattctccggcttaacaagtgacaagggacaacgagtcacgttgaacctatcgagtcgagtccgaggacaggaagacgaggcctgactancacgtcgccatcagcgacctcaggtgggtaggtgggttcgttcgggacggacgggactaaggttcggaccgtccgtaggtcaggccccgaggtccctcggcccccgtggtaccactccgtccgttaccccg

SEQ ID NO: 162453 - DNA, 807 bp, Homo sapiens
  misc_feature: GYAE6OF01DG053.33.78.H01.1.454.CMB.1.raw
  modified_base (598)..(598): a, c, t, g, unknown or other
  misc_feature (598)..(598): n is a, c, g, or t
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgccggcctcctacgagctgacacagcccaccggttcgtttctgtgtcacgtgggacaggacggccaggactcacctgctctaggagatgctattcggaaccaaaagctaaagtacgtcttttagtttacggaaccagacaaggaacggaccgaacgggaccgaacgggtcccccttaggttaacctaggtaaattaaattaaacgtaaaaccgaaaaaggaaagtaaacggtaggaaacggaacccggtaccccggttacggaaacggggtacctttaccccgtagggaaccggtaccggttaacgtttacccgtacccggtaacgttaaaaccaacggtacggaaccggaaacggggtaaacccaaacggtaacggttaacctaacgggttaaccgaacccgtaagtaccgaaggttacgggaacgtaccgaggacaaaggtacgaacggaacgngttaacgactttacaccgaaccgtcgacccctaacgtacgacggacccggtacctacggtaagggtcgggttaggggtcgggttgggtaccgggacggggaacggtaccgtaaagggttccgacccggttacgtaccggtccgtacggacccggaacgtcccgtcccgtaccccgtgtaccctaccgtcctcccgttaccccgtccccg

SEQ ID NO: 162454 - DNA, 678 bp, Homo sapiens
  misc_feature: GYAE6OF01C1KHN.33.78.H01.1.454.CMB.1.raw
  modified_base (259)..(259): a, c, t, g, unknown or other
  misc_feature (259)..(259): n is a, c, g, or t
tcagtacacacactcacgaccggtgctcgatttagtgtgagtagtttgggtttgggggctgtgggtccaggaggcagaactctgggtgtctcaccatggcctggatccctctacttcctccccctcctcactctctgcacaggctctgccggcctcctacgagctgacacacgccaccgttcggtttctgtgtcacgtgggacaggacggccaggactccacctgctcgtggagatgctattcgaccaaagcaatacgntttagttcggtacagacaagaacgccgacggccacggccctgtactagaataataataacaaagagaatggagacgccctagacggactccgagagcgtacttccgtccgactacaagtcgacgaggaaccacgtacgtacgtacgttacgactagtacgaggtacggtacgtaccgaggacgaaaggaacggacggtacggtctaacggtaacttacgtaccgacctcggaccctaccgtacgacccggaccggtaccttacgggtagggttacggggttagggttcggggttcggtaccggggacgggtaacggtaccgttagggttaccggaacccggttacgtacggacccggacgtaaccccggtacggtcccgttaccccggccccctttacgggtccctacccggtttcccg

SEQ ID NO: 162455 - DNA, 756 bp, Homo sapiens
  misc_feature: GYAE6OF01DI6NS.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagctaaatacgtctttagttcggtaccagcaaggaacgccgaggccacggcccctgtactgaataagtataacaaagagaatgagacggccctcgagggactcccgtagacgcgtacttcgtccggtactaacaagtcgacgaagggaaccaaacgacgtacgacgttacgaacctacgtacggaaggtcgggaacgtacccgaacgggacgtaaaggaaacgggaaccggaacgggtaccgttaacggtaaccttaacttaccgtaaaccgttccgaccctaccgttaccgaaccggtcccggtaacccgttacgtagggttaggggttacggggtttcgggggttacggttacggggtacccggggacggggtaaacccgttaacgggttacggtacccccggttacgggtaccgggttaccgaaccgggacccccgtaaggggtccccttccccgggtcccccccggttcgggttaccccaccgttttcccccgttcccgttaccccccgttaacccccg

SEQ ID NO: 162456 - DNA, 791 bp, Homo sapiens
  misc_feature: GYAE6OF01CG8CN.33.78.H01.1.454.CMB.1.raw
  modified_base (185)..(185): a, c, t, g, unknown or other
  misc_feature (185)..(185): n is a, c, g, or t
tcagtacacacactcacgaccggtgctcgatttagtgtgagtagtttgggtttgggggctgtgggtccaggaggcagaactctgggtgtctcaccatggcctggatccctctacttcctccccctcctcactctctgcacaggctctgcgcctcctacgagctgacacagccaccgtcggtttcngtgtcacgtgggacaggacggccaggactccactgctcgtggagtatgctattcgaccaaagacaatacgtactttagttacggtacagacgaagaacgccgacggccgacggccccttagtactagtaataataataacgaaaagaagaagtagaacggacggaccgttaccggaagggtaccgtacccgtacggacggacgttcgttaccgttacccggtacgtaacgtaacgtacggaacggaacggaaacgaaaccgtaacgtaccgtaccgttaaccgtacctaaccgtagtacggtacgggaaccggtaccgaaccggagaaacggtaaggaaaccgggacggtaccgtaacgtaacgtacctacgtaactacccggactaccgtacgaacccggtaccggacctttacgggtacgggttgggttacggggttcgggttacgggttaccggggacggggtaaaccgggtcggtttaaaccgggtcccggttaaacccgggttcggttaaccgggtcccgaaaccggaccccggttaacccgggcccgttaaccccccgggtcccccgtttaaccgggtcccggtccccttttaccccggg

SEQ ID NO: 162457 - DNA, 758 bp, Homo sapiens
  misc_feature: GYAE6OF01EEPTC.33.78.H01.1.454.CMB.1.raw
tcagtacacacactcacgaccggtgctcgatttagtgtgagtagtttgggtttggggtggggtccaggaggccagaactcgtgggtgtctcaccatggcctgggactccctctacttcctccccctcgtccacctctctgcacaggcctctggccggcctcctacgagctgacacacgcccaccgttcggttttctcgttcgtccacgtgggacaggcggccgaggactccgacctcgcctgtggagtagtcggactagttcgaaccgtaacgtcaagttacgtcttttagtcggtacctagaacgaaagggacgccgacggccgtacgtcccctgtacctgaacttaactacgtaacaaaggacgtaagtcggaacgacggtacccgtagagggtacctcccgtagaacgtcggttacgttccggaccggtactaacgaacgtcgacgacggaacaacgtcgtacgacgttacgaacctagttacgtagggtacgaacgtacccgaaggtcgaaaggtaaacgacggaggtactacgacttacgtacacgtccgacccttacgacgtaccgggacgtaccgtacgtacgggttagggtaacggggttacggtaccggtaacggggtcgggtaacggtaccgtaaggttacccggtacccggttaccgttacgtacccggacgttacccggtaacggttcccctaccccggttcccccgtaggttaccccttaccggttccgttccgttaaccccccg

SEQ ID NO: 162458 - DNA, 672 bp, Homo sapiens
  misc_feature: GYAE6OF01DA8ZO.33.78.H01.1.454.CMB.1.raw
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (396)..(396): a, c, t, g, unknown or other
  misc_feature (396)..(396): n is a, c, g, or t
tcagtacacacactcacgaccggtgctcgatttagtgtgagtagtttgggtttgggggggtccaggaggcagaactctgggtgtctcaccatggcctggatccctctacttcctccccctctcactctctgcacaggctctggccgcctcctacgagctgacacacgcccacgttcggtttctgtgtcacgtgggacaggacggcaggatccactgctgnggantgctatcgaccaagcaatcgctttagtcggaaccagacgagacgccgagccacggccctgtactagaataatataacaaagagaataggagacgacctacgaggtactccgagacgacgtactccgtcgactaacagtcgacgacgaacaacgtacgtactacgtcaactancgtaggtacgtacgacgaggacgaagaacggacgtagtctagactacgactacgccactacgtacgagtacccgtactacggacgggttcgggtaacggttcgggtacgggttaccgggacgggtaacggtaaccggttaacgggtaccggtacccgttacgggtaacccggttaccgaaccgggtaccccggtacgggtccccgtacccgggttacccccccgttacggtacccttaccgttacccccgtttaccccgtcccccgttaacccccg

SEQ ID NO: 162459 - DNA, 863 bp, Homo sapiens
  misc_feature: GYAE6OF01DXFML.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttcctcccccctcctcactctctgcacaggctctgccggcctcctacgagctgacacacgcccaccggttcggtttctgtgtcacgtgggacacggaccggccaggactccaccgtgccttcgtagggagtatgactacgttcgaaccaaagaccaaattaccgtacttttaagttcggtaaccagacaaggaaccgccgacggacccgaccggtccccttagtaccgtagtaattaaactaacgtaaacgaaaaggaacgtaaagtggaacggtaccggtaccccgtacgggaacgggtcccttaccccggtaggaccggacgttaccgttcccggtacccggtaacttaaacgtaaacgtcggaaaccggtaacggggtaaaccaacggtaacgtaccgtaacgttacgtaacctagtacgtagggtacggaccgtaccgaacgggacgtaaacggaaacggacggtaacggtcgtaacggtaaccttactaccgtaccgtccgaccctaaccgtaccggaaccggtacccggtacccgtacgggtagggttagggggttacgggttcgggggttacgggtaccgggggaccggggtaaccgggtaacccggttaacggttacccgggtaacccggtttaccggttaccgggtacccggtaacccgggtaccccggtaaacccgggtccccggttaaccccccgggttccccccggttaccgggttccctaccccggtttcccccgg

SEQ ID NO: 162460 - DNA, 801 bp, Homo sapiens
  misc_feature: GYAE6OF01DD6DC.33.78.H01.1.454.CMB.1.raw
  modified_base (185)..(185): a, c, t, g, unknown or other
  misc_feature (185)..(185): n is a, c, g, or t
  modified_base (229)..(229): a, c, t, g, unknown or other
  misc_feature (229)..(229): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttcngtgtcacgtgggacaggacggccaggactcacctgctcgtgganatgcagttcgaccaaagcaattacgtactttagttcggtaaccagacaagaacgccgaggccgacgtccctgtactgaataataataacgaaaagagtaagtggaacggacggtacccctagaacgggtactcccgaggacgtacggtactttccgaccggtactaacgtaagtcggacgaaggaaccaacgtacgtaccgtacgttacgactagtacgtaggtacggaacgtaccgaaggtacgaaaggaaacggtaacggacggtacgtacggaaacttcgtaaccgtacttcccggacctaaccgtaccgaacggtacccggtaaccgttacgggtagggttacgggggttacgggttacggggtttccggggtaccgggggtaaaccggggtaacggggtaaacccggtttaacggggttaccgggtttaaacccccggttaccggggtttaaccggggtaccccgaacccggggtaacccccggtaaacggggttccccccgtttacccccggggtaccccccggtttaacccgggttccccgttaaaccccggttttccccccggg

SEQ ID NO: 162461 - DNA, 581 bp, Homo sapiens
  misc_feature: GYAE6OF01EURZB.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggttttctgtgtcactgggacagacggccaggatcacctgctctggagatgcattgaccaaagcaatacgcttattcggtaccagcagaagccaggccacggcccctgtactgataatataacaaagagaatggagacggccctacgagggactcccgtgagcgtacttccgtccgctacaatcgacgagggacaacgagtacacgtcgaccatcaggtggtacgtccgagggacaaggaaggacgaggtctagacctagtacactcgccactcgacggccgactcgtaggtgggtagggttgggtggttcgggcgggacgggacctaggttcgacccgttcggtacgtcgacgccgacggtcctccgcccccgttcgaccctaccgttccgttcccgtacccccg

SEQ ID NO: 162462 - DNA, 687 bp, Homo sapiens
  misc_feature: GYAE6OF01B7V2I.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgcggcctcctacgagctgacacagcccaccgtcggtttctgtgtcacgtgggacagaccggccaggatcacctgctcgtggagatgctagttcgaccaaagcaatacgtcttaagttcggtaaccagacaagaacgccgacggccgacggtccctagtactagaataaatataacaaagagaagtagacgacggccctagacggactcccgtagacgtcgtacttccgtccggtactacgaacgtgacgaagggaacaaacgtagtacgtacgttacgacctagtcgtaggtacgggacgtaccgaggacgaaggaacgacgtacggactacgactacgtaccacgtcgaccctacgtacgacgacccgtacctcgtaacgggttgggttacgggttcgggttcggttacgggacgggtacgggaaccgtaacggttccggacccgtacggttacggtacccgaccggacccggtaacggtcccttaccccggtacccccggtcggtaccctaccgtttcccgttccccgttcccccgtaccccg

SEQ ID NO: 162463 - DNA, 607 bp, Homo sapiens
  misc_feature: GYAE6OF01EMR60.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattcgaccaaaagcaatacgcttattggtaccagcagaagccaggccacggccctgtactgataatataacaaagagaatgagacggccctgagggactcccgtgagacgtattcgtccggactacgaatcgacgagggaacaacgagtacacgttacggacatcgaggtcggacgtccgaggacaaggaacgacgaggctagactatcacgtcgaccacgtcaacgccgtacctacgtaggtagggttagggtggggttcgttacggggacgggtacgggaccgtaaggtccggacccggtcgtaagggtccgacggacccggtaagggcccgtccggcccccgttaggtacccaccgttccgttccgtaccccgtaccccg

SEQ ID NO: 162464 - DNA, 645 bp, Homo sapiens
  misc_feature: GYAE6OF01E4U6G.33.78.H01.1.454.CMB.1.raw
  modified_base (298)..(298): a, c, t, g, unknown or other
  misc_feature (298)..(298): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttattggtaccagcagaagccaggccaggccctgtactgataatataacaaaganaatgagaggccctcgagggactcccgtgacgcgtacttccgtccggactaacaagtcgaccgaagggaaccaaacgagtcctaacggttacgaacctagtacgaggtgggacgtacccgaagggccgaaggaacggaacggacggtctagaaccttataccactcgacccactcgacggccggtacctgtagggtgggttaggggttcgggttcggttccggggacgggtacgggtaaccgtaaggttccgtacccggtaccgtacgggtccgaccggacccgaagggtccctacccggtccccccgttcggtaccctaccgttccttcccggtccccccgtccccg

SEQ ID NO: 162465 - DNA, 557 bp, Homo sapiens
  misc_feature: GYAE6OF01CRPKL.33.78.H01.1.454.CMB.1.raw
  modified_base (299)..(299): a, c, t, g, unknown or other
  misc_feature (299)..(299): n is a, c, g, or t
  modified_base (315)..(315): a, c, t, g, unknown or other
  misc_feature (315)..(315): n is a, c, g, or t
tcagtacacacactcacgaccggtgctcgatttagtgtgagtagtttgggtttgggggtgggtccaggaggcagaactctgggtgtctcaccatggcctggatccctctacttctccccctctcactctctgcacaggctctgcggcctcctacgagctgacacagcccaccgtcggtttctgtgtcacgtgggacagacggccaggatcacctgctctggagatgcattgaccaaagcaaatcgcttatgtaccagcagaagccaggccaggcccctgtactgataatataacaaagngaaatgagaggccctnacgggactccctgaacgcgtattctccggctaacaatgacaggacaacagtcacgttgaccatcagtaggacgtcaggtcaagaagacgaggctgacgtatcactgaccctactcagaccgacctcgaggtcgggtaggttgggtcggttcggcgggaggaccgtagttccgaccgtcgtacggtcacggcccgaacggtctaccgtcccccgttcgacctacctccgttcccgttaccccc

SEQ ID NO: 162466 - DNA, 727 bp, Homo sapiens
  misc_feature: GYAE6OF01DGYHT.33.78.H01.1.454.CMB.1.raw
  modified_base (225)..(225): a, c, t, g, unknown or other
  misc_feature (225)..(225): n is a, c, g, or t
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgcggcctcctacgagctgacacagccaccgtcggtttctgtgtcacgtgggacaggacggccaggactcacctgctcgtgganatgctattcgaccaaagctaatacgtcttattcggaccagcaagacgcgacggccacggccctgtactgaactaataataacgaaagagaataggacgtaccggcctacgacgggtactcccgtaggacgcgtacgttccgtaccggtactaacgtaagtcggacgaaggggaacctaacggacggttaccgtaacggtttacgaacctaacgttacggaacgggttacgggaaccggtccgaacgggtaccggaaagggaaacggaacgggtacggtacttacgggtaacttaaccgtacgaccgtaccgaccctaaccgtcgaacggcccggtaaccgtcgagggttcggggtaggggtttcgggtcgggttaccgggggacgggtaacgggaccggttaaggtccggtacccggtacgtaccgggtaccgacgacccgacggtcccgtccccgtcccgttaccggcctacccgttccgttacccgttcccccgtacccg

SEQ ID NO: 162467 - DNA, 705 bp, Homo sapiens
  misc_feature: GYAE6OF01C2Z6O.33.78.H01.1.454.CMB.1.raw
  modified_base (227)..(227): a, c, t, g, unknown or other
  misc_feature (227)..(227): n is a, c, g, or t
  modified_base (663)..(663): a, c, t, g, unknown or other
  misc_feature (663)..(663): n is a, c, g, or t
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgccggcctcctacgagctgacacagcccaccgttcggtttctgtcgtacacgtggacagacggccaggatccactgcctgtgganatgactattcgaccaagctaagtcgtcttagtcggacagacagacgcgacggccgacgccctgtactacgtataaataagtaacgaaagaagaagtagaacggtaccggccctaggacggtactaccgaggtacgcgtactacgtccgtactacgaagtcgacgacgggtaacacgtacgtacgtaacgtacgaacttagaccgtaggtcggtacgtaccgaaggtacgaaggtaacggacgacggacgtacggtaactacgtacacgtccgaccctacgacgacggaccgtaccgtaggttacgggtcgggtttacggggtcgggttacgggtcggggaaccgggtacgggtaaccgttagggtaccggtacccggttaccgaccggggttacaacccgggtcccggtaccggcccgttacccgtcccccgggtnttacccgttacccgtaccgttccccgaccccggttaaccccg

SEQ ID NO: 162468 - DNA, 680 bp, Homo sapiens
  misc_feature: GYAE6OF01D6CVW.33.78.H01.1.454.CMB.1.raw
  modified_base (286)..(286): a, c, t, g, unknown or other
  misc_feature (286)..(286): n is a, c, g, or t
  modified_base (424)..(424): a, c, t, g, unknown or other
  misc_feature (424)..(424): n is a, c, g, or t
  modified_base (459)..(459): a, c, t, g, unknown or other
  misc_feature (459)..(459): n is a, c, g, or t
tcagtacacacactcacgaccggtgctcgatttagtgtgagtagtttgggtttgggggaaaacctcattcctcctctaaagaagcccctgggagcacagcgcatcaccatggactggacctggaggtttcctctttgtggtggcagcagctacaggtgtccagtcccagttccaactggtacaatctgggtctgaggtgaagaggcctgggtcctcgggtgagggtctcctgcagttgtctcgtgggacgccggccttcagccacctatcgccatcaccgtgggtncgacacggccccggagaacggcttgagtggagtggggggtatcgactccctctcgttcggcacaatacgacgtaccgaccaactaatttacgaagacagagtcacgtaagtttcggacgtaaacatacaaccgaccanactaccaacagtagtagttagaggactccgtaganacgttcgagaacgtaccgacggtaccgttaacttacgttacgtaggtagaccggtaagtaagtaactaacgttaaagtcgggtaaggtaccggaaacgttaaaacgggtttcggggttttaaccgggtttacggaacccggtttccggggtacgggggtaccccggaaaccggggttaacccgttcggttaaccttaccgttccggttccttaacccccgg

SEQ ID NO: 162469 - DNA, 678 bp, Homo sapiens
  misc_feature: GYAE6OF01D2W7H.33.78.H01.1.454.CMB.1.raw
  modified_base (269)..(269): a, c, t, g, unknown or other
  misc_feature (269)..(269): n is a, c, g, or t
  modified_base (665)..(665): a, c, t, g, unknown or other
  misc_feature (665)..(665): n is a, c, g, or t
tcagtacacacactcacgaccggtgctcgatttagtgtgagtagtttgggtttggggaaaacctcattcctcctctaaagaagcccctgggagcacagcgcatcaccatggactggacctggaggttcctctttgtggtggcagcagctacaggtgtccagtcccagttccaactggtacatcgtggtctgaggtgaagacggcctggtcctcggtgaggtctccgtgcagttcgtctcgtgggacgccgtccttcgacgcctacctancgacctactccgaccggtgggtcgacgaccggaccggaccccggaacggaacgggtcgttaggtacggtagggtaggggttcgggggtaactccgtaccgttcccttcgttccgtcggactaactaactaccgtacgtacccgacctaaactaacgttacgaaagaacgaggtacgttagtaacggtttaacgtttacgaacgaaacgtaactacgaaaccgaccaacgactaccgaagtgtagggtagttagacgtacgactacgactagtacgagacgaccgtacgtactatacgtacgagtcgacgtagaacgtaataacgtaagtgacgtacgtaacgttaaggtttgggttacgttacgacgttccggacggaccgtacggtacgtcgtanccgtcgtccctcg

SEQ ID NO: 162470 - DNA, 650 bp, Homo sapiens
  misc_feature: GYAE6OF01A1TUB.33.78.H01.1.454.CMB.1.raw
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
tcagtacacacactcacgaccggtgctcgatttagtgtgagtagtttgggtttgggggaaaacctcattcctcctctaaagaagcccctgggagcacagcgcatcaccatggactggacctggaggttcctctttgtggtggcagcagctacaggtgtccagtcccagttccaactggtacaatctgggtctgaggtgaagaggcctgggtcctcggtgagggtcctccgtgcagtcgtctcgtgggagccgccttcagcctacctatcgccactcaccgtggtgcgacacggccccggacaaggtctgngtaggngtggggtatcactccctctcgtcggcacaactacacgtacgcccaactaattacgaagacagagtgactagtttacgacgtaacgaactacgaaaccgaccacgtacgtacccaacgagttagggacgttggaacgggtacgaccgtacgactagtcgtacgaacgaccgaacgggtcctaatacgttactaggtcgacgtagaagtacttaagaaagttcggaggtaccgtagtaaagggtttcgggtttaccgggtttacggaccggttcccggacgggggtaacccgtaacggggtaaccctcgggttaccgccttccggttcctacccgg

SEQ ID NO: 162471 - DNA, 624 bp, Homo sapiens
  misc_feature: GYAE6OF01EFPQG.33.78.H01.1.454.CMB.1.raw
  modified_base (305)..(305): a, c, t, g, unknown or other
  misc_feature (305)..(305): n is a, c, g, or t
tcagtacacacactcacgaccggtgctcgatttagtgtgagtagtttgggtttgggggtgggtccaggaggcagaactctgggtgtctcaccatggcctggatccctctacttcctccccctctcactctctgcacaggctctgccggcctcctacgagctgaccacacgccctaccggttcggttttctgtgtcacgtgggacaggaccggcaggactccaccgtgctgtggagatgctagtcgacaaagctaatcgtcttagtcgtacagacagacgcgagccacgccctgtactgataatanaacaagagaatgacgacgccagaggctccgagacgcgtacttccgcgactaacgagtcgaacgacggaccaacgtgtacctacggttacgacctagtcgaggtggaccgtccgaaggacaagggaacgacggacggtctacggactactacacgtacgacccatcgaacggccgtaacctgtacgggttgggtacgggttgggttcggacggggacggaccggtaacgttcggtaccgggtacctaccgggtagacccgacggtacccgtacggtcccttccccggtcccgtcgtaccctcgtcccgtccgtacccccg

SEQ ID NO: 162472 - DNA, 677 bp, Homo sapiens
  misc_feature: GYAE6OF01CWV27.33.78.H01.1.454.CMB.1.raw
  modified_base (224)..(224): a, c, t, g, unknown or other
  misc_feature (224)..(224): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcacgtgggacaggacggccaggatcacctgctctgganatgcattgaccaaagcaatacgctttatggtaccagcagacgccagccacgccctgtactgataatataacaaagagaatgaggacggccctacgagggactccctaggacgcggtattccgccggctaacaagtgacgaagggacaacgagtcgacgttagaacctatcgaggtggacgtccgaaggacgaagaaggacgacggcagactaactcgacctcgacctacgcgtacggaccggtaccgtacgtacgggttaggggtacgggttggggttacgggttacgggaccgggggtaacgggtaacccgttaaggggttcccggtaacccgggttacccggttaaacgggtaccgaaccgggtacccccggaaaggttccccggttaccggtacccccccgtttccgggtaccctaccccgtttcccggttcccgtttaccccccccggg

SEQ ID NO: 162473 - DNA, 724 bp, Homo sapiens
  misc_feature: GYAE6OF01A9ZMJ.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctcccctcctcactctctgcacaggctctgcggcctcctacgagctgacacagccaccgtcggtttctgtgtcactgggacagaccggccaggatccacctgctctggagatgcattgaccaaagcaatacgtctttagttcggaccagcaagaacgccacggccacggccctgtactgaataatataacaaaggagaatggagacggccctagacgggactcctggacgcgtacttccgtccggtactaacgtaatcgaccggaaaggggaaccaaacgtaacggttaccgtaacccggtttacgaacccgtactaccgtaacgggttcgggaacggttacccgtaacgggacgtaaaacggaaacgggtaacgggaacgggtacgttacggaaacccttacgtaccgaaccgtcggaccctaccgtcgaacggaccggtaacccgtggtacggttggggtacgggttgggggttacggttcggggacgggacgggtaaccgtagggttaccggacccggttccggtaagggtccgaacgaccccggtaaggtcccgtcccgtcccccgttacggtccctaaccggttcccgttcccggttccccgtccccg

SEQ ID NO: 162474 - DNA, 627 bp, Homo sapiens
  misc_feature: GYAE6OF01B7U67.33.78.H01.1.454.CMB.1.raw
  modified_base (140)..(140): a, c, t, g, unknown or other
  misc_feature (140)..(140): n is a, c, g, or t
  modified_base (231)..(231): a, c, t, g, unknown or other
  misc_feature (231)..(231): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacnggctctgcggcctcctacgagctgacacagcccaccgttcggtttctgtgtcacgtgggacaggacggccaggatccacctgctcgtgganatgcattgaccaaagcaatacgcttattcggtaccagacaagaacgccaaggccaacggcccctgtacctgaactaatataacaaagagaatgaagagccctagagggactcccgtagacgcgtattccgccggactaacgatcggacgaagggacaaacagtccgtacgtttacgacctatacagtacggacgttaccgaaggacgaagtaacggacgacggctaggaactactacgacgtcgacccactcgacgaccggaacctcgtaaggttcggtagggtcgggttacgtcgggacgggacggtaaccgtaggtcggtacccgtacgttacgggtccaacggtaccccgaagggtcccccaccccggttaggtacctaccgtcgttaccccg

SEQ ID NO: 162475 - DNA, 769 bp, Homo sapiens
  misc_feature: GYAE6OF01EOCPI.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcacgtgggacaggacggccaggatccacctgcctcgtggagatgctagttcgaccaaagcaaataccgtctttattcggtaacccagacaagaacgccgacggccacggcccctagtactagaataatactaacgaaagagaagtgaacggacggtaccctacgacgggtactcccgtagacgtacgtacttccgtaccggtactaacaagtcgacgaagggaaccaaacgtacgtaccgtacggttacgaacctagttaccgaggttacgggacgtaccgaacgggtacaaaggaacggaaccggtaacggtacgttaacggtaaccttaacgtacctaaccgtcgtaccctaccgtaccgacggtacccggtaccgtcggtaacgggttcggggttaacggggttgggggttaccgggttcggggacccggggtaacgggtaacccgttaacgggtttacccggtaacccggttacccggtaacggggtaccgtaacccgggtaaccccgtaaaccgggttccccgtaccccgggttacccccccgttaccgggttccccgtacccgtttacccccgg

SEQ ID NO: 162476 - DNA, 706 bp, Homo sapiens
  misc_feature: GYAE6OF01B32HZ.33.78.H01.1.454.CMB.1.raw
  modified_base (226)..(226): a, c, t, g, unknown or other
  misc_feature (226)..(226): n is a, c, g, or t
tcagtacacacactcacgaccggtgctcgatttagtgtgagtagtttgggtttgggggggtccaggaggcagaactctgggtgtctcaccatggcctggatccctctacttcctccccctctcactctctgcacaggctctgcggtcctcctacgagctgactacagccaccgttggttttctgtgtcacgtgggacaggacgccaggatccaccgtgctgtgganatgactagttcggaaccaaaagctaaactcgtactttagttcggaaccagcgaagaacgccgacggaccgacggcccttgtactagaattaaactataaacgaaagtacgaaagtcgaacgaccggtccctacggaacgggtacctccgtaggacggtaccgtacgttccgaccggtactaacgaagtcggacgaacggtaacaacgtacgtacgtacgttacgaacctagtacgaggttacggactccgaggacgaaggaaacgacggacgtacgtagaaccttacgtacgaaccgttcgaccctacgtacgaccggaccgtactacggtacggtgggtacgggttagggtcggttacgggacggacggtaaccgtaaggttccggaaccgttacgtacgggtacacccgggaccggtaacggtccgacccggtccccttacgggtaccaaccggtttcccgtccgtacccctacccgg

SEQ ID NO: 162477 - DNA, 713 bp, Homo sapiens
  misc_feature: GYAE6OF01BQHZ2.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattcgaccaaagcaatacgtctttattcggtaccagcaagaagccgaggccacggcccctgtactgaataatataacaaagagaatgagacggccctagagggtactcccgtaggacgtcgtacttccgtaccggctaacgaagtcgacgtaacgggaacaacgtacgtaccgtacggttacgaacctacgtacgaggtacgggacgtacccgaaggaccgaaagggaaacggacggaggactacgtaacttacgcacgtccgacctaacgtcgaacggccgtaccttaggaagggtttggggttaacgggttcggggttacgggttaccggggacggggtaaccggggtaacccgttaagggtttcccgggaacccggttaccgggttaacggtacccgaaccggaaccccggtaacgggtccccgttaccccggtcccccggttacgggtaccctaaccgttcccggttcccggttacccccccg

SEQ ID NO: 162478 - DNA, 709 bp, Homo sapiens
  misc_feature: GYAE6OF01B5O9C.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagcccaccgttcggtttctgtgtcactgggacagacggccaggatcacctgctctggagatgcattcgaccaaaagcaatacgcttatggtaccagcagaagccaggccacggcccctgtactagataataataacaaagagaatgagacggccctagacgggtactcccgtgacgcgtacttccgtccggactaacaagtcggaccgtaagggaaccaaacgtacgtaccgaccggtttacgaaccctagttacgacggttagggaccgttacccgaagggaccgtaaagggaacggtaacggtacggtctaacggtaaccttacgtaccgtaccgtacgacccctaacgtaccggaacggtacccgggtacccgtaccggtaacggggttgggttacggggttggggttacggttccggggacggggtaacggggtacccgtaaggttcccggacccggttaccgttacgggtaccgacggtacccccgtaaagggtcccgtacccggacccccgtaccggttaccgtcccgttacccg

SEQ ID NO: 162479 - DNA, 734 bp, Homo sapiens
  misc_feature: GYAE6OF01C8RJM.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttcctccccctcctcactctctgcacaggctctgcggcctcctacgagctgacacagcccaccggtcggtttctgtgtcacgtgggacaggacgccaggatcacctgctcgtgggagatgactattcgaccaaagcaagttacgtctttatcggtaaccagacaagaacgccaggccacggcccctgtactgataataataacaaagagaatagacggacggtccctagaacgggtactcccgtaggagccgtattccgtccggacctaacgaagtcgacgaacgggaacaacgacgtacgtacggttacgacctagtcgtagtggacgtaccgaaggacgaaggaacgacggaggtacgtagaaccttataccgtacgtacgaccgtacctacgacggtaccggaccgttaccggtaagggttacgggttacggggttacggggttacggggttaccggggacggggtaaccggggtaaccggttaacggttacccgggtaacccggttaccggttaacggtacccgtaaccgggaccccggtaacgggtcgtaccccccccccccccccggttcggttacccggtacccgttaacccggttcccgttcccgttaccccccg

SEQ ID NO: 162480 - DNA, 702 bp, Homo sapiens
  misc_feature: GYAE6OF01EAHJH.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgttcggtttctgtgtcactgggacagcggccaggactcacctgctctggagatgctattcgaccaaagcaagtcgtcttagttcggaaccagcaagaacgccgacggccacggtcccctagtacctgaattaaatactaacgaaagagaatggacggacggccctagaggactccgtagacgtcgtacttccgtccggctaacgacgtcgacgaacgggaacaacgtacgtaccgtacggttacgaaccgtatacgtaaggtcggacgtaccggaacgggacaaggaaaccggacggacggtacgtacgtaacttacgtaccgaccgtccgaccctacgtacgaccgggtacccgtaccgtacgtacgggttagggttaggggttcgggttacgggttacgggacgggtaacgggtacctaacgggttccggacccgttaccggtacggaccgtaaccggtcccggaacggtcccgtaccccggtccccgttacggtaccttaacccgttccgttccccgttaccccccg

SEQ ID NO: 162481 - DNA, 792 bp, Homo sapiens
  misc_feature: GYAE6OF01B7TZX.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacacgccaccggttcggtttctgtcgtcacgtgggacaggacggccaggatccactgctcgtaggatatgcattcgaccaaagacaatacgtactttagttcggtaaccagacgaagaaacgccgacggcccgtaaccggccccgtagtacgtagtaacttaagtaataaacgaaaagagaagtaggacgaccggcccgtacggaagggtacctacccggtagtacggaccgttacttacccggtaccggtactaaacgtaagtcggaaccggtaacgggaactaaacgtacggttaactaccggttaacaaccgtaacgtaccggtaaggtacggtaaccgtaccggaaggtaacgaaaggaaacgggacggtacgacgttaacggtaactaactacccgtacggtaccacttaccgtaacggaccggtaccggtaccgtacggtagggttacgggttacgggtcggggtttaccggtaccggggaacggggtaaccgggtaaccgttaaccgggttaccggtacccggtttaccgggaacgggttcccgtaaacgaccccgggtaaacgggtccccgttaccccggtaccccggttaccggtaacccgttacgtttccccccgg

SEQ ID NO: 162482 - DNA, 695 bp, Homo sapiens
  misc_feature: GYAE6OF01AWOV6.33.78.H01.1.454.CMB.1.raw
  modified_base (181)..(181): a, c, t, g, unknown or other
  misc_feature (181)..(181): n is a, c, g, or t
  modified_base (222)..(222): a, c, t, g, unknown or other
  misc_feature (222)..(222): n is a, c, g, or t
tcagtacacacactcacgaccggtgctcgatttagtgtgagtagtttgggtttgggggtgggtccaggaggcagaactctgggtgtctcaccatggcctggactccctctacttctcccctctcactctctgcacaggctctgcggcctcctacgagctgacacagccacgttcggtttcngtgtcacgtgggacagacgcaggactcacctgctcgtgganatgctattcgaccaaagctaatacgtattaagttcggtaccagtcaagaacgccgaggccacggtccctagtactgaactaatagtaacaaagagaatggaacgacggccctacgaacgggtcttaccgagacgtacgaccttcgaccggtactaacgaagttcgaaccgaacgggtacaaacgtacgtaccgttaacggttaccgaaccgtagttacggtacggtacggtaaccgtacccggaacggacggaaaaggtaaacggaaccgggtaacggtacgtaaccggtaaccgtacttaccgaaccgttacgacctacgtacgaccgggtacccggtactaggtacgggtgggttcgggtagggtttccgacggggtacgacgggtaacgtacgggtccgtaccgtacggtcgtacgacggtccgacggtcgttacccgcccgtaggtacctctccggttcccgtaccccg

SEQ ID NO: 162483 - DNA, 812 bp, Homo sapiens
  misc_feature: GYAE6OF01EEEXA.33.78.H01.1.454.CMB.1.raw
  modified_base (207)..(207): a, c, t, g, unknown or other
  misc_feature (207)..(207): n is a, c, g, or t
  modified_base (239)..(239): a, c, t, g, unknown or other
  misc_feature (239)..(239): n is a, c, g, or t
tcagtacacacactcacgaccggtgctcgatttagtgtgagtagtttgggtttgggggaaaacctcattcctcctctaaagaagcccctgggagcacagcgcatcaccatggactggacctggaggtttcctctttgtggtgcagcagctacgaggtgtccagtcccagttccaacgtggtaacaatcgtgggtctggaggtgaagnggccgtggtcctcggtgacgggtcctcctgcngtgtctcgtgggcgccgtccttcgacgctacctacgtcgaccgtactccaccggtgggtcgaccggaaccgaccggggtaccccccggaaggtaacgggtcgtttggagggttagggtaacgggggttacggggggttacttaccggtaccgtttcccgttccgtttcggttaccggacctaaaccaacgttaccgaccggttacccgaacccctaaagttaaacttacgaaacgaacgtacggtaacggtacgtaaccgtttacggttttacgaaaccggtaacggtaaactaacccgtaaacgaccctaacgaccgtaccagtacgtaggtacgttaggacggacgtaccgtacgactacgtacgtacgaacggtacccgaacggttacctaatttacgtaccgttagtacggacgtaagtagtaacttaacgttaaggtacgggaccggtacgtaaacggttaagggtttaccgggtttacgggtttaccgacccgggtttcgggacccggggttaccccgaaacgggttacccggtgtacccgtttacggtcccgttccgtaaccccgg

SEQ ID NO: 162484 - DNA, 799 bp, Homo sapiens
  misc_feature: GYAE6OF01B7037.33.78.H01.1.454.CMB.1.raw
  modified_base (572)..(572): a, c, t, g, unknown or other
  misc_feature (572)..(572): n is a, c, g, or t
  modified_base (757)..(757): a, c, t, g, unknown or other
  misc_feature (757)..(757): n is a, c, g, or t
tcagtacacacactcacgaccggtgctcgatttagtgtgagtagtttgggtttgggggggtccaggaggcagaactctgggtgtctccaccatggcctggactccctctacttcctccccctcctcactctctgcacaggctctgccggcctcctacgagctgacacagccaccgttcggtttctgtgtcactgggacaggacggccaggatccacctgctcgtggagatgtcagttcgaaccaaaagtctaattaccgtctttagttaccggaccagacaagaacgccgacggtacccgaccggtccctagtactaggtaacttaagtaactaaacgaaaggtaagtaacgtagaacggtaccggtaccctacgggaacgggtctttaccccggaaggtaccggtaccggtaaccttttacccggtacccggtaacttaaaccggaagttacgggaaccggtaaacgggaaacctaaaccgaacgttacccgacgttaccgaaactacgtaccgtagggtaacgccgtacgacggaacgaaggaacgtacggacgtcgtacgaaccgttanacgtaacgtcgtaacctacgtaaggaccggacccggtaccttaaggtcgggtttacggggtacgggtttagggtttacgggtcgggggaacgggttacggtaaaaccggttaggttcccgtaccggttacggtacgtccggtaacccggacgtaaccggtcccgttaaccccgcccccgggtttntaacccgtacccgtttcggtaccccgttcccccggtaccccg

SEQ ID NO: 162485 - DNA, 716 bp, Homo sapiens
  misc_feature: GYAE6OF01BW5XK.33.78.H01.1.454.CMB.1.raw
  modified_base (231)..(231): a, c, t, g, unknown or other
  misc_feature (231)..(231): n is a, c, g, or t
tcagtacacacactcacgaccggtgctcgatttagtgtgagtagtttgggtttgggggctgtgggtccaggaggcagaactctgggtgtctcaccatggcctggatccctctacttctcccccctcctcactctctgcacaggctctgcggcctcctacgagctgacacagcccaccgttcggtttctgtgtcacgtgggacagacggccaggactcactgctcgtggagntgctattcgaccaaagcaatacgtctttagttcggaccagacaagaacgccgaggccacggcccctgtactagaataatataacaaagagaatgagcgccctagaggtactcccgtagacgcgtacttccgtcgactaacgagtcgacgaacggacaaacgtcgtaccgtacgttacgaacctagtacgtagggttacgggaaccgtaccggaagggaacgaaaggaacggaccgggtaaaggcctaaggtaaccttacgtacccgaacgtcccgaaccctactacggaccggtacccggtacccgtggtaacgggttggggtttaacgggtggggtttaccgggtcgggaccggggtaacgggtaacccgttaagggttacccggtaacccggttccggtaaacgggtcccgaaacccgggtacccgaaccgggttccccggtaaccccggttcccccgtacgggttcccgtcccgtttcccgg

SEQ ID NO: 162486 - DNA, 967 bp, Homo sapiens
  misc_feature: GYAE6OF01EFDNC.33.78.H01.1.454.CMB.1.raw
tcagtacacacactcacgaccggtgctcgatttagtgtgagtagtttgggtttggggaaaacctcattcctcctactaaagaacgcccctgggagcacagcgcatcaccatggactggacctggaggttccttctttgtggtggcagcagctacgaggtcgtccacgtcccagttccaactggtaacaagtcgtgggtctggaggtagaaggacggtccgttcgggtccttcgggtggtacgggttcctccgtggctaggttcgtccgttcggtggggacgcccgttccttacgacgcctaaccgtgtaccgaccgtaagtccgtaaccggttcgggtacgacccggtaaccgacccggggaccccccggtaacggtaacggggttaccttaggggacggggttacggggtaacggggggtttacggggggtaaacctttcccggtaacccgtttccccggtttaccgtttcccgggtttaccggaacctaaaccgttaaaacctaccggtaaccgttaaccccgtaaccccgtaaaattaaaccggttaacaaaacgggtaccgaaacggttaacgtaccggttaaccgtttaaaccggtttacccggaaacggtaaaaccgttaccgtaaacccgaaaacccgtaccggtaaccgtaaccgtacctaacggttaggtacggggttaagttacgggaacggtccgtaagtaccgaacttaacggtcggaaacgacccggtaaccgtacgggttacctttaatacggttaccggtggaacggtaccgtaaggtaactaaacgttaagtacgggtaggtaccggtaaacgttaaacgggtttacggggttttagggtttaaccggtaccgtttaacccgggtcccggggttaccggggtaaccccggttaaccgggttacccgtttacggggtacccttaacggttccccggttcccgttaacccggg

SEQ ID NO: 162487 - DNA, 657 bp, Homo sapiens
  misc_feature: GYAE6OF01A800O.33.78.H01.1.454.CMB.1.raw
  modified_base (304)..(304): a, c, t, g, unknown or other
  misc_feature (304)..(304): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgttcggtttctgtgtcacgtgggacagacggccaggatcacctgctctggagatgcattgaccaaagcaatacgcttattggtaccagcagaacgccaggccacggccctgtactgaataatataacaaaaganaagtgagacggccctacgagggactcccgtgagacgtattccgtccggactaacaatggacgagggaccaacgagtacacgtacaccagtccaggtcggacgtccgaaggcgaaggaaacgacggacggtactacggaactactcaactcgacccactacgacggtccggtacctacgtacgggtgggttacggggttcggggttcggttacggggacgggtacgggaaccgtagggttccggtacccggttaccgtacgggtaccgaaccgggtaccccggaaggtccccgtcccggcccccccggttacgggttaccctacccgttcccgttcccgttcccccctaccccg

SEQ ID NO: 162488 - DNA, 932 bp, Homo sapiens
  misc_feature: GYAE6OF01E6HZQ.33.78.H01.1.454.CMB.1.raw
  modified_base (138)..(138): a, c, t, g, unknown or other
  misc_feature (138)..(138): n is a, c, g, or t
tcagtacacacactcacgaccggtgctcgatttagtgtgagtagtttgggtttgggggggtccaggaggcagaactctgggtgtctcaccatggccctggactccctctacttccctccccctctcactctctgcacnggctctgccgcctctacgagtctagacacacgccctacggttcggtttctggtcgtcacggtgggacaggaccggaccaggtacctccgaccgttgacctcggtaggaacgtacgttcggactaagttaccgaaccgtaaaagtccttaaagttaccgttacgtttaacgttaccggaacccaggaccgtaaacggaaccgcccggaacggtaccccgtaccggttacccgttaagttacggtaaacgtaaattaaaacttaacggaaaacggaaaaggttaacggaacggtacggaacccggtaccgggtacccgttacgggaaacggttcccctttacccgggaagtaacccggttccgtaaccgttaccccgggtacggaaacgttaacggacgtacgggaaccggtaacggaactaaccggttacgtaccgtaacgtacgactaaggtacggtacgggttacggacgtaaccgaaggaacgaaggaaccggtacgtaacggttctaacggtaacctacgtaccgacgttacccgaccgtaccggtaaccggaccggttaccggtaacggttacggggtaggggttacccggggtttggggtacccggggtttaccgggtaccggggtaaccgggttaaccggaccgtttaacggggtaccccgtaccgggtaaccgttacccggggtccgtaaccccggaaaccgggttccccgtcccggtaccccccggttacccgtaccgtttacccccggtttacccgtccccgttttacccccggcccctttacgg

SEQ ID NO: 162489 - DNA, 758 bp, Homo sapiens
  misc_feature: GYAE6OF01CN79W.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgccggcctacctacgagctgacacagcccaccgttcggtttctgtgtcacgtgggacaggaccggccgaggctcacctgctctggagatgctattgaccaaagactaatacgtcttagttcggtaaccagacaaggaacgccgacggaccgaccgtccctgtactagataatataacgaaagagaatggaggaccgtccgtacggacgggtacctacccgtggacgacgtacgttccggtacccgtacgttaaccaacgtcgaccggtaacgggaacctaaacggtacgttaaccgtaaccggtttaccgaaaccgtacgtacggtaacgggttacgggtaaccgttaccggaacggtacggaaacggtaaacgggaacgaacgggtacgtaacgtaaccttaggtaccctaacgtccgaccctaacgtaccgtacggtaccggaccgttacgtaacggggttgggggttacggggttccgggggttcgggtacgggaccggggaccggggtaacttacgggtccggttaacccggtcgtaacgggtaccgaccggtaccggacgtcccgtcccgtccccgtccggttacaccgttcccgttccggtcccctcccg

SEQ ID NO: 162490 - DNA, 852 bp, Homo sapiens
  misc_feature: GYAE6OF01AHYR3.33.78.H01.1.454.CMB.1.raw
  modified_base (117)..(117): a, c, t, g, unknown or other
  misc_feature (117)..(117): n is a, c, g, or t
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
tcagtacacacactcacgaccggtgctcgatttagtgtgagtagtttgggttgggggtcgttgggtggtccaggaggcagaactctgggtgtctcaccactggcctggactcccgtntacttctccccctctcactcctctgacacgaggctacgtggccggcctcctacgagcctacgactaccagccctccgtccggtttcncgttcgtcncgtgggacagggccggccaaggtctcctaccgtgtcctacgtagggactactcgactagttcggacctaaaagtcctaaagttaaccgtcgttaacgtacgtaccgtacgtaccgaacgaccgaccggacggacccgaccggaccccgttaacgtaaccgtaagttaactttaaacgtaacgtaaacgaaagtacgtaacgtacggtaccggtaccggtacccgtacggtacgggtaccgttaccgtaggtaccgttaccggttacgttacccggaccggtaactaaaccgtacggtaccgtaacggtaaccgtaaccgtaccgtaccggttacgtacggtaccgaccggttacgtacggtacggtacggaccggtacgtacggtaacgtaacggaacgtaacggtacgtacgtacgaaccgtctacgtacctactacgtaccgtaccggaccgtaccggtacgttacgggtacgggttacggggttacgggttaccgggtacgggtaccgggtaccgggtaccggtaccggtaccgggtacccggtacccggtaccggtccggtacccgggtcccggtacccggtacggttccccgtacccccgttaccgttccccgttaccccgtcccgttaccccg

SEQ ID NO: 162491 - DNA, 813 bp, Homo sapiens
  misc_feature: GYAE6OF01DZC9Y.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgccggcctcctacgagctgacacacgccctaccggttcggtttctgttgtccacgtggggaccaggaccggccgaaggtactccaccgtgcctcgtaggagagtgactagttcgaccaaagcaaactcgttactttagtcggaccagcaagaacgccgacggccgacggccctagtacgagtaataatactaacgaaagaagaagtgaggaccgcccgtacgaacggtctccgtaggacgtacgttcttccgaccgtactaaccgtagtacgaccggaacggaacctaaacgtacggtaccgtaaaccggttacgaaccgtaacgttacggtaaggttacggggtaacctaccggaacgggtaaccgaagggtaaacgggacgtaacgggtccttaacgtaacccgtacgtacctaccggtaccgtaccctaacgtaccgacccggtacccggtaccgttacggtacggggtttacgggttagggggttcgggttaccggggttaccgggggacccggtaaacggggttacccgtaaagggtttcccggggtacccggttaaccggtaagggtaccccgtaaccggaccccggtaacgttccccgttaccccccggtcccggtcccggttaaccttcccgtttcccgttcccccgttcccccgttaccccg

SEQ ID NO: 162492 - DNA, 742 bp, Homo sapiens
  misc_feature: GYAE6OF01C5203.33.78.H01.1.454.CMB.1.raw
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (336)..(336): a, c, t, g, unknown or other
  misc_feature (336)..(336): n is a, c, g, or t
tcagtacacacactcacgaccggtgctcgatttagtgtgagtagtttgggtttgggggggtccaggaggcagaactctgggtgtctcaccagtggcctggatccctctacttcctcccctcctcactctctgcacaggctctgcggcctcctacgagctgacacacgcccaccgtcggtttctgtgtcacgtgggacaggacggccaggatcacctgctcgngganatgcattgaccaaagcaaatcgcttagttggaccagcagaagccaggccaggccctgtactgataatataacgaaagagaatggagacggtccctagagggacttaccgnggacgcgtacttacgtccggacttaacaagttcggaccgaagggtaacaaacgtacgtaccgacgtttacggaccctagtacgtaaggtcggacgttaccgaaggaccgaaaggaaacggttaccggaacgggaccttaacgggaaaccctaactttccgggaaaccgtttccgaacccctaacgttaacccggaacggggaaccccggtaccttaaccggggtaacgttaggggggttaaccggggttgggggtaaccggttcgggggttacccgggaagggggttaacccctacgggggttttaccgaaaccccggttgtaaacccgggttcgaaacccggtacccgtaaacgggtccgtcccgtaccccgtggtacctcgtcccgtaccgtcccctaaccccg

SEQ ID NO: 162493 - DNA, 794 bp, Homo sapiens
  misc_feature: GYAE6OF01EP4UT.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttcctccccctcctcactctctgcacaggctctgccggcctcctacgagctgacacagccaccgtcggttttctgtgtcactgggacagacggccaggatcacctgctctggagatgctatgaccaaagcaaatacgacttagttggtaccagcaagaagccaggccacggccctgtactgaataaatataacaaaagagaatggacgacggccctacgagggactcccgtagagacgacttccgtaccggactaacaatagcgaaagggaaccaaacgtacgttaccgtaaccggtttcgaaaccgtactaccgtaagggtacgggtaccggtaccgtaacgggacgaaagggaaaacggaaccggaagggtaccgttaacggtaacttaacctacctaaccgtaccggaccctaaccgttaacccgacgggtacccgggtaaccctaccggaaggggtttacgggggttaaggggttcgggggtttacggggttcccgggggaacgggggtaaaccggggtaaacccggttaaaacggggtttcccgggtaaacccggtttaaccccggttaacgggttacccgaaacccggtaccccgggtaaaccgggtcccgtaccccggtccccccggttaccgggttacccttaacccgtttccccggttaacgtttccccccccg

SEQ ID NO: 162494 - DNA, 553 bp, Homo sapiens
  misc_feature: GYAE6OF01BGXDI.33.78.H01.1.454.CMB.1.raw
  modified_base (536)..(536): a, c, t, g, unknown or other
  misc_feature (536)..(536): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggttttctgtgtcactgggacagacggccaggatcacctgctctggagatgcattgaccaaagcaatacgcttattggtaccagcagaagccaggccaggcccctgtactgataatatacaaagagaatgaagaggccctcgagggatccctgagcgattctccggctacaatgcagggacaacgagtcacgttgaaccatacagtaggagtccaggcaagaaaggacgaggctagactataccactgaccactcacgcgacctacgaggtggtagggtgggtcgttcgggcggagggactaaggttcgaccggttccgtaggtcacggcccgaaaggtcctccggtcccccttcggtccnccttcgtccgttccccc

SEQ ID NO: 162495 - DNA, 749 bp, Homo sapiens
  misc_feature: GYAE6OF01CRWQ1.33.78.H01.1.454.CMB.1.raw
  modified_base (230)..(230): a, c, t, g, unknown or other
  misc_feature (230)..(230): n is a, c, g, or t
tcagtacacacactcacgaccggtgctcgatttagtgtgagtagtttgggtttgggggctgtgggtccaggaggcagaactctgggtgtctcaccatggcctggatccctctacttctcccccctcctcactctctgcacaggctctgccggcctcctacgagctgacacagccaccgtcgtttctgtgtcacgtgggacagacggccaggactccacctgctcgtgganatgctattcgaccaaagcaataccgtctttagttcggtaaccagacaaggaacgccgacggccaccggccccttaggtaactagtaattaaataactaacgaaaagtagaagtaggacgacggtcccctaggacggtactccccgtaggacgtaccgttacgttcccggtacccggtactaacgtaacgtcgaccggaacggaaacctaaacgtacgtacgtaccgttacgaacctagtcgtaggtacgggacgtaccgagggtaacaacggtaaacggacggaggtacctaacggtaacctatcccgtaacgtcccgacccctagtaccgaaccggtccgtaacccgtaggtagggttcgggttaggggttcggggttaggtaccgggggcgggtaacgggtaacccgttaagggttaccggtacccggtttaccgggtaaaggtccccggaaccggtaccccggtaaaggtccccggtaccccgacccccgggttcgtccctaacccggttcccccg

SEQ ID NO: 162496 - DNA, 633 bp, Homo sapiens
  misc_feature: GYAE6OF01BAYXD.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggactcacctgctcgtggagatgctattcgaccaaagcaatacgtcttattggtaccagcagaagccaggccacggcccctgtactgaataatataacaaaagagaatgagacggccctagagggactcccgtggacgcgtacttccgtaccggactaacgaagtcgacgaagggaacaaacgacgtacgtacgttcgaacctatacgtaggtacggacgtaccgaggacaaggaacgacggaggctagactagtaccacgtcgcccaacgtcgacggtccgacctcggtaaggtcgggttagggtacggggttcgtacggggacgggtacgggtaccgtaacgggttacggacccggttcggtacgggtcccgacggtaccccgaacggtcctcccggtacccccgttcggtcctaccgttcccg

SEQ ID NO: 162497 - DNA, 701 bp, Homo sapiens
  misc_feature: GYAE6OF01CB0G9.33.78.H01.1.454.CMB.1.raw
  modified_base (187)..(187): a, c, t, g, unknown or other
  misc_feature (187)..(187): n is a, c, g, or t
  modified_base (212)..(212): a, c, t, g, unknown or other
  misc_feature (212)..(212): n is a, c, g, or t
  modified_base (228)..(228): a, c, t, g, unknown or other
  misc_feature (228)..(228): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgccggcctcctacgagctgacacagccaccgttcggtttcngtgtcacgtgggacagacggcaggntcacctgctcgtggantgctattcgaccaaagccaataccgtctttagttcggtaccagcgaaggaacgccgaggcccgacggcccctagtactcgaataactaataacaaagagaatggagacggccctagagggtactcccgtagacgtcgtacttccgtaccggtactaacgaagtcgaccgaagggtaaccaacgtagtaccgtacgttacgaacctagtccgtaggtcggtacgtaccgagggacaaggaacggacggacggtcgtacgtaactacgtacgactccgacctaccgtacgacggtacccggtaaccgtcggtagggttcgggttacggggttcgggttaccgggttcggggacgggtacggggtaaacccgttaaggttcccggtaacccgttccggttaaggtccggaacccgtacccggtaacgggtccctaccccgggtacccccgttcggtacccgttccgttacccccgg

SEQ ID NO: 162498 - DNA, 647 bp, Homo sapiens
  misc_feature: GYAE6OF01AVOO2.33.78.H01.1.454.CMB.1.raw
  modified_base (185)..(185): a, c, t, g, unknown or other
  misc_feature (185)..(185): n is a, c, g, or t
  modified_base (288)..(288): a, c, t, g, unknown or other
  misc_feature (288)..(288): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttcngtgtcactgggacagacggccaggactcacctgcctctggagatgcattgaccaaagcaatacgcttatggtaccagcagaagccagccacggcccctgtacngataatatacaaagagaatggagacggccctgacggactcccgtagacgcgtacttctccgggactacgaagtgacgaagggacaacgtagtacgtacgttacgaccatacgaggtacggacgttaccgaagggtcaaggtaaacgacggtaggactgaacttactaccgtacgtacgcctaaccgtcgacgaccggacccgtacgtacggtacggggttaggtcggggtcggttccggggacgggtacgggaacccgtaagggttccgtaacccggttccgtaacgggtcccgacggtaacccccgtaggggacccgttccccggacccccgttccggtaccgttaccccgttcccgg

SEQ ID NO: 162499 - DNA, 775 bp, Homo sapiens
  misc_feature: GYAE6OF01DV92N.33.78.H01.1.454.CMB.1.raw
  modified_base (108)..(108): a, c, t, g, unknown or other
  misc_feature (108)..(108): n is a, c, g, or t
  modified_base (181)..(181): a, c, t, g, unknown or other
  misc_feature (181)..(181): n is a, c, g, or t
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
tcagtacacacactcacgaccggtgctcgatttagtgtgagtagtttgggtttgggggtgggtccaggaggcagaactctgggtgtctcaccatggcctggatccctntacttctccccctcctcactctctgcacaggctctggcgcctcctagagctgacacagcctaccgtggtttcngtgtcacgtgggacagacgccaggntcacctgctgtgganatgctagtgaccaaagctaatcgtcttagtggtacagacagaagccgaggcacggtccctgtactagattaaatactaaacgaaaaggtaggtaaataggaaggaccggtacccgttacggaacgggggtaaccttccccggttaggaacggtcggttaaccttccgtacccgggtacttaaaccgtaaagtaccggaccggtaaacggggaaaacctaaaccgtaacggttaccgtaaccgggtttacgaaaccctaggttaaccgtaggggttacgggaacgtcccgaaagggtaccgaaggaaacggtacggaaggtacgtacgtaacgtacttaccgacgtcgaccctacgtaccggaccggtaccggaccttacggtagggttacgggttggggttacggggttacggttaccggggacgggttaaacgggaacctttacggggtaccgttaaccccggtacggtaaccggttaaccggacggaaccccgaacggtcccgtaccggtccccccttcgggttaccacccgttcttccccggttacccccg

SEQ ID NO: 162500 - DNA, 748 bp, Homo sapiens
  misc_feature: GYAE6OF01C0ZLC.33.78.H01.1.454.CMB.1.raw
  modified_base (183)..(183): a, c, t, g, unknown or other
  misc_feature (183)..(183): n is a, c, g, or t
tcagtacacacactcacgaccggtgctcgatttagtgtgagtagtttgggtttgggggtgggtccaggaggcagaactctgggtgtctcaccatggcctggatccctctacttcctccccctctcactctctgcacaggctctgcgcctcctacgagctgacacagccaccggttcggtttcngtgtcacgtgggacaggacggccaggatcacctgctcgtggagatgactaattcgaccaaaagcaaagtacgtctttagtcggtaccagacaagaacgccaggccacggcccctagtacctgaattaaataataacaaaagagaatgagacggcctagagggactccctggacgcgtattccgccggactaacaagtgacgagggaaccaacgtagtacgtaacggttacaacccgtaagtacgaaggttcggaacgtacccgaagggaccgaaagggaaacggaacggaacgggtaccttaacggaacttaacgtaccgtacgtacgtacccaacgttaccgaaccgggtacccgggtaaccctaggtaacgggtttacggggttaacggggtacggggtttcgggttaccggggacggggaacggtaaacccgttaacgggttccggtaacccggttaccggtaacgggtccgtaaccggaccccggtaacgggtccccgttccccgggtaccccccggttggtaacccgttacccgttcccgtttacccggttacccccccg

SEQ ID NO: 162501 - DNA, 625 bp, Homo sapiens
  misc_feature: GYAE6OF01EXB9C.33.78.H01.1.454.CMB.1.raw
  modified_base (185)..(185): a, c, t, g, unknown or other
  misc_feature (185)..(185): n is a, c, g, or t
tcagtacacacactcacgaccggtgctcgatttagtgtgagtagtttgggtttgggggctgtgggtccaggaggcagaactctgggtgtctcaccatggcctggatccctctacttctcccccctcctcactctctgcacaggctctgcggcctcctacgagctgacacagccaccgtggtttcngtgtcacgtgggacagacggccaggatcacctgctcgtggagatgctattcgaccaaagcaatacgcttattggtacagcagaagccgaggccacggcccctagtactgaataatataacaaagagaagtaggaggacggcctacggagggtactcccgtaggacgcgtacttcgtccggactaacgatgacgacgggaacaaacacgtacgacgttcgaacatacgaggtacgacgtaccgaggacaaaggaacgacgacggactacgtaactacgtctacgtacgacccactacgacgaccgtacccgtacgtagggtaggtaggggtcgggttggtacgggacgggaacgggtaccgaaaggttccggtaccgttacgggacggtcgaccggaaccgacggtccgcccggtacccccgttcgggccctacgttcccg

SEQ ID NO: 162502 - DNA, 736 bp, Homo sapiens
  misc_feature: GYAE6OF01AQ399.33.78.H01.1.454.CMB.1.raw
  modified_base (106)..(106): a, c, t, g, unknown or other
  misc_feature (106)..(106): n is a, c, g, or t
  modified_base (222)..(222): a, c, t, g, unknown or other
  misc_feature (222)..(222): n is a, c, g, or t
tcagtacacacactcacgaccggtgctcgatttagtgtgagtagtttgggtttgggggggtccaggaggcagaactctgggtgtctcaccatggcctggatccctntacttctcccctctcactctctgcacaggctctgcggcctcctacgagctgacacagccaccgtcggtttctgtgtcacgtgggacagacggccaggatcgacctgcttcgtggangtgctagttcgacaagccaaattcgcttagttggaccagcagaacgccaggtccacggtcccctgtaactgaactaatataactaaagagaatgacgaggtccctacgaacgggacttcccgtaggacgacgtacttcccgtccggtactaccgtaaagtcggaccgaacgggaaacctaacgtacgtaccgtacgtttacgaaccgtacttaccgtaaggttacggaccggtacccgaggaacgaacggtaaacggacgtaagggtactacggtaactacgtaccaaccgtccgtacccacgtaccgacgtaacccgtacctacggtaggttacgggttacgggttaacgggttcggttaccgggaccggggtaacggtacccgttaaagggttaccggaacccggttacggttaaccgggtaccgtacgggaaccccgtaaacgggcccgttacccggtaccccccgttacgggttcccaaccgttcccgtttacccggtccccgttccccg

SEQ ID NO: 162503 - DNA, 714 bp, Homo sapiens
  misc_feature: GYAE6OF01DH5CL.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgttcggtttctgtgtcacgtgggacaggacgccaggatcacctgctcgtggagactgctattcggaacctaaaagcaaagttacgtactttagttcggtaaccagcgaagaacgaccgacggccgacggccctagtactagaataatataacgaaagagaatgagacgcctagaggtactccgtagcgcgtacttccgccgtactaacgaagtacgacgtacggaacaacgagtacgtacgttacgaacctagtacgacggttaggacgtaccgaggaacgaacggaacggacgtacggactaacgtacctactacacgtacgaccacgtacgaccggtccgtacgtagacggggttacgggtaggggttcgggttacgggtccggggtaaccggggtacgggtaaccgttaacgggttacccggtaccccggttacgtaaccgggtaccaccgggtacccggtaacgggtccccttccccggtaccccccggttacgttaccccttaccggttttcccgttccccgtttcccccgtaaccccg

SEQ ID NO: 162504 - DNA, 810 bp, Homo sapiens
  misc_feature: GYAE6OF01BQPKE.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctctcactctctgcacaggctctgccggtcctcctacgagctgacacacgccctaccggttcggttttctggtcgtcacgtgggacaggaccggcaggactccacctgctcgtggagtatcgactattcgaaccaaagactaagtacgtctttagtcggtaaccagacaaggaacgccggaacgcccgaccggtcccctagtacgtagtaactaaataactaaacgaaagtaacgaagtaggaacggaccggtaccctaggaacgggtaccttaccgtaggacgtaccgtacgtttccgtaccggtactaaacgtacggtacggaaccggaaggaaccgtaacgtacggttaccgtaacgtacgtaaccgacgtacggtacgggtcggtaaccgaccggaaggaacggtaacggaacggacgggtacgtaccgtaacgtaaccttacgtaccgaccgtacgaacccgtaccgaccggtaaccggacccgtacgtaccgggtagggttacgggggtttagggttagggggttaccggttaccgggggaacgggttaaccggtaccgggttaaaccggggtttccggtacccgggtttacggtaccgggaccgtaccccgggaaccggttacccggtccccgttacccgggtaaccccccgttgggttaccccttcccgtttacccccgg

SEQ ID NO: 162505 - DNA, 765 bp, Homo sapiens
  misc_feature: GYAE6OF01DEAMR.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgcggcctcctacgagctgacacagcccaccgtcggtttctgtgtcactggacagacggccaggatcacctgctcgtggagactgactattcgaaccaaaagcctaaattacgtactttagttcggtaaccgaagacaaggaacgcccgaacgggacccgaacgggcccctaggttaacctaggtaaacttaaactaacgtaaacgaaaaggaaagaacgtaggaaggaaccggtcccgttacgacgggtaacctcccgtaggacgtcgtacgtttaccgtaccggtactaaccaagttcggacgtaacggaaccaaacgtacgtacctaacgtttacgaaccgtacgtacgtacggtacgggtaacggtacccgagggtaaccgaaaggtaaacgggaaccgggtacggtacgtacggtaaccttaacgtaccgtaacttccgacctaccgtacgaccggaccggtacctacggtagggttacgggtacggggttgggtacggttacgggacgggtacgggaaccgttaacgggtacggtacccgtccgtacggtaccgacggacccgacggccgtacccgtccccgtccggtacctccgttccgtcccgttccccgtccccg

SEQ ID NO: 162506 - DNA, 741 bp, Homo sapiens
  misc_feature: GYAE6OF01DRSYW.33.78.H01.1.454.CMB.1.raw
  modified_base (106)..(106): a, c, t, g, unknown or other
  misc_feature (106)..(106): n is a, c, g, or t
  modified_base (135)..(135): a, c, t, g, unknown or other
  misc_feature (135)..(135): n is a, c, g, or t
  modified_base (186)..(186): a, c, t, g, unknown or other
  misc_feature (186)..(186): n is a, c, g, or t
  modified_base (218)..(218): a, c, t, g, unknown or other
  misc_feature (218)..(218): n is a, c, g, or t
  modified_base (554)..(554): a, c, t, g, unknown or other
  misc_feature (554)..(554): n is a, c, g, or t
tcagtacacacactcacgaccggtgctcgatttagtgtgagtagtttgggtttgggggggtccaggaggcagaactctgggtgtctcaccatggcctggatccctntacttcctccccctctcactctctgcacnggctctgccgcctcctacgagctgaccacacgcccaccggtttcggtttcnggtcgtccagtgggacagacgggccaggtacnccacctgccgtcgtaggagactgcctagttacgaaccgaaacgcctaaattaaccggtccttttaagttcggaaaccgaacgacgaacggaaacgcccgacggacccggaccggtcccgtacgtaactaggaaacttaacttaacaaacgaaagaaagtagtaggacggacggccctaggacgggtactccgtaggacgaccgtacgttccaccggactactaacgtcggacgaaggaacctaacgtacgtaccgacgttaccgaactacgtggtaacggtaccggaggtacccagggaacgagaaacggaggcgacgtacgtctaacgcgtaccncgaccacgtacggacgtacccgacgtacggtcgggttaaggtcgggggttaggttacggtcgggaccgggtacggtacggttaaccggtccggtaccgtaccggtaccggtaccgaccggacccggtccggacccgtccccgtaccccggcgttaccctccgtacccgtccccgttccccgtacccg

SEQ ID NO: 162507 - DNA, 755 bp, Homo sapiens
  misc_feature: GYAE6OF01AKYX5.33.78.H01.1.454.CMB.1.raw
  modified_base (111)..(111): a, c, t, g, unknown or other
  misc_feature (111)..(111): n is a, c, g, or t
tcagtacacacactcacgaccggtgctcgatttagtgtgagtagtttgggtttgggggctgtgggtccaggaggcagaactctgggtgtctcaccatggcctggatccctntacttctcccctctcactctctgcacaggctctgcggcctcgtacgagcctgacacagccaccgtcggtttcgtgtcatgggacagaccggtcaggatcacctgctctgggacatgcattcggaccaaaggcaaagtacgctttagtcggtaaccaggtccaaggaacgtccaacgggcccaacgggtccccctagtacctagaacttaactaactaacgaaaacgagaactacgggtaacggtacggtaccccgtaggtacggggtaacttccccgtagtaacggccgttaacgtttcccggtaccgggtacctaaacctaaacgtccggtaaccgaaggggaaccctaaaccgttacggtacccgtaccggtttaacgaaccctagttacgtacgggtcggtaacgtaccgacggtacgaacggtaacggaacgtacggtccgtagtacctactacgtaccgtcggtacccaacgtccgtaacggccgtaccgtcgttacgggtgttacgggtcggttacggtcgggaaggtacggtaccgtaggttaccgggtaccgttaccggtaacgggtcccaccgggtaccgtaacccgggtccgttaaccccgggcccccgttacggtcccgtaacgtttccccgg

SEQ ID NO: 162508 - DNA, 769 bp, Homo sapiens
  misc_feature: GYAE6OF01CB5RC.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgttcggtttctgtgtcacgtgggacaggacggccaggactccacctgctcgtggagatgactagttcgaaccaaagctaaacgtacgtctttagttcggtaccagacaaggaacgccgaacggccacggcccctagtactagaataataataacaaagagaagtaggaacgacggccctacggaacgggtacctcccgtaggacgtaccgtacttccgtaccggactaacaagtcgacgaacgggaaacaacgtacgtacctaacggttacgaacctagtacgtacgggtacggtacgtaccggaaggaacgaaagggaaacgacgggacgtaccgtaggtaacttactactacgtccgaccctacgtaccggaacggcccggtaaccgttacggttacgggttaggggttacggggttcggggtttacggtccgggggacgggtaacgggtaacccgttaagggtttcccggtaacccgggttaccggttacgggtacccgaacgggtacccccggaagggttcccccgtccccgggttaccccccggttacgggtaaccctttccccggttcccgtcccccggtttaaccccccg

SEQ ID NO: 162509 - DNA, 747 bp, Homo sapiens
  misc_feature: GYAE6OF01E4Z7S.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcgcctcctagagctgacacagccaccgttcggtttctgtgcacgtgggacagaccggccaggatccacctgctcgtaggatatgctagttcgaccaaagcaaagtcgtattatggtaccagacagaacgccgacggccacggcccctaggtactacgaattaataactaacaaaaggagtaagtaggaacggaccgtcccacggaacggggtacctcccggtaggaagtccgttaacgttcccgtaccggtaactaacgtaagtcggaccggaaacgggaaccaaaccgtacgttaccggtaaccgttacgaacccgtacgtacgtaacgggtcggaacggttaccggaagggtaccggaaaagggaaccggcggtaaacgggtcctaacgggttaacctaaccgtcgaaccgttacccgaaccgtacctacggacggtaacccggtacccttaggggtaggttacggggttaggggtcgggttaccgggttacgggacgggtaaccgggtaacgtacggtccgggtaccttacggtaacgggtccaaccggccggtaactccggttccccggaccttcgggtacctccggtttaccccg

SEQ ID NO: 162510 - DNA, 614 bp, Homo sapiens
  misc_feature: GYAE6OF01DUR4J.33.78.H01.1.454.CMB.1.raw
  modified_base (298)..(298): a, c, t, g, unknown or other
  misc_feature (298)..(298): n is a, c, g, or t
tcagtacacacactcacgaccggtgctcgatttagtgtgagtagtttgggtttgggggaaaacctcattcctcctctaaagaagcccatgggagcacagcgcatcaccatggactggacctggaggttcctctttgtggtggcagcagctacaggtgtccagtcccagttccaactggtacaatctgggtctgaggtgaagaggcctgggtcctcggtgagggtcctcctgcagtgtctcgtgggagccgtccttcagcacctatcgccatcacctgggtgcgacacggcccccgganaacgggcttgaggtggagtggggggtatcatccctctcttcggcacaatacagtaccgccaactaaatttcaaagacagagtgactaagtttcgacgaacgaatacaacgaccacacgtaccaacagtagggtagttaggaaggtacgccgtagactatccgtaggaacgacgaccggtccgttaattactttacgtacgtggacgagagactacaaaattggtaggacgacgtaaaggttcgggtttacgggtttggtaccgttccggtaggggacccgtacggggaacccgttgggtacctacgtccgttaccc

SEQ ID NO: 162511 - DNA, 861 bp, Homo sapiens
  misc_feature: GYAE6OF01EW2UU.33.78.H01.1.454.CMB.1.raw
  modified_base (256)..(256): a, c, t, g, unknown or other
  misc_feature (256)..(256): n is a, c, g, or t
  modified_base (280)..(280): a, c, t, g, unknown or other
  misc_feature (280)..(280): n is a, c, g, or t
  modified_base (336)..(336): a, c, t, g, unknown or other
  misc_feature (336)..(336): n is a, c, g, or t
  modified_base (778)..(778): a, c, t, g, unknown or other
  misc_feature (778)..(778): n is a, c, g, or t
tcagtacacacactcacgaccggtgctcgatttagtgtgagtagtttgggtttgggggaaaacctcattcctcctctaaagaagcccatgggagcacagcgcatcaccatggactggacctggaggttcctctttgtggtggcagcagctacaggtgtccagtcccagttccaactggtacaatctggtctgaggtgaagaggcctgggtcctcggtgagggtctcctgcagtgtctctggggacgcgccttacgngccaaccttagtcgaccctatccncccggttagggtcgccggaccaccgggaccccccggtaacgaacggggttccgttnaggtacgggtacgggtacggggttacgggggttaccgtaccgtacccgtttccccttaccgtttacccggttacccggtaccgtaacccgttaaaccgttaacccgttaaacccggttaaacccccggttaaaccccgtaaaacccgtttaaaaccgtttaaaccgaaaacggtaaaccggtaacggtaacggttaaccgttaaaccggttttaaacgggttttacccggtaaaccggtaaaccggtaaccgtaaacccgaaacccggtaaccctaaccgtaacccgttaacccgtaacgtaacggttacggtaggaagtttacggaccggtacgtaaccgtacggtacgtacgtaacgtaccggtaacggtaccgtaacggtaccgttaacgttaacgttacggtacgtacgtacgtaagtaacgtaaagtacgtaaacgntacggtaaggtaacggttcgggttaacgggttacggttaacggttacggtacgggtacccggtacgggtaccgtacggtaccg

SEQ ID NO: 162512 - DNA, 696 bp, Homo sapiens
  misc_feature: GYAE6OF01DESZP.33.78.H01.1.454.CMB.1.raw
  modified_base (226)..(226): a, c, t, g, unknown or other
  misc_feature (226)..(226): n is a, c, g, or t
  modified_base (497)..(497): a, c, t, g, unknown or other
  misc_feature (497)..(497): n is a, c, g, or t
tcagtacacacactcacgaccggtgctcgatttagtgtgagtagtttgggtttggggggtccaggaggcagaactctgggtgtctcaccatggcctggatccctctacttcctccccctcctcactctctgcacaggctctgccggcctcctacgagctgacacagccaccgttcggtttctgtgtcacgtgggacaggacggccaggatcacctgcttcgtgganattgctaagttcgaccaaaagccaaatacgtctttagttcggtaaccagcaagaacgccgaggcccacggcccttgtacctgaataatataacgaaaagagaatgaggacgccctgagggactcccgtaggacgacgtacttcgtaccggctaaccgaagtcggaccgagggaaacaaaccgtacgttaccgacgtttacgaaccctagtaccaagggttcggacgtaccgacgggagaacggaaacggacgacggtactaggaaccttancctaacctcgaccctactcgaccgaccggtacctcgtaagggttagggttacgggttggggttcggttcggggacgggtacggaccgttaaaggttaccggacccggttaccgtacggtaccgaccggtacccggaaccggtcccgtacccgacccccggttcggtacctaccgtttccctacccgttcccctaccccg

SEQ ID NO: 162513 - DNA, 620 bp, Homo sapiens
  misc_feature: GYAE6OF01DEGND.33.78.H01.1.454.CMB.1.raw
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (325)..(325): a, c, t, g, unknown or other
  misc_feature (325)..(325): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
  modified_base (596)..(596): a, c, t, g, unknown or other
  misc_feature (596)..(596): n is a, c, g, or t
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgccggcctcctacgagctgacacagcccaccgttcggtttctgtagtcacgtgggacaggaccggccaggatccacctgctgngganatgctatcgaccaaagctaagtcgtactttagttcggaacagcaaggacgcgacgccgcggtccctagtactacgaattaataactaacgaaaganaagtgacgaccggtcctaggacggtactccgagcgacgtacttccgtccgataaccagtcggacgtaggaacaacgtgtactacgtagactatgaggtcggactccggagacgaagacgacgagactanactnacctacgccacacgtcgacggccgtaccgtagtaggggttgtaggggttcgggtcgtacgggaccgggtaggtaaccgtgttaccgggaccttaggtccgacgaccggacggtccgtccggtccctccggtcgtaccngtttccctcccggttccctacccg

SEQ ID NO: 162514 - DNA, 811 bp, Homo sapiens
  misc_feature: GYAE6OF01C0ACC.33.78.H01.1.454.CMB.1.raw
  modified_base (212)..(212): a, c, t, g, unknown or other
  misc_feature (212)..(212): n is a, c, g, or t
  modified_base (236)..(236): a, c, t, g, unknown or other
  misc_feature (236)..(236): n is a, c, g, or t
tcagtacacacactcacgaccggtgctcgatttagtgtgagtagtttgggtttgggggggtcaggaggcagaactctgggtgtctcaccatggcctggactccctcttacttcctccccctcctcacttctctgcacgaggtctctcggccggtcctacctacgagctagacaccgacgccgtaccgttcgtttgtgtcgtcacgtggaacnggacgtcagcacacctgctgaganacgtgctaatcgaaaccaaagtactaacttaccgttattacggttacgaaccagacgaacgaaggccgaacgacccgtaccggtcccttagtaacgtaataacttaagaactaaaacgaaagaagtaacgaagaccggacccgtaccgtaggaacggtccttaccgacggagtaccgttccgttacgacctagtaacgagtcggaacgaacgtaacgacgtacgtactaacgttacaacgtacggtacaagggtccggtaacggtacgaaacggtaacggaacggaaaggttaacgaacggtacgtaacgtaacgttacgacccgtacgtaaccgacctaaccggtccggacggtacccttacggtaaccggtagggtttacggggtcgggttagggggttaccggtaaccgggggtaacgggtaaccgggtaaccggttaacgggtttaacccgacccgggttaaccaacggggtaactaccccggaccggttaaacccggcccggtttaccccgtaacccggttcccgttaacctaccgtttacccccgttacccgttaccccggttaacccc

SEQ ID NO: 162515 - DNA, 974 bp, Homo sapiens
  misc_feature: GYAE6OF01B3AM5.33.78.H01.1.454.CMB.1.raw
  modified_base (221)..(221): a, c, t, g, unknown or other
  misc_feature (221)..(221): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctcgtgganatgctattcgaccaaaagcaatacgactttagttcggtaccagcgaagaacgccgaacggcccgaaccggtccccgttagttaaccgtggtaaattaaactaaactaaacgaaaaagtaaggtaaacgtggaacggtaccgggtcccctacggaacgggtaccgttccccgtagggaacgtccgtactttcccggtacccgggtactaaccgtaagtcgacggaacggggaaccctaaacgtaccggttacctaccggtttacgaaccgtaacgtaccgtaagggttacgggaaccggttacccggaaagggtaccgaaagggaaaaccgggtaacgggaacgggtaccgtaacggtaaccttaacgtacccgtaaacggtcccgtaacccctaccggtaacccgaacgggtaccccccgggtaaccggttaaccgggttaacggggttttacggggggttaaccgggggggttttaggggggttcccggggtttttacccggggggaaaccgggggggtttaaaccggggtaaaccccgggtttaaaacgggggttttacccggttaaacccccggggtttaaccgggttaaaccggggttacccccggaaaccccgggtaaccccccgggtaaacgggggtttcccccggttaccccccccggttaccccccccgggtttaaccggttcccccgtaaaccccggtttttcccccggtttcccccggtttacccccccccttaccccccggg

SEQ ID NO: 162516 - DNA, 788 bp, Homo sapiens
  misc_feature: GYAE6OF01CJKMY.33.78.H01.1.454.CMB.1.raw
  modified_base (230)..(230): a, c, t, g, unknown or other
  misc_feature (230)..(230): n is a, c, g, or t
  modified_base (270)..(270): a, c, t, g, unknown or other
  misc_feature (270)..(270): n is a, c, g, or t
tcagtacacacactcacgaccggtgctcgatttagtgtgagtagtttgggtttgggggtgggtccaggaggcagaactctgggtgtctcaccatggcctggatccctctacttctccccctctcactctctgcacaggctctgcgcctcctacgagctgacacacgcctacgttcggtttctgtgtcacgtgggacaggacggccaggactcaccgtgctcgtggaagtntcgactagttcggaaccaaaaggtcctaaacgttaccgtntttttacggttacggtaaccgaagaccgaaaggaaccgcccggaacgggaccccgtaaccgggtcccccgttaggtaccttaggaaattaaacgtaaataacgaaaaaggacgtaaagtaggaacggtaccggtcccgttaggaacgggtaaccttcccgtagggaccgtaccgttacgttcccgtaccggtactaacgaacggtcgaacggaagggaaccaacgtacgtaccgtaacggtttacgaccgtagtaccgtaaggttacgggactaccggacggaccgaaaggacgaacggtcgtaacgtacgtactacgtcaccgtcgacctacgtacgaccgggaccgtccgtaggttaacggtggggttacgggttcgggttacgggtacgggggaccggtaagggtacccgttaacgggttccggaccccggtttacggtacgtacccggaaccgtcccggtacgacccggttccccgacccggttcgtaccttcccgtccgttccccggtccccg

SEQ ID NO: 162517 - DNA, 947 bp, Homo sapiens
  misc_feature: GYAE6OF01AW4V1.33.78.H01.1.454.CMB.1.raw
tcagtacacacactcacgaccggtgctcgatttagtgtgagtagtttgggtttgggggggtccaggaggcagaactctgggtgtctcaccatgcctggatccctctaccttcccccctccctcactctctcgcacagctcgtcgcggcctcctacgagctcgacacacgccgaccgttcgtttcgtgtcgtcacgacggacgacgaccggcgacgtacgtccaccgtgccgtcgtggagtacgtcgacgtactacgaacgaaacgaacgtaacgtaccgttactttacgtttacggtaacgacgtaacgaacgaaccggaccgaaccggaccggaccggtacccgtacgtacgtaagtaacttaaattaaacgtaaaacgaaaggaaacgtaagtaggtaacggtaaccggacccgtacgggtaacggtaccgtaccgtacggaacggtaccgtaccgtttaccgtacccggtacttaaacgacggtaacggacggtaaccggaacgtacttaaacggtccgtaaacgtaccggaaacccttacggtaccgtaaggggttacggtaccggtaaccggaacgggtaacggaaccgggtaaacgggaacgggtaacggttaaccgtaacgggttaaaccgttaaccgttaccgtaacccggttaacccgacccgtaacccggtaaccggtaccgggtaacccggttacccggttacggttaaccgggggtttaagggttcgggggtttacgggggtacccggggtttacggggggaaaccggggtaccggggttaaccggttaaacccggggttccggtaaccccggtaccgggtacccggtaccggaacccggtaacccggtaccgggtacccgtccccgggttacccccggttaccggttcccgtacccgttacccgttccccgttaccccgttaaccccgttccgg

SEQ ID NO: 162518 - DNA, 721 bp, Homo sapiens
  misc_feature: GYAE6OF01CPO7X.33.78.H01.1.454.CMB.1.raw
  modified_base (230)..(230): a, c, t, g, unknown or other
  misc_feature (230)..(230): n is a, c, g, or t
tcagtacacacactcacgaccggtgctcgatttagtgtgagtagtttgggtttgggggggtccaggaggcagaactctgggtgtctcaccatggcctggatccctctacttctccccctctcactctctgcacaggctctgcggcctcctacgagctgacacagcccaccggttcggtttctgtgtcacgtggggacaggaccggccaggactccacctgcctcgtgganatgcattcgaccaaagcaatcgcttagtcggacagcaagacgccgaggccacggccctgtacctagataatactaacgaaagagaatagacggacgccctagacggtacctaccgtgacgtcgtacttccgtaccggtactaacgaagtcgacggaacggaacctaacggacttaccgtacggttacaacctagttacgtaggtaggaccgtaccggaaggaccgaaggaaacgtacggacggtacgtacgtaacgttactaccgtacgtaccgaccccgtacgtaccgacggacccggtaagtccggtaagggttagggttacggggtgggggttcgggttaccggggacgggtacgggtaacgtacgggttaccgtaacccggttcggtaacggtccggtaaccggacccggtacggtaccccggttcccggtaccccccggttcgtacccgttaccgttacccggttcccccgttccccgtcccccgg

SEQ ID NO: 162519 - DNA, 741 bp, Homo sapiens
  misc_feature: GYAE6OF01CHFWX.33.78.H01.1.454.CMB.1.raw
tcagtacacacactcacgaccggtgctcgatttagtgtgagtagtttgggtttgggggaaaacctcattcctcctctaaagaagcccctgggagcacagcgcatcaccatggactggacctgaggttcctctttgtggtggcagcagctacaggtgtccagtcccagttccaactggtacatctgggtctgaggtgaagaggcctgggtcctggtgagggtctcctgcagtgtctgtgggacgcgccttcagccacctatcgccatcaccgtgggtcgcgacgaccggccccggacgaacgggcttggaggtgggaggttgggggtactccgacgtcccctcgttcgtccggcaactaactacagtaccaccctaaactaattaacagaacagtacgtacgtacgtaacgtttccgacgtaaacgtaaacgtaccaaaaccggtacccaacgtaaccgtaccctaacgtaacggttagggttaacggtttacgggaacgggacgtaccgtaggaaccttacgtacgtaacgaaaccgggaccgtaacggtacccgtttaaacgttacgtttacggtaccgttacgggtacgtaacggtaaacgtaacgttaaacgaaaggttcgggtaacggtaccgtaacgggttaaaagggttccggggtttttacggggttaacgtaccggttccgggtacggggacccgtacgggtaacccgtcggtacgtacgtccgtcgtacccg

SEQ ID NO: 162520 - DNA, 753 bp, Homo sapiens
  misc_feature: GYAE6OF01B4DRI.33.78.H01.1.454.CMB.1.raw
  modified_base (141)..(141): a, c, t, g, unknown or other
  misc_feature (141)..(141): n is a, c, g, or t
tcagtacacacactcacgaccggtgctcgatttagtgtgagtagtttgggtttgggggctgtgggtccaggaggcagaactctgggtgtctcaccatggcctggatccctctacttctcccccctcctcactctctgcacnggctctgccggccctcctacgagctgacacacgcccaccggttcggtttctgtgtcacgtgggacaggaccggcaggactccacctgccttcgtggagtatcgactagttaccgaccgaaaagacctaagttaccgtctttaagttcgtaacccgagaccaaggaaccgccggacggccaccggtcccctagtactagtaataatataacgaaagagaagtaggaggaccgcccgtagacgggtactcccaggacgtccgtacgttcgccggtactaaacgagtaggaaccggtaaggaacaaccgtacgtaccgttaacgggttaccaaccgtactacgacgggttaggtaccgtaccgaggtacgaagacgggacgaggtcatactacgtccaacggtccactaccacgcggtaaccgtccgttagggtaggtttcggggtagggtttcggggttacccgggtcgggggtaacgggaacgggtttcccgttaacggggtttcccggacccgtttagggttacccgggaagaccccccgggtaggttaccccgggtcccggtaccccccggttacccggtaccggtttaccctccggttttcccccccggg

SEQ ID NO: 162521 - DNA, 823 bp, Homo sapiens
  misc_feature: GYAE6OF01DY8RY.33.78.H01.1.454.CMB.1.raw
tcagtacacacactcacgaccggtgctcgatttagtgtgagtagtttggggtttggggggggtccaggaggcagaactctgggtgtctcaccatggcctggatccctctacttcctccccctcctcactctctgcacaggctctgccggcctcctacgagctgacacagccaccgttcgtttctgtgtcacgtgggacacggacggccaggactccaccgtgcctcgtggagatcgctattcgaaccaaagactaagtactacttagttacggtaccagcaacggaacgaccgacggacccgtaccggcccgtagtaaccgtagtaactaaattaactaacgaaaagtaagtaagtcggaacggaaccggtcccgtacggacgggtaccttcccgtaggacggtccgttacgttacccggaccgtactaaacgtacgacggtaccgaacgggaaccaacggtcgtaacgtacggtacctaactacgtacgaacggttacggtacgtacccgaacgggacgaagggaacggacggtaacgtacgtccgtaaactcgtaacccgtaactccgtacccaccgtaacgggtaccggcccggttaaaccgtggttaaccggggttggggtacggggttcggggtacggggttccggggaccgggtaacgggtaccggttacggggttaccgttaccccgggtacggttaccgaccgggtaacccggacccggtcccgggttacccctaccccccgggtacccccggttttacccggttaccccgttaacccggtttcccccgtttaccccggttccccccctaccccg

SEQ ID NO: 162522 - DNA, 693 bp, Homo sapiens
  misc_feature: GYAE6OF01EDDJ8.33.78.H01.1.454.CMB.1.raw
  modified_base (187)..(187): a, c, t, g, unknown or other
  misc_feature (187)..(187): n is a, c, g, or t
  modified_base (226)..(226): a, c, t, g, unknown or other
  misc_feature (226)..(226): n is a, c, g, or t
  modified_base (267)..(267): a, c, t, g, unknown or other
  misc_feature (267)..(267): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccacgttcggtttttgngtcacgtgggacagacggccaggatcacctgctctgganatgcattcgaccaaagcaatcgcttattggtacagcagaanccagccaggcccctagtactagataatatacaaagagtaatgaagacggcccttagacgggtactacccgtggacgtcgtattccgtccggacttaacaagttcggacgtaacggggaaccaacgacgttaccgtaacggtttacggaaacctacgtttaccgaagggtttcgggaacgttacccgaggggttaccaaacggtaaacggaacgaacgggtactacgggtaacccttaagtacccgtaactccggtaccctaacgttccgaaccggtaccgtaccccgtaggtagggtacgggttacgggttcgggttcgttacggggacgggtacgggtaccgtaagggttcgaacccggttccgtagggtccacggacccgaacggccgttcccgacccccgttggacctccgtccgttccccgg

SEQ ID NO: 162523 - DNA, 751 bp, Homo sapiens
  misc_feature: GYAE6OF01D90ZK.33.78.H01.1.454.CMB.1.raw
  modified_base (166)..(166): a, c, t, g, unknown or other
  misc_feature (166)..(166): n is a, c, g, or t
tcagtacacacactcacgaccggtgctcgatttagtgtgagtagtttgggtttgggggtgggtccaggaggcagaactctgggtgtctcaccatggcctggatccctctacttctccccctctcactctctgcacaggctctgccggcctcctacgagctgacacncgcccaccggttcggtttctgtgtcacgtgggacaggccgcaggtctccacctgctcgtggagtatgactagttacgaccaaagctaagttccgtactttagtcgtaccagcgaaggaacgccgacggcccgacgtcccttagtactagtaattaaataacgtaaacgaaaggtaagtaacgtacggacgtaccggtacccgtacggacggtaccgttccgaggtacgtcgttaccgttccgtaccgtactaactacggtcgacggaacgactaacgtcgtaccgtaagttccaaccttacgtacggtacggttacggaccgtaaccggaggaacgaaagggaaccggaaccggtaggtacgttaacgtaacttaccgtaccgacggttaccacccgtaatcccgggtaaccgtccggtaaccgttcgggttaagggttcggggttacgggttcgggtacggtcggggaccggtaaccgggtacgttacgtaccgggttaaccgtacgttacggcctacccggaccgtacggtcccgtaccggtaccccgtacggtccctacccgttccgttacccctaccccgg

SEQ ID NO: 162524 - DNA, 573 bp, Homo sapiens
  misc_feature: GYAE6OF01DINXW.33.78.H01.1.454.CMB.1.raw
  modified_base (215)..(215): a, c, t, g, unknown or other
  misc_feature (215)..(215): n is a, c, g, or t
  modified_base (291)..(291): a, c, t, g, unknown or other
  misc_feature (291)..(291): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
tcagtacacacactcacgaccggtgctcgatttagtgtgagtagtttgggtttgggggggtccaggaggcagaactctgggtgtctcaccatgtcctggatccctctacttctccccctcctcactctctgcacaggctctgcggcctcctacgagctgacacagccaccgtcggtttctgtgtcactgggacagacggccaggatcacctgctntggagatgcattgaccaaagcaatacgcttatggaccagcagagcagcagccctgtactgataatataacaaaganaatgagaggcctgaggatccctagacgacgattcctaccggctaacaatgcgagggaacaaaccagtacacgttagacccaatcaagtgaagtccaggacagaaagacgagatagactancactncactnacgtgtacnctagtaggtaggtggtagttcgggacggtagggaaccgaagttacggaccccgtcgtaacggtccgaaacggtcccaaaagggtccctcggacccccccgttcgggtaaccttaccgtacgtcccggttcccccgtacccccg

SEQ ID NO: 162525 - DNA, 1023 bp, Homo sapiens
  misc_feature: GYAE6OF01ENA56.33.78.H01.1.454.CMB.1.raw
tcagtacacacactcacgaccggtgctcgatttagtgtgagtagtttgggtttgggggggtccaggaggcagaactctgggtgtctcaccatggcctggactccctctacttctccccctcctcactctctgcacaggctctgccggcctcctagacgctcgacacacgccctacccggttcggtttctggtcgtacacgtaggggaccaggaccggccaggtactaccaccgttgcctcgtaggaatacttggactattcgaaccaaaagctaactcgtactttaaggttcgtaaccagacaacggaacgaccgacggccgaccggtccctagtactacgaattaactaacgtaaacgaaaagtaacggtaacgtacgggaacggtacccggtacccgtacgggaacggggttacccttacccgtaggtaacggtaccggttaccgttacccggtacggttaaacccgtaacctaagtacccgggaacggaacgggtaaaccctaaacgggtaccgttaccgtaaccggtttaacggtaaacctaacggtacggtaacgggtacggggtaaccgtaaaccggtacggggaaccgaagggtaaaaccgggtaacgggtaaaccgggtacgttaaccgtaaccggtttaattacccggtaaaccggttccgtaacccgtaccggttaaccgggaaccggggttaccccggtaacccggttacggggtttaacggggttacggggggttaacggggggttttaccggggtaaccggggttacccgggggtaaccggggggtaaaacccggggttaacccgtttaaacccgggggttacccggttaaacccgggttaccgggtttaaaacccggggtacccggtaaacccccggggtaacccgttacccggggttaaaccccgttttaccccccgggtaccccccggggttaaacccgggtttttccccaacccccggggttttttacccccgttccccggttaaaccccccccgtttaaccccgg

SEQ ID NO: 162526 - DNA, 764 bp, Homo sapiens
  misc_feature: GYAE6OF01EUYWQ.33.78.H01.1.454.CMB.1.raw
  modified_base (110)..(110): a, c, t, g, unknown or other
  misc_feature (110)..(110): n is a, c, g, or t
  modified_base (186)..(186): a, c, t, g, unknown or other
  misc_feature (186)..(186): n is a, c, g, or t
tcagtacacacactcacgaccggtgctcgatttagtgtgagtagtttgggtttgggggtgggtccagggaggcagaactctggggtgtctcaccatggcctggatccctntacttctccccctctcactctctgcacaggctctgcggcctcctacgagctgacacagccgaccggttcggtttcngtgtcacgtgggacaggacggccaggactcgaccgtgcttcgaggagtatcgactagttacgaccaaagctaagtacgtcttagttcgtacgagcgaaggacgccgtacggccacggtcccctagtacctagaattaataacgtaaacgaaaggaagaaagttcgggaacggtaccggtcccgtaaggtacgggtacccttacccgtaggacgtacggtacttcccggtaccggacttaacgacgtcggaacgacgggaacaacgtagtacccgtagttacgaacctagtacggacggtcggacgtaccgagggacgaaagggacggaaccgaggtctaagaacctataccacgtcgaacccacgtaccggcggtacggtacctaacgggtagggttacgggttacggggttacggggttaccggtacggggaaccgggtaacggttaaccgttaaccggggttccggtacccggggttacttcggggtaacctaacccggggcccgtacgggtaccccctcccggttcccccgggtaggtaaccccttccggttccccggtttcccgtaccccccgg

SEQ ID NO: 162527 - DNA, 700 bp, Homo sapiens
  misc_feature: GYAE6OF01EP7EI.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccacggccctgtactgataatataacaagagaatggagacggccctgagggatcccgtgagtcgattccgtccggctaacaaagttcgacgaaggggtaaccaaacgtagtaccgtacggtttacgaacctactacgtaacgttgggacgtccgaagggcgaacggaaggaaccggaggcgttaggacttaagttacccacgttaccgacctacgttccgaacggtaccgggaacccttacgaacgggtttggggttaacggggtttcgggggttcgggtttaccggggacgggggtaacggggtaaacccgtaagggtttccggaacccggtttaccggttcgggtaaccgaccggccccggtaaacgggtccctaccccggtccccccgttcgggtacccttacccgttccggttccggttacccccccc

SEQ ID NO: 162528 - DNA, 892 bp, Homo sapiens
  misc_feature: GYAE6OF01C5UP3.33.78.H01.1.454.CMB.1.raw
  modified_base (184)..(184): a, c, t, g, unknown or other
  misc_feature (184)..(184): n is a, c, g, or t
tcagtacacacactcacgaccggtgctcgatttagtgtgagtagtttgggtttgggggggtccaggaggcagaactctgggtgtctcaccatggcctggatccctctacttcctcccctcctcactctctgcacaggctctgcggcctcctacgagctgacacagccaccgttcggtttctgtntcacgtgggacagacgccaggatccacctgctcgtggagatcgctattcgaccaaagacaaagttacgctttagtacggtacagcgaagaacgccgacggcccgacggtccctagtactagtaataataactaacgaaagtaagaacgtagaacgaccggtcccgtaggacgggtacctcccgtagacggtaccgtacgtttccgcccggttactaacgtaacgtacgacgacgggaaaccaacgagttacctacgtttacgaactacgtacgtaggtacggacggtaccgtacggaacgtaacggaaacgggagtaacggtctaaggtacctaactaccgtaccgtacgacccctaacgtaccggaaccggtacccgggtaaccgttacgggtacggggtttaccggggttaagggggttccggggtttacgggggtttacccggggtaaccggggtaaccggggtttaaaacccgggtttaaccgggtttaaccccgggttacccccgggtttaaacccggggttaccggttaaaacccggggtaccccgtaaaccccccggggttaacccggggttaacccccgttcccccccggggtttaaacccccccggggtttcccgggttaaaaccccgttttaccccccgggtttttcccccgtttaaaccccccccggtttttccccccccggttaaacccccccggg

SEQ ID NO: 162529 - DNA, 792 bp, Homo sapiens
  misc_feature: GYAE6OF01CKEO7.33.78.H01.1.454.CMB.1.raw
  modified_base (567)..(567): a, c, t, g, unknown or other
  misc_feature (567)..(567): n is a, c, g, or t
  modified_base (575)..(575): a, c, t, g, unknown or other
  misc_feature (575)..(575): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgccgcctccgtacgagctgacacacgcctaccgttcggtttctgtgtcacgtgggacagaccggccaggatccacgtgactctggagtatggactagttacgaaccaaaagactaaagttaccgtacttttagttacggtaaccagtacgaaggaacgaccgtaacgggccgtaccggacccttagtaccgtaagtaattaactaaacttaaaacgaaaaggtaaggtaaacgttacgggaacggtaacccggtaccccgtaggaaccgggtacctaccccgtaggacgtaccgtacgtttccgacccggttaacaacgtaagaccgggtacgtaaacgggaacctaacggtacgtaccgtacgtttacgaacctagtacggagtggactacgaggtaacaggtaacgacgtagactaactactanaccgtacnccgtacctacgtacgacggtaccgtccgtaggtacgggttcggtacggggttcgggttacgggtacggggacgggtaccgggtaacgttacgggttaccgaccggttaccggtaccggtaccggtacccgtaacccggacgggcccttacccccggggtcccctttacggggtacccttaccgtttacccccgttcccggttacccccccgtacccg

SEQ ID NO: 162530 - DNA, 794 bp, Homo sapiens
  misc_feature: GYAE6OF01CTJ4K.33.78.H01.1.454.CMB.1.raw
  modified_base (226)..(226): a, c, t, g, unknown or other
  misc_feature (226)..(226): n is a, c, g, or t
tcagtacacacactcacgaccggtgctcgatttagtgtgagtagtttgggtttgggggggtcaggaggcagaactctgggtgtctcaccatggcctggatccctctacttcctcccctcctcactctctgcacaggctctgcgcctctacgagctgacacacgcctaccgttcggtttctgtgtcacgtgggacaggaccggcaggactcacctgcctcgtggacntgctattcgacaaagcaatacgtcttagttcggacagcaagaagccaggccacggtccctagtacgtagataatactaacgaaaagtagaatggacgacgcccgtagcgggtactcccgtagacgacgtcttaccgtccggtactaacgtaacgtcgaacggtaaggaacctaacgtaacggttaccctacggttacgaaacctacgtacgtaacgggtacggtaacgtaccgacgggaaccgaagggaaacgaacggaggtccgtaagtaacgtactaaccgtctacgacctacgtaccgacggtaacccggtcgttacggtaagggtttccggggtaaggggtttcggggttaccgggggttaccgggtaacccggggtaacggggtaaccgttaaccggggtttacggtaaccccgggtttcccggtaacgggtaacccggttaacccgggtaaccccgggtaaccgggttaacccccgggttcccccggttacccccccggttcggttaacccccgttaccggtttaacccccgttccccggtttaccccccgttaaacccccg

SEQ ID NO: 162531 - DNA, 892 bp, Homo sapiens
  misc_feature: GYAE6OF01CX189.33.78.H01.1.454.CMB.1.raw
tcagtacacacactcacgaccggtgctcgatttagtgtgagtagtttgggtttgggggtgggtccaggaggcagaactctgggtgtctcaccatggcctggatcccctctacttctcccccctcctcactctctgcacaggctctgcggcctcctacgagctgacacagcccaccgttcggtttctgtgtcacgtgggacagaccggccaggactccacctgcctcgtggagatgctattcgaccaaagcctaagtaccgtctttagtcggtaaccagacaagaacgccgacggcccaccggtccctagtactgaacttaatataacgaaaggagtaagtcggacggaccggtcccgtaggacgggtaccctccccgtaggaccggtaccgttaccgtttcccggtacccggtaacctaacgtaacgtaccggaaccggaaacgggtaaaccctaacggtaccgttacccgttaaccggttacccgaaacccttaccggtaacggtacgggggttacgggtaacccggtaccccgggaaaggtaacccgggaaagggtaaacccggtacggggaacggttaccgtaaccgttaaccctacgttaccccgaaccgttacccgaaccccgttacgtaacggacccgggtacccggtaaccccgttagggtaggggtttacgggggttaccggggttcgggggtttacccgggttaacggggggaccgggttaaaccggggtacccggtttaaaccgggtcccgggttaaccccgtaccggggttaaacggtccccgaacccgggtacccggtaccggggtcccccttacccccggggtcccccggttaaccggttcccttacccgtttcccccggttacccccggtttcccccg

SEQ ID NO: 162532 - DNA, 780 bp, Homo sapiens
  misc_feature: GYAE6OF01CPQ0F.33.78.H01.1.454.CMB.1.raw
  modified_base (185)..(185): a, c, t, g, unknown or other
  misc_feature (185)..(185): n is a, c, g, or t
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (324)..(324): a, c, t, g, unknown or other
  misc_feature (324)..(324): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgccggcctccacgagctgacacagccaccgttcgtttcngtgtcacgtggacaggacgccaggactcactgctcgnggaantgcagtcgaccaaagctaatacgtnttacgttcggtaaccagacaaggaacgccgacggcccgaacggtccccctaggtactagtaataaacttaanaacaaaaggacgaaagtaggaacggacggtaccccgttacggaacgggacctccggttaacggacggtaccggtacgtttacccgaccgggtactaaaccgtaagtaccggcgaaacgggaacctaaacgtacgtaccgtaacgttaccggactacgacgtaggtacggaccgtacggaggaacgaagggtaacggacggacggactcggttaaacatacccgtacgtaccgacctaaccgtccgaacggtaccgggaacccttacgggtaccggggtttgggtaacggggggtttcggggtttaccgggaccgggggtaacgggtaaacgggtaccggttaaacgggttcccggtaacccgggtttacggtaagggtaccccgaaccgggtaacccaaccggggttccccgtcccgggtaccccccgttcggtcccctaacccggtttcccccgg

SEQ ID NO: 162533 - DNA, 778 bp, Homo sapiens
  misc_feature: GYAE6OF01C02GN.33.78.H01.1.454.CMB.1.raw
  modified_base (142)..(142): a, c, t, g, unknown or other
  misc_feature (142)..(142): n is a, c, g, or t
  modified_base (164)..(164): a, c, t, g, unknown or other
  misc_feature (164)..(164): n is a, c, g, or t
  modified_base (191)..(191): a, c, t, g, unknown or other
  misc_feature (191)..(191): n is a, c, g, or t
tcagtacacacactcacgaccggtgctcgatttagtgtgagtagtttgggtttgggggtgggtccaggaggcagaactctgggtgtctcaccatggcctggactcccctctaccttcctcccccctcctcactctctgcacngctctgccggcctctacgagcngacacacgccctaccggttcggtttcngtcgtcacgtgggacagaccggcaggactcacccgtgcctcgtgggagtatcgactagttcgaaccgaaagtacctaagtacgttcttaagtccggtaccagacagaacgccgaacggcccgtaacggtcccgtagtaccgtagtaagtaaataacgtaaacgaaaggaagtaagtacggacggaccgtacccgtacggaacgggttaccctaccgtacggacgaccggttactttaccggaaccggtactaaacgaacgacggaccggaaacggaacgaacgtaccgttacctaacggtacgaacctaaggttaccgaaggtacggacgtacgaacgggacgaagaacggacggacgataacgactactacgaacgcctcacgtacgacgtccggtaccgtacgggtaggttagggtaccgggtaggtttccggggaacggtaccgggtaacgggaaccgggttaacgggttcccgggtaaccttacgggttacgaacccgggtacccgtacccggtaacggtccccggttacccgtcccccgttaacggttccccgtaccccgttccgttcccccggttaccccg

SEQ ID NO: 162534 - DNA, 761 bp, Homo sapiens
  misc_feature: GYAE6OF01EIRD8.33.78.H01.1.454.CMB.1.raw
  modified_base (386)..(386): a, c, t, g, unknown or other
  misc_feature (386)..(386): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagcctaccgtcggtttctgtgtcacgtgggacagaccggccagggactccaccgtgctcgtggagatcgactattcgaccgtaaaagctaaagtacgctttaagttcggtaacccagacgaacgaacgccgacggccacggcccctagtacgtagaactaatactaaacgaaagagaaagtggtaacggacggtaccctacgacgggaccttacccgnggacgtacgtaactttccgtacccgggtactaaccgaagtcggaacgacggtaaccaaacgtacggttaccgtacggttaccgtaacctacgttaccgaggttacgggtacgtaccggtaacggacgaaacggtaaacgggaaccggtacggacgtaacgtaaccgtaacctcgaaccgtgacccctaacgtaccgacgggacccgtacccgtaagtacgggttacggggtagggtttcgggttcgggaccgggtaacgggggacggtaccgttaaggttccgggtaaccccgttcgggttacggacccgtaaccggacccggtaaacgggtccccttacccgggacccccgttccggttaccacccgtttcccg

SEQ ID NO: 162535 - DNA, 721 bp, Homo sapiens
  misc_feature: GYAE6OF01EQZYR.33.78.H01.1.454.CMB.1.raw
  modified_base (182)..(182): a, c, t, g, unknown or other
  misc_feature (182)..(182): n is a, c, g, or t
  modified_base (257)..(257): a, c, t, g, unknown or other
  misc_feature (257)..(257): n is a, c, g, or t
  modified_base (646)..(646): a, c, t, g, unknown or other
  misc_feature (646)..(646): n is a, c, g, or t
tcagtacacacactcacgaccggtgctcgatttagtgtgagtagtttgggtttgggggggtccaggagcagaactctggtgtctcaccatggcctggatccctctattcctccccctctcactctctgcacaggctctgccggcctccgtacgagctgacacgagccctaccgtcggtttcnggtcgtcacgtgggacaggcggccaggactcacctgctcgtaggacgtatgactattcgaccaaagcaatacgtnttaattcggaccgagacaagacgccgaggaccacggccctagtaacgtagtaacttaaatactaaacgtaaaaggacgtaagtcgggaacggacggtacccgtacggacgggtacctcccggtagacgtacggtcttcccgtaccggtactaactacggtgaacggacgggaacaacggtacgtaactacgttacgaacacgtacgaggtttggaccgtaccggtaacggcggtaacgaacgggtacgacgggtacgtacggtaacttactccgtaaactccggacccaccgtacggtacggtcccgtacgtccgtaaggggttcggtaggggttcgggttacggttcgggacggtacgggtacgtaacggttacgtacccgggttacncgggtccacggtacccgagtacccgtcccgtcccggttacctccgtaaccttccgttaaccctcccgttaccccg

SEQ ID NO: 162536 - DNA, 753 bp, Homo sapiens
  misc_feature: GYAE6OF01DBX26.33.78.H01.1.454.CMB.1.raw
  modified_base (288)..(288): a, c, t, g, unknown or other
  misc_feature (288)..(288): n is a, c, g, or t
  modified_base (332)..(332): a, c, t, g, unknown or other
  misc_feature (332)..(332): n is a, c, g, or t
tcagtacacacactcacgaccggtgctcgatttagtgtgagtagtttgggtttgggggtgggtccaggaggcagaactctgggtgtctcaccatggcctggatcccctctacttcctcccccctcctcactcctctgcacaggctctggccgcctccctacgagctgaaccacacgcccaccggttcggtttctgtcgtccacgtgggacaggacggccgaggctcacctgcttcgtggagagtgctagttacgaccgaaagactaacttacgtcttagtacgtacanacgagacgacgacggccacggccctagtactagtaactaataanaacgaaagagagtacggaaggaccgacctacgacggtacctccgtagacggtactacgttccgtacccggtactaacgaggtacgaacggtaacggaactaacggtaacgttacctaacggtacgtaaccgtataccggtaaggtagggtacccgtaggaaccggaagaacgggaaacggtaggaacggtacgtacgtaacctcgtacccacgttaccgaaccgtacctacggaccggtacccggtaaccgtaggttaccggggtaagggttacggggttacgggttacgggttccggggaccgggtaacggaaccgttaacgggtccgtaaccggtacggtaccgtaggaacccggtaccgccggtacccgtcggtacccccgtccggaccgtttcccttcccggtcccgttaccccccg

SEQ ID NO: 162537 - DNA, 753 bp, Homo sapiens
  misc_feature: GYAE6OF01BMSOB.33.78.H01.1.454.CMB.1.raw
  modified_base (604)..(604): a, c, t, g, unknown or other
  misc_feature (604)..(604): n is a, c, g, or t
tcagtacacacactcacgaccggtgctcgatttagtgtgagtagtttgggtttgggggggtccaggaggcagaactctgggtgtctcaccagtggcctggatccctctacttcctccccctctcactctctgcacaggctctgcggcctcctacgagctgacacacgccctaccgttcggtttctgttcgtcacgtggacaggaccggccagactccaccgttgacctcgtaggagtactggactaagttcgaacccgtaaaaggccgtaagttacccggtacttttacgtttacggaccagaccgaaggaacgcccgaccggtcccgaccggtaccccgttagtactaggtaacttaaagttaactaacgaaaaggttagaacgtacggaccggacggtaccccgaggtacgggcctacccgtacggtacgtccttacgttccccgtaccggtcttaacgacgtacggacgtaaacggacaacgtacgtacgtacgtacacctacgtacgtaggcgaacgtacggacggaacgaaggaacgtaccggagtacgtacgaccttacgccgaactaccgaccacggtcgacgtaccggcttacggngggttacggttaggttgggttcggtaccggacgggtaccgacgtacgtacggtaccccgtagttcccggtactacccggaccggtaacggccccttacccggccccggtaccttcctacccggtttcctaccccggttcccctaccccg

SEQ ID NO: 162538 - DNA, 694 bp, Homo sapiens
  misc_feature: GYAE6OF01BWC1C.33.78.H01.1.454.CMB.1.raw
  modified_base (239)..(239): a, c, t, g, unknown or other
  misc_feature (239)..(239): n is a, c, g, or t
  modified_base (517)..(517): a, c, t, g, unknown or other
  misc_feature (517)..(517): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggtcctacctacgagctagacactacgccctcgttcggtttctgtcgtacacgtgggacacggacggccaggtatcacctgtctcgtgganatgctattgaccaaagcaatacgtactttagttacggaccaggacagaacgccgacggccacggccctacgtacgtagaattaactaactaacgaaagtaagaaagtacggaacggaccggaccctacggaacgggtactccccgtaggaccgtcgtactttccgaccggtaacctactacgtcgacggaacggacctaaacgtacgtacgacgttcgactacgtagtacggtggtaacggacgaggacaagaaggacggacggtactacgaacttanacctacgaccgtactaaccgtcgaacgtacccgtaccgtcggtacgggttacgggtaggggtttgggtacgggttacgggcggggaaacggtaccgttaggtcggtacccggtacgtcggtaccgaccgtacgacccggtaccgtccgtacccccggtctcccgtaccgttccccgg

SEQ ID NO: 162539 - DNA, 853 bp, Homo sapiens
  misc_feature: GYAE6OF01BAJY3.33.78.H01.1.454.CMB.1.raw
  modified_base (830)..(830): a, c, t, g, unknown or other
  misc_feature (830)..(830): n is a, c, g, or t
tcagtacacacactcacgaccggtgctcgatttagtgtgagtagtttgggtttgggggaaaacctcattcctcctctaaagaagcccctgggagcacagcgcatcaccatggactggacctggaggttcctctttgtggtggcagcagctacaggtctccagtcccagttaccaacgtggtacaattcgtgggtctggaggtgaacgaggtccgtgggtccctgggtcggacgggttcctccgtgacgtagttcgtccgtcgtggggacgccgtccttacgacgtcctaaccttagcgacccgtacgtaccgtaaccgttcgggtcggaccgaacccggacccgggtacccccgggaaagtaaccggggttaccgttaggtacgggtacggggtacgggttacggggggtaccttaccgtaacccgttcccggttaccgttcccggtttaccggaaccgttaacctaaaccgttaacgtaaccggttacccgaacccgtaaacttaaaaccgtttacgaaacgtacgtaaggtaacggttacgaaccgttaggtttaccgaaacgtaaaccgtaacgtaaccgaaacgtaacccgtaaccgtacgtacccacgtaaggtacggtaaggtttacggaacgggtaccgtaccgttagaacccgtacgtacggtaaagtaccggaacgtaccggtaaccggttaacgttaacgttcgaaggtccggtaagacgtaagtaacgtaagtacgttaggacggaacgttagtaaacggtttcgggttaacggttagtaacccggtcgggtaacggacccggtaacgtaaccgggttntaacccgtcggtcctcgtacccg

SEQ ID NO: 162540 - DNA, 733 bp, Homo sapiens
  misc_feature: GYAE6OF01EQINJ.33.78.H01.1.454.CMB.1.raw
  modified_base (134)..(134): a, c, t, g, unknown or other
  misc_feature (134)..(134): n is a, c, g, or t
  modified_base (237)..(237): a, c, t, g, unknown or other
  misc_feature (237)..(237): n is a, c, g, or t
  modified_base (253)..(253): a, c, t, g, unknown or other
  misc_feature (253)..(253): n is a, c, g, or t
  modified_base (280)..(280): a, c, t, g, unknown or other
  misc_feature (280)..(280): n is a, c, g, or t
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
  modified_base (357)..(357): a, c, t, g, unknown or other
  misc_feature (357)..(357): n is a, c, g, or t
  modified_base (507)..(507): a, c, t, g, unknown or other
  misc_feature (507)..(507): n is a, c, g, or t
  modified_base (627)..(627): a, c, t, g, unknown or other
  misc_feature (627)..(627): n is a, c, g, or t
  modified_base (694)..(694): a, c, t, g, unknown or other
  misc_feature (694)..(694): n is a, c, g, or t
tcagtacacacactcacgaccggtgctcgatttagtgtgagtagtttgggtttgggggggtccaggaggcagaactctgggtgtctcaccatggcctggatccctctacttcctccccctctcactctctgcanaggctctggccgcctacctacgagctagacacacgccctaccggtttggtttctgtcgcctacggtcggacaggccggtccaaggactccactgcctgtgganatgatatcgaaccaanctaatccgtttagtcgacagacagacncgacggccacgtccngtactagactaatanaacgaaagagtacgagacgtaccggtcctaaggtacggaccttccgnggacgtccgttacttcccggacggttaacctagtacgtcggaaaccggtaggtaaaccacgtcggtaaccgttagtaccaaccttagcgtagggtacggtactccgagaacggaacgtaaggacgcgtcgtaactataacccgtctaacnccggtaccctaacggtaccgccgggtaacctacggtttaacgggaggggttttacgggttacgggggttgtaccggggggttacgaacgggttaccgggtaaccgtttacggggttcccncggggtttaaccccggggtaaccgtaccccgaccgggtcccttaccccggtccgttaaccccgggtnttcccgaacgtttccccctttaccccggcccttacccgg

SEQ ID NO: 162541 - DNA, 739 bp, Homo sapiens
  misc_feature: GYAE6OF01ED6KD.33.78.H01.1.454.CMB.1.raw
  modified_base (228)..(228): a, c, t, g, unknown or other
  misc_feature (228)..(228): n is a, c, g, or t
  modified_base (319)..(319): a, c, t, g, unknown or other
  misc_feature (319)..(319): n is a, c, g, or t
tcagtacacacactcacgaccggtgctcgatttagtgtgagtagtttgggtttggggggtccaggaggcagaactctgggtcgtctcaccatgcctggataccctctacttctccccctctcactctctgcacaggctctgcggcctcctagagctgacacagcccaccggttcggtttctgtgtcacgtgggacagacggccaggatccacctgcctgtaggacgtntgctacgttgaaccaaagctaagtacgtactttagttacggtaccagacgaagacgccacggccacgtccctagtacgtagtaataactanaacgaaaggagtaagtaggacgaccggaccgtacggacgggtactcccgaggacgtacgtacttaccgaccgtactaacgaacgtcggacgaaggacctaacgtacggtacctacggtacgacctagtacgtagggtccggtacggtaccgacggacgaacggaacggaacggtacggacgtacgtacgtactacgtacgtaccgaccaccgtacgacggaccggtaccgtacgtacgggttagggttacggggttacgggttacgggttacgggtacgggtacgggtaccggtaacggttaccggtacccggttaccggttaccggtaccgtacccggtacccggtaccggtcccgtacccgtccccgttaaaaaaacccggttccgtacccgttcccgttcccgttccccgtaccccg

SEQ ID NO: 162542 - DNA, 1030 bp, Homo sapiens
  misc_feature: GYAE6OF01C329M.33.78.H01.1.454.CMB.1.raw
tcagtacacacactcacgaccggtgctcgatttagtgtgagtagtttggggtttgggggctctgggtccaggagacagaactctggggtgtctcacatggcctggatccctctacttcctccccctcctcactctatgcacaggctcgtggccggcctcctacgagctagacacacgcccgtaccggttcggtttctggttcgtaccgtacggtacggggaaccagggaccgggcccgtaagggtactcccaccgttgtaccgtcggtaggacgtacttcggtactaacgttaccggaaccgaaaacgtaacctaaagtttaccggttaccttttaacggttttaccgggtaaacccaggaccgtaaaacgggaaacccggtacccgggaaccgggtaccccgacccgggtacccccttaggtaccgttaaggtaaattaaacgttaaacgaaaccgtaaaaggtaagaagtacgggaacggtacccgggtacccgtaacgggaccgggtacctacccgggtaggacggtaccgttaccgttcccgggtacccggtaacctaacgtacggtacggaaccgggtaacgggtaaaccctaacgtaccggtaacccggttaacggttaaccgaccgtaacgttacggtaacggggtaccgggtaaccgtaacccgggaacggacggaaacgggtaaccggaacggggtacggtaccgttaacgtaaccggtttaaccacccgttaacccgtacgtaacccccggttacgtaaccccgggtaaccgggtacccgggttaacccggtacgggtttacggggggttacgggggtttacggggttaccggggggtttaccggggtaacccggggggaacgggtaaaccgggggtttaaacccgtaccgggggttacccgggtaaaccccggtttagggttacccgggtaacccgaacccggggtaccccggttaggtccccccggtttaccccccggtacccgggtttccggtacccttaaccccggtttcccccgg

SEQ ID NO: 162543 - DNA, 864 bp, Homo sapiens
  misc_feature: GYAE6OF01ECM29.33.78.H01.1.454.CMB.1.raw
  modified_base (400)..(400): a, c, t, g, unknown or other
  misc_feature (400)..(400): n is a, c, g, or t
tcagtacacacactcacgaccggtgctcgatttagtgtgagtagtttgggtttgggggggtccaggaggcagaactctgggtgtctcaccatggcctggactccctctacttcctccccctcctcactctctcgcacgaggctcgtggccgtccttccgtagagtctacgaccacgacggtccctaccggtttcgtttctggtcgtcacggtacgggaacaggtaccggacctaggtactccgtaccgtcgtacctggtaggacgtcgtacgtcttaacggttaccgaaaaccggaaattaccgttaaacgtaccgtttacgttttacggttacggaaccgacgtaacgaagtaccggaccggacggtaccgtaccggtaccttcgtaagaataacgtanaacgtaagagatacgagacgccgtaccgtacgacggtcctcggacgtacgtccggttactccgacgttaacgaacgtcgaccggtaagaaccgggtaacccaagttaccggtaaccgttagggtaaacctaacgtcgggtaacgttaagggtaccggtacgggtaccgaaacgggtaacggaaacggaacggaacgtaaccggtacgtaacgttaaccgtacgtaccgtaccgttaccgaccgtaccgtaccggtaccggtacccgttacggtacggttacgggttacgggtcggggtttacggggtaccgggtacgggtaacgggtaccggttacggtacggttaacccggtaccggtaccggtaaccggtccgttaaccgggacccgtcccgggtacccgtccccggttaccccggtaccgttacccgttcccggttccccgttccgttcccccgtacccgg

SEQ ID NO: 162544 - DNA, 817 bp, Homo sapiens
  misc_feature: GYAE6OF01DT488.33.78.H01.1.454.CMB.1.raw
  modified_base (111)..(111): a, c, t, g, unknown or other
  misc_feature (111)..(111): n is a, c, g, or t
  modified_base (208)..(208): a, c, t, g, unknown or other
  misc_feature (208)..(208): n is a, c, g, or t
  modified_base (372)..(372): a, c, t, g, unknown or other
  misc_feature (372)..(372): n is a, c, g, or t
  modified_base (465)..(465): a, c, t, g, unknown or other
  misc_feature (465)..(465): n is a, c, g, or t
  modified_base (602)..(602): a, c, t, g, unknown or other
  misc_feature (602)..(602): n is a, c, g, or t
tcagtacacacactcacgaccggtgctcgatttagtgtgagtagtttgggtttgggggctgtgggtccaggaggcagaactctgggtgtctcaccatggcctggatccctntacttctccccctctcactctctgacacgaggctcgtggccggtccttacctacggacgtcgtacgacacgacgacccgtaccggtttcggttttcnggttgtaccgtaacggtcggggaacacggtaccgggccaaggtacctccgtaacccgttgccttggtaggaacgtgttcgactacgtacggaaacaaagtctaaactacgtcttagtacgaccagacgaagaacgcgacggtacgaccgtcccgtagtacgtanaacttaagtacgaacgaaagagtaacgtacggaacggccgtaccgtaagacggtacctcggtagacgtacgtactccggacgtacaagtacgngaacggacgaataccggactacggtaacgtagaacgtacgtacgacggtacggtaacgtaccggaagaccggaaacgaacgttacgggaacggtacttaacgtacgtaactacgtcgaaccgtacgttaacccgggngaaccgggtaaccgtccgttaaggggtaaccgggttggggttacgggtttacgggggtccgggtaaccgggtaagggggaaccgttaccggttaaacgggttaacccgggtccccggttaaaggtaaccccgggtcggttaaaacccgggaccggttacccggtaaccccgggttccccacccgggttttcgaacccggttcccttaaccccggg

SEQ ID NO: 162545 - DNA, 877 bp, Homo sapiens
  misc_feature: GYAE6OF01BDBB0.33.78.H01.1.454.CMB.1.raw
  modified_base (190)..(190): a, c, t, g, unknown or other
  misc_feature (190)..(190): n is a, c, g, or t
  modified_base (235)..(235): a, c, t, g, unknown or other
  misc_feature (235)..(235): n is a, c, g, or t
  modified_base (253)..(253): a, c, t, g, unknown or other
  misc_feature (253)..(253): n is a, c, g, or t
tcagtacacacactcacgaccggtgctcgatttagtgtgagtagtttgggtttgggggctgtgggtccaggaggcagaactctgggtgtctcaccatggcctgatccctctacttctccccctcctcactctctgcacaggctctgcgcctcctacgagctgaccacacgccctaccggttcggttttcngtctcacgtgggaccaggaccggcaggactccactgctgtaggantgctagttcgaccgaaanactaatacgtatttacgttacggtaaccagacagaaccgccgacggtaccaccggtccccttagtaactagtaaataactaaacgtaaccgaaaagaagtaacgtaggaacggtacccggtccgtacggaacgggtaccttaccgaggaccgtacgttacctttcgaccgtactaacgtaagtcggaacgaaacggtacaaacgttagtacccgtacgtacggacctagtcgagtacggtaaccgcggaacggacgaaggaacggtacggacggttactagtaaccttaacgtcccgtaacgttacccggtaaccctacggtacggtaacccggaccggttaaccccgtaggggttaaagggtttccgggggtttaaggggttcccgggtttacggggggttacccggggaaacccggggtaaacggggtttaaacccggttaaaccggggttacccgggttaacccccggggtttaccccgggtttaacgggggaaaccccgtacccccggggtaaaaccccgggtaccccggggttttccccccgtaaccccccccggggggttttacccccggttaccccgggttttaaacccgttaccccccggtttttacccccccggg

SEQ ID NO: 162546 - DNA, 765 bp, Homo sapiens
  misc_feature: GYAE6OF01E0DTP.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctcccccctcctcactctctgcacaggctctgccggcctcctacgagctgacacagcccaccggttcgttttctgtgtcacgtgggacagacggcaggatcacctgctcgtagggagatcgctagttcgaccaaagactaacttacgtactttagttcggtaaccagacgaagaacgacccgacgggacccaccggaccccgttagttaccgtagtaagttaaataataaaaccgaaaaggaagtaacgtaggaacggacggtacccgtacggaagggtaccgtcccgtaggacgtacgtacgttaccgtaccggtactaacaacgtcgtacggaaaccgggtaaccaaacgtacgtacccgtaacggttacaccgtactcgtaacgggttaggacccgtaccggagaacgaaggtaaacggaccggtaagtcgttaaacgaccttactaccgtaccgtaccgaccctacgtaccggacggtacccggtaaccttacggaggggtttacggggttaggggttcggggttacgggttccgggaacggggacggtaaccgtacggttcggacccggtttacggtcggtacgaccggcccgtaacgtcccgtaccccgtccccgttacgaccttccttccggttccccgtccccg

SEQ ID NO: 162547 - DNA, 769 bp, Homo sapiens
  misc_feature: GYAE6OF01CU4LL.33.78.H01.1.454.CMB.1.raw
  modified_base (182)..(182): a, c, t, g, unknown or other
  misc_feature (182)..(182): n is a, c, g, or t
  modified_base (197)..(197): a, c, t, g, unknown or other
  misc_feature (197)..(197): n is a, c, g, or t
tcagtacacacactcacgaccggtgctcgatttagtgtgagtagtttgggtttgggggggtccaggaggcagaacttctgggtgtctcaccatggcctggatccctctacttctcccctcctcactctctgcacaggctctgccggcctcctacgagctgacacagcccaccgtcggtttcngtgtcacgtgggacngacgcaggatcactgctcgtggagatgctattcgaccaaagcaagttacgctttagttcggacagcaagacgaccgaggccgaggtccctgtaactagaacttaataactaacgtaaagaaggtaaatacggacggaccggtaccctaggacgggtaacctcccgtagacgtcgtacttccgtccggtactaagtaaacgtcgacggtaacggaacctaacgaggttacctacggtttaacgaccgtaacgtacgtaggtcggaacgttacccggaggacgaaggtaacggaacggtacggacttaacggacttactaccgacgttccggaccctacgtacgaaccggccgtaaccgtagtacgggttaaggggtcggggtttcgggttacgggttccggggtaaccgggacgggttaacccggttaacggtttcccgggaaccggtttaccggttaccggtaaccggtaacccgtacccgggtaaaccgggtccggttacccccgtacccccgggttacggttaccccgttaaccctttaccccggtcccgtttcccccccggtaaccccg

SEQ ID NO: 162548 - DNA, 684 bp, Homo sapiens
  misc_feature: GYAE6OF01ECXRV.33.78.H01.1.454.CMB.1.raw
  modified_base (244)..(244): a, c, t, g, unknown or other
  misc_feature (244)..(244): n is a, c, g, or t
tcagtacacacactcacgaccggtgctcgatttagtgtgagtagtttgggtttggggggtccaggaggcagaactctggtgtctcaccatggcctggatccctctacttcctccccctctcactctctgcacaggtctctggccggccctacctacgagctagacacacgtccctaccgttcggtttctgtcgtcgacgtgggaccaggaccggccaggtactccaccgtgtcctagtaggagngtagcgtagtcgaacctaagacctaacgtacgttactttagtaccggtacacgacgaacgaccgaccgaccggccgtaccgtaccgtagtactagtaataataacgaaacgaggaacgtagtacggacggtaccggaccgtaggtaccgtactaccgtagtacgtacgttacctaccgtaccgtacgtacgtacgtacgacggaacgtactacgtacgtacccgtacgtacacgtacgttgacgtcgtacgacgagacgagacggacgagactacgtacacgactcgacacacgacgacgcgcgtacgtaggtcggtagggtcggtacggtacggacggtacggtacgtacgtacggtaccgtacgtacgtaccgaccgaccggtcgtacccgtcccgtacccgtccgtaccgttaccctcccgttcccgtcccgtcccg

SEQ ID NO: 162549 - DNA, 864 bp, Homo sapiens
  misc_feature: GYAE6OF01A0G8K.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctcccccctcctcactctctgcacaggctctgccgcctcctacgagctgacacacgccaccggttcggtttctgtcgtcacgtgggacaggaccggccaggtactccacctcgtctcgtggacgtagtcgacttagttacgaaccgaagacaacttacggtctttagtacgtaccagacgagtaccgccgtacggacccgaccgcccgtagtaccgtagaattaacgtaacgtaaacgaaaggtaacgtaaggaggtaacgggaacccggtcccgtaacggtacgggtaccttaccccgtggaaccgtaccggttacttacccggtacccggtaccttaaacgaacggtaccgacgggtaaaccggtaaaccgtaaaccggtaacggttaccgttaaccggtaccgaaacgtacgtaccggtaggtacggtacgtaccggagacgaacggaacggacggtacgtcgtacgtaactacgtacgtacgtaccgaccgtacgtacccgtacggacccgttacgtacggtaccgggttaggggttaccgggttacggggttaccggggtacggggttaaccgggggtaaccgtaaccgggtttacgggttaacccgggttaaccggttacccgggttaaccggtacccgtaacccggtaccccggtaacccgggtccccggttaacccccgtacccccggtttacccggtaacccggttaccccgttttccccggttccccccgttacccccccg

SEQ ID NO: 162550 - DNA, 804 bp, Homo sapiens
  misc_feature: GYAE6OF01BFO3G.33.78.H01.1.454.CMB.1.raw
tcagtacacacactcacgaccggtgctcgatttagtgtgagtagtttgggttggggctggtgggtccaggaggcagaactctgggtgtctcaccatggcctggactccctctacttcctcccctcctcactctctgcacaggctcgtcgcggtcctcctacgagtctgacacacgccctaccggttcggtttctgtcgtcacgtggacacgacggccagactcaccgtcgctcgtacgggagtcgtcgtacgtaacgtttcgaacccgaaaagacaaaacggttccgtacgtttaacgttcggtaaccagactaacggaacggtccgaccgggtaccaaccggtcccttacgtacgtagtaactaactaactaagaaacgacgtaacgtcggaacgtaccgtacccgtacgaacgggtactaccggacgtacaccgtttaccgaccggttacgtactaacgtacgtacggtaacggaacgtacgtacgtacgtacgtacgtacgaactgtacgtacgggtacgtacgacgacgtaacgaaacgaacggtaaggacgtcgaacgtacgtacgttacgactccgtaacgtaccgtacggaccgtacgggttccgtagggttacgggttcggggttacgggttaccggggtcggttaacgggggaccgggttaacggtaccggtttacggtacccgggttaaccgggttaccggttccggttaacccggacccgggttacccggtaccccgttaacccggttacccggtaccccgttttacccgggaacccttcggtttacccccgg

SEQ ID NO: 162551 - DNA, 506 bp, Homo sapiens
  misc_feature: GYAE6OF02F5TEE.33.78.H01.1.454.CMB.1.raw
tcagtacacacactcacgaccggtgctcgatttagtgtgagtagtttgggtttgggggtccaggaggcagaactctgggtgtctcaccatggcctggatccctctacttctcccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctccggctacaatgcagggacaacagtcacgttgaccatcagtggagtccaggcagaagacgaggctgactatcactgccactcagcggactcagtggtaggtgggtgttcggcggagggacaagttgacgtcctaggtcagcccaaggctcgcccctcggtccactctcgtcccgtccc

SEQ ID NO: 162552 - DNA, 504 bp, Homo sapiens
  misc_feature: GYAE6OF02IVJC6.33.78.H01.1.454.CMB.1.raw
tcagtacacacactcacgaccggtgctcgatttagtgtgagtagtttgggtttggggggtccaggaggcagaactctgggtgtctcaccatggcctggatccctctacttctcccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatataacaaagagaatgagaggccctcagggatccctgagcgattctccggctacaatgcagggacaacagtcacgttgaccatcagtggagtccaggcagaagacgaggctgactatcactgccactcagcgactcagtggtagtgggtgttcgcggaggacgagtgaccgtcgtaggtcacgccgaagctcgcccctcggtccactctcgtccctaccc

SEQ ID NO: 162553 - DNA, 495 bp, Homo sapiens
  misc_feature: GYAE6OF02FI31Q.33.78.H01.1.454.CMB.1.raw
tcagtacacacactcacgaccggtgctcgatttagtgtgagtagtttgggtttggggctgtgggtccaggaggcagaactctgggtgtctcaccatggcctggatccctctacttctcccctcctcactctctgcacaggctctgcggcctcctacgagctgacacagccaccgtcggtttctgtgtcactgggacagacggccaggatcacctgctctggagatgcattgccaaagcaatacgcttatggtaccagcagaagccaggccaggccccctgtactgataatatacaaagagaatgagaggccctcagggatcccctgagcgattctccggctacaatgcagggacaacagtcacgttgaccatcagtgagtccaggcagaagacgagctgactatcactgccactcagcggacctcagtggtaggtggtgttcggcggaggccaagttgaccgtccaggtcagcccaaggctgcccctggtcactc

SEQ ID NO: 162554 - DNA, 493 bp, Homo sapiens
  misc_feature: GYAE6OF02JA4E9.33.78.H01.1.454.CMB.1.raw
  modified_base (311)..(311): a, c, t, g, unknown or other
  misc_feature (311)..(311): n is a, c, g, or t
  modified_base (330)..(330): a, c, t, g, unknown or other
  misc_feature (330)..(330): n is a, c, g, or t
  modified_base (419)..(419): a, c, t, g, unknown or other
  misc_feature (419)..(419): n is a, c, g, or t
  modified_base (439)..(439): a, c, t, g, unknown or other
  misc_feature (439)..(439): n is a, c, g, or t
  modified_base (472)..(472): a, c, t, g, unknown or other
  misc_feature (472)..(472): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagagcctnaggatccctgagcgattcncggctacaatgacgaggacaacagtacacgttgaccatcagtgactcaggcaagagacgaggctgactatcactgccactcagcgaccncagtggtaggtggtgtcggnggacggacagtgacgtcgaggtcacgccaagcncgcccgtgcacgtctcgtccc

SEQ ID NO: 162555 - DNA, 539 bp, Homo sapiens
  misc_feature: GYAE6OF02FF3XH.33.78.H01.1.454.CMB.1.raw
  modified_base (442)..(442): a, c, t, g, unknown or other
  misc_feature (442)..(442): n is a, c, g, or t
tcagtacacacactcacgaccggtgctcgatttagtgtgagtagtttgggtttggggtgggtccaggaggcagaactctgggtgtctcaccatggcctggatccctctacttctccccctcctcactctctgcacaggctctgcggcctcctacgagctgacacagcccaccgtcggtttctgtgtcactgggacagacggccaggatcacctgctctggagatgcattgccaaagcaatacgcttatggtaccagcagaagccaggccaggcccctgtactgataatatacaaagagaaatgagaggcccctacgagggaatcccctgaagcgtacttcctccggcttaacaaatcgacagggaacaacagtcacgttgaccatcagtggagtccaggcaagaagacgaggctagactatcacttgccactcaggcgaccngagtggtaggtgggttgtcggcggaggaccagttcgaccgtccgtaggtcacgcccgaaggcctcgcccccgtcggtccacgttcctcgttcccccg

SEQ ID NO: 162556 - DNA, 522 bp, Homo sapiens
  misc_feature: GYAE6OF02F8SX2.33.78.H01.1.454.CMB.1.raw
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
tcagtacacacactcacgaccggtgctcgatttagtgtgagtagtttgggtttgggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttatggtaccagcagaagccaggccaggcccctgtactgataatataacaaagagaatgagaggccctnagggatccctgagcgattcnccggctacaatgcagggacaacagtcacgttgaccatcagtggagtccaggcaagaagacgaggctagactatcactgaccactcacgcggacctcaggtggtaggtggtgttcgggcgaggacagttcgaccgtcgaggtcacggcccgaaggcctcgaccccgtggtacctctaccgttcgtcccctaccc

SEQ ID NO: 162557 - DNA, 503 bp, Homo sapiens
  misc_feature: GYAE6OF02IRXTE.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctcggctacaatgcagggacaacagtcacgttgaccatcagtgagtccaggcagaagacgaggctgactatcactgccactcagcgacctcagtggtaggtggtgttcggcggagggacaaggttcgacgtcctaggtcacgccgaaggctcgcccctggtccactccg

SEQ ID NO: 162558 - DNA, 553 bp, Homo sapiens
  misc_feature: GYAE6OF02G7A63.33.78.H01.1.454.CMB.1.raw
tcagtacacacactcacgaccggtgctcgatttagtgtgagtagtttgggtttgggggggttccgggaaggagggacagaactcgtcgggtcgtcgtctaccagtggcctgggatcccttcgtacttcggtccccgtcctcactctactgtcgacaggtcgtctgcggccgtccctacggagcgtcgacgacaaggcctaccgttcggtttctgtgtctactgggacaggacggccgaggaagtcacctgctctggagatgcattgccaaaagcaaatacgcttattggtaccagcagaagccaggccaggccccctgtactgataatatacaaagagaatgagaggcctcagggatccctgagcgattctccggctacaatgcagggacaacgagtcacgttgaccatcagtggagtccaggcagaagacgaggctgactatcactgccactcagcggacctcgacgtgggtaggtgggtgttcgggcggaggacagtgaccgtcgtaggtcagccgaaggctgcccctcggctactcttcgtccctacccg

SEQ ID NO: 162559 - DNA, 530 bp, Homo sapiens
  misc_feature: GYAE6OF02JADEM.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggcccaggccccctgtactgataatatacaaagagaatgagagggccctcgagggatcccgtgacgcgattcctccggctacaatgcgagggaacaacagtcacgttgaccatcagtggagtccgaggcagaagacgaggctagactatcactgccactcagccggactcgaggtggtaggttggttgttcgggcgggaggaccgtaaggttcggaccgtccgtaggtcagcccaaggcctcgccccgtcggtccactccg

SEQ ID NO: 162560 - DNA, 510 bp, Homo sapiens
  misc_feature: GYAE6OF02I8PF5.33.78.H01.1.454.CMB.1.raw
tcagtacacacactcacgaccggtgctcgatttagtgtgagtagtttgggtttggggggtccaggaggcagaactctgggtgtctcaccatggcctggatccctctacttctcccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggcctcaggatccctgagcgattctccggctacaatgcagggacaacagtcacgttgaccatcagtgagtcaggcagaagacgaggctgactatcactgccactcagcggacctgacggtggtagggtgggtgttcgggcgggaggacaagttgaccgttcgaggtcaggccaggctcgcccctcggtccactctcgttccctacccg

SEQ ID NO: 162561 - DNA, 521 bp, Homo sapiens
  misc_feature: GYAE6OF02G40ZN.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggcctcagggatccctgagcgattctccggctacaatgcagggacaacagtcacgttgaccatcagtggagtccaggcagaagacgaggctgactatcactgaccactcagcggacctcagtggtaggtgggtgtcgggcggagggaccgtaaggttcggaccggttccgtaggtcgacgcccgaaggcctcgcccccgtcggtccactccg

SEQ ID NO: 162562 - DNA, 499 bp, Homo sapiens
  misc_feature: GYAE6OF02GQX6O.33.78.H01.1.454.CMB.1.raw
  modified_base (316)..(316): a, c, t, g, unknown or other
  misc_feature (316)..(316): n is a, c, g, or t
tcagtacacacactcacgaccggtgctcgatttagtgtgagtagtttgggtttgggggctgtgggtccaggaggcagaactctgggtgtctcaccatggcctggatccctctacttctcccctcctcactctctgcacaggctctgcggcctcctacgagctgacgacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctnagggatccctgagcgattctccggctacaatgcagggacaacagtcacgttgaccatcagtggagtccaggcagaagacgagctgactatcactgccactcagcgacctcagtggtagtgggtgtcgggcggaggacaggttgccgtcgtaggtcagccgaaggctcgcccctggtcactccg

SEQ ID NO: 162563 - DNA, 508 bp, Homo sapiens
  misc_feature: GYAE6OF02F48H2.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggccccctgtactgataatatacaaagagaatgagaggccctcagggatccctgagcgattctccggctacaatgcagggacaacagtcacgttgaccatcagtgagtccaggcagaagacgaggctgactatcactgccactcagcggacctcagtggtaggtgggtgttcgggcggaggacagttgacgtcctaggtcagcccaaggctcgcccctcggtccactctcgtcccaccc

SEQ ID NO: 162564 - DNA, 542 bp, Homo sapiens
  misc_feature: GYAE6OF02IB5UW.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcgagggatcccctgagcgattctccggactacaatgcagggacaacagtcacgttgaccatcagtggagtccgaggcagaagacgaggctgactatcactcgccactcagcggacctcagtggtagggtgggtggttcggcgggagggaccgaaggttcggtaccggtaccgtacgggtcacggacccgaaggccgtaccggccccccgtcggtcccaccttcccgg

SEQ ID NO: 162565 - DNA, 515 bp, Homo sapiens
  misc_feature: GYAE6OF02JD4XS.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggccccctgtactgataatatacaaagagaatgagaggccctcagggatccctgagcgattctccggctacaatgcagggacaacagtcacgttgaccatcagtggagtccaggcagaagatagaggctgactatcactcgccactcagcggacctcagttggtaggtggtgttcggcggagggacgaggttcgaccgtccgtaggtcacgcccgaaggcctcgcccccgtcggtcctccg

SEQ ID NO: 162566 - DNA, 505 bp, Homo sapiens
  misc_feature: GYAE6OF02F4K8K.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctccggctacaatgcagggacaacagtcacgttgaccatcagtggagtccaggcagaagacgaggctgactatcactgccactcagcgacctcagtggtaggtgggtgttcggcggagggaccagttgaccgtcgtaggtcagcccaaggctcgcccctggtcactctgtcccc

SEQ ID NO: 162567 - DNA, 511 bp, Homo sapiens
  misc_feature: GYAE6OF02FICQ6.33.78.H01.1.454.CMB.1.raw
tcagtacacacactcacgaccggtgctcgatttagtgtgagtagtttgggtttggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcgagggactccctgagcgattctccggctacaatgcagggacaacagtcacgttgaccatcagtgagtcaggcagaagacgagctgactatcactcgccactcagccggactcgagtggtaggtggtggttcgggcggagggaccaagttcgaccgtcgaggtcagcccgaagctcgcccctggccactctcgtcccgtccc

SEQ ID NO: 162568 - DNA, 519 bp, Homo sapiens
  misc_feature: GYAE6OF02HIB9J.33.78.H01.1.454.CMB.1.raw
  modified_base (408)..(408): a, c, t, g, unknown or other
  misc_feature (408)..(408): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctccggctacaatgcagggacaacagtacacgttgaccatcagtggatccaggcagaagacgaggctgaactancactgccactcagcggacctcaggtgtagggtggtcgttcgggcggagggaccaaggttcgaccggtcctaggtcacgcccgaaggcctcggcccccgtggtcccatcccg

SEQ ID NO: 162569 - DNA, 501 bp, Homo sapiens
  misc_feature: GYAE6OF02F9IXQ.33.78.H01.1.454.CMB.1.raw
  modified_base (446)..(446): a, c, t, g, unknown or other
  misc_feature (446)..(446): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctccggctacaatgcagggacaacagtcacgttgaccatcagtggacgtccagcagaagacgaggctgactatcactgccactcacgcgacctcagtggtaggtgggtgttcggnggaggacagtgacgtcgtggtcagccaagctcgcccctcggtcactctgtccccg

SEQ ID NO: 162570 - DNA, 530 bp, Homo sapiens
  misc_feature: GYAE6OF02IT8XY.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctccggctacaatgcagggacaacagtcacgttgaccatcagtggagtccaggcagaagacgaggctgactatcactgccactcagcgacctcgagtggtaggtgggtcgttcgggcggagggaccaaggttcggaccgttaccgtagggtccacggacccgaacggccgtcggcccccgtcggtccacgttcccg

SEQ ID NO: 162571 - DNA, 505 bp, Homo sapiens
  misc_feature: GYAE6OF02HIG45.33.78.H01.1.454.CMB.1.raw
  modified_base (316)..(316): a, c, t, g, unknown or other
  misc_feature (316)..(316): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctnagggatccctgagcgattctccggctacaatgcagggacaacagtcacgttgaccatcagtggagtccaggcagaagacgaggctgactatcactgccactcagcggacctgagtggtaggtgggtgttcggcgggaggaccgaagttcgaccgtctaggtcagcccaggctcgcccctcggtcactcg

SEQ ID NO: 162572 - DNA, 537 bp, Homo sapiens
  misc_feature: GYAE6OF02JNOHP.33.78.H01.1.454.CMB.1.raw
  modified_base (336)..(336): a, c, t, g, unknown or other
  misc_feature (336)..(336): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagacggccctgagggactccctgacgcgattcnccggctaacaatcgacgaggacaacgagtcacgttgaccatcagtggatcaggcagaagagagctagactatacactcgccatcagcgacctcgaggtggtaggtagggtgttcgggacggagggaccgtaagttggaccgtcgtacggtcacggccgaacggtctaccggccccgtcggtccaccgtcgtaccgtccccg

SEQ ID NO: 162573 - DNA, 548 bp, Homo sapiens
  misc_feature: GYAE6OF02HV4H0.33.78.H01.1.454.CMB.1.raw
  modified_base (310)..(310): a, c, t, g, unknown or other
  misc_feature (310)..(310): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagagccctnagggatccctgagcgattctccggctacaatgcagggacaacagtcacgttgaccatcagtggagtccaggcagaagacgaggctggactatcaactgcccactcgagccggactcgaggtggtagggtgggtgttcggcgggaggacctaggttcgacccgttcgtaggtccacggtcccgaaggtcccgtccggcccccgtcgggttccaccgttccgttccgttccccgtccccg

SEQ ID NO: 162574 - DNA, 522 bp, Homo sapiens
  misc_feature: GYAE6OF02IJDHP.33.78.H01.1.454.CMB.1.raw
  modified_base (303)..(303): a, c, t, g, unknown or other
  misc_feature (303)..(303): n is a, c, g, or t
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaaagcaaatacgcttattggtaccagcagaagccagcaggcccctgtactgataatatacaaaganaatgagaggccctcagggatcccctgagcgattctccggactacaatgcacgggacaacagtcacgttagaccatcagtgagtcagcagaagagagntagatatnactgcactcagcgacctcgagtggtaggtgggtgttcgggacggagggaccgaaggttcgaccgttccgtaggtccgagcccgaaggctacgcccccgtcggtccagttccccg

SEQ ID NO: 162575 - DNA, 518 bp, Homo sapiens
  misc_feature: GYAE6OF02I25T4.33.78.H01.1.454.CMB.1.raw
  modified_base (222)..(222): a, c, t, g, unknown or other
  misc_feature (222)..(222): n is a, c, g, or t
  modified_base (335)..(335): a, c, t, g, unknown or other
  misc_feature (335)..(335): n is a, c, g, or t
  modified_base (503)..(503): a, c, t, g, unknown or other
  misc_feature (503)..(503): n is a, c, g, or t
  modified_base (514)..(514): a, c, t, g, unknown or other
  misc_feature (514)..(514): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggagtcacctgctctggagntgcattgccaaagcaatacgcttattggtaccagcagaagccaggccaggccccctgtactgataatatacaaagagaatgagaggccctcgagggatccctgacgcgattcnccggctacaatgcagggacaacgagtcacgttgaccatcagtggacgtccaggcaggaagacgaggctgactatcactcgaccactcacgccgacctcgagtggtaggtgggtgttcggcggaggacgagttcgacgtcgtaggtcacgccaagctcgccctcggtcnctctcgtcccncccg

SEQ ID NO: 162576 - DNA, 515 bp, Homo sapiens
  misc_feature: GYAE6OF02GPRBF.33.78.H01.1.454.CMB.1.raw
  modified_base (429)..(429): a, c, t, g, unknown or other
  misc_feature (429)..(429): n is a, c, g, or t
  modified_base (507)..(507): a, c, t, g, unknown or other
  misc_feature (507)..(507): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatcccctgagcgattctccggctacaatgcagggacaacagtcacgttgaccatcagtggagtccaggcagaagacgaggctgactatcactgccactcagcggacctnagtggtaggtgggtgttcgggcggagggaccaaggttgaccgtccgtaggtcagcccgaaggctcgcccctcggtccncgtttccg

SEQ ID NO: 162577 - DNA, 549 bp, Homo sapiens
  misc_feature: GYAE6OF02IOZO3.33.78.H01.1.454.CMB.1.raw
  modified_base (377)..(377): a, c, t, g, unknown or other
  misc_feature (377)..(377): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
tcagtacacacactcacgaccggtgctcgatttagtgtgagtagtttgggtttgggggctgtgggtccaggaggcagaactctgggtgtctcaccatggcctggatccctctacttctcccctcctcactctctgcacaggctctgcggcctcctacgagctgacacagccaccgtcggtttctgtgtcacgtgggacagacggccaggatcacctgctctggagatgcattgaccaaagcaatacgcttatggtaccagcagaagccaggccacggccctgtactgataatataacaaagagaatgagaggccctacgagggactcccgtagagcgattccaccggctaacaatgcgaggacaacgagtcacgttnaccatcgagtggagtccaggcaagaagacgagcngactancactgaccacgtcacgccggtacctacgaggttcgggtaggtcgggtgttacgggcggacgggacctaaggttcggaccgttcgtaacggcgacgacccgaacggtcctaccgccccgtaggtcacgttccg

SEQ ID NO: 162578 - DNA, 516 bp, Homo sapiens
  misc_feature: GYAE6OF02INNG6.33.78.H01.1.454.CMB.1.raw
  modified_base (408)..(408): a, c, t, g, unknown or other
  misc_feature (408)..(408): n is a, c, g, or t
tcagtacacacactcacgaccggtgctcgatttagtgtgagtagtttgggtttgggggctgtgggtccaggaggcagaactctgggtgtctcaccatggcctggatccctctacttctcccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctccggctacaatgcaggacaacagtcacgttgaccatcagtaggagtcgaggcagaagacgaggctgactancactgccactcagccggacctcgaggtggtaggtgggtcgttcgggcggaggacaagttcggaccgtccgtaggtcagacccgagccgtcgccccgtcgtccactccg

SEQ ID NO: 162579 - DNA, 522 bp, Homo sapiens
  misc_feature: GYAE6OF02GXPVC.33.78.H01.1.454.CMB.1.raw
  modified_base (335)..(335): a, c, t, g, unknown or other
  misc_feature (335)..(335): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaaagcaatacgcttattggtaccagcagaagccaggccaggcccctgtactgataatatacaaagagaatgagaggccctgagggatccctgagcgattcnccggctaacaatgcaggacaacagtcacgttgaccatcagtggagtccaggcagaagacgaggctagactatcatcgaccactcagcgacctcgaggtggtaggtgggtgtcgggcggaggacagttcgaccgtcgtaggtcacgcccgaaggcctcgcccccgtcggtccacgttcctcgttcccc

SEQ ID NO: 162580 - DNA, 500 bp, Homo sapiens
  misc_feature: GYAE6OF02FHINO.33.78.H01.1.454.CMB.1.raw
  modified_base (399)..(399): a, c, t, g, unknown or other
  misc_feature (399)..(399): n is a, c, g, or t
  modified_base (425)..(425): a, c, t, g, unknown or other
  misc_feature (425)..(425): n is a, c, g, or t
tcagtacacacactcacgaccggtgctcgatttagtgtgagtagtttgggtttgggggctgtgggtccaggaggcagaactctgggtgtctcaccatggcctggatccctctacttctcccctctcactctctgcacaggctctgcggcctcctacgagctgacacagccaccgtcggtttctgtgtcactgggacagacggccaggatcacctgctctggagatgcattgccaaagcaatacgcttatggtaccagcagaagccaggccaggccccctgtactgataatatacaaagagaatgagaggccctcagggatcccctgagcgattctccggctacaatgcagggacaacagtcacgttgaccatcagtggatccaggcagaagacgaggcngactatcactgccactcagcgacctnagtggtaggtgggtgttcggcggaggaccagttgaccgtcctaggtcagcccaaggcctcgcccctcgtcactcg

SEQ ID NO: 162581 - DNA, 521 bp, Homo sapiens
  misc_feature: GYAE6OF02H7MPB.33.78.H01.1.454.CMB.1.raw
  modified_base (310)..(310): a, c, t, g, unknown or other
  misc_feature (310)..(310): n is a, c, g, or t
tcagtacacacactcacgaccggtgctcgatttagtgtgagtagtttgggtttggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggcaggcccctgtactgataatatacaaaagagaatgagaggccctnagggatccctgagcgatctcggctacaatgcagggacaacagtcacttgaccatcagtgagtcaggcagaagagaggctgactatcactgccactcagcggacctcaggtgtaggtggggtgttcgggcggagggaccaagttgaccgttcctagggtcacggcccaacggtctcggccccctggtccaccgtccttcgttccctaccccg

SEQ ID NO: 162582 - DNA, 509 bp, Homo sapiens
  misc_feature: GYAE6OF02GML5P.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcgagggatccctgagcgattctccggctacaatgcagggacaacagtcacgttgaccatcagtggagtccaggcagaagacgaggctgactatcactgccactcagcggacctcagtggtaggtggtgttcggcggagggaccaaggttcgaccgtccgtaggtcagcccaaggctcgccccctcggtcatccg

SEQ ID NO: 162583 - DNA, 538 bp, Homo sapiens
  misc_feature: GYAE6OF02JA214.33.78.H01.1.454.CMB.1.raw
  modified_base (299)..(299): a, c, t, g, unknown or other
  misc_feature (299)..(299): n is a, c, g, or t
  modified_base (406)..(406): a, c, t, g, unknown or other
  misc_feature (406)..(406): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaaganaatgagaggccctcgagggatcccgtgacgcgattctccggctacaatgacagggacaacgagtcacgttgaccatcagtgagtccaggcagagacgagctgactancactgaccactcagcgacctcagtggtaggtgggtgttcgggcggagggaccgtaagtcgtaccgtccgtaggtaccacgaccgtaacggcctccgcccccgtcggtcctaccgttccgtccgttacccccg

SEQ ID NO: 162584 - DNA, 514 bp, Homo sapiens
  misc_feature: GYAE6OF02HUA7I.33.78.H01.1.454.CMB.1.raw
tcagtacacacactcacgaccggtgctcgatttagtgtgagtagtttgggtttggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctccggctacaatgcagggacaacagtcacgttgaccatcagtggagtccaggcagaagacgaggctgactatcactgccactcagcgactcagtggtaggtggtgttcggcggaggaccgaagttgaccgtcgtaggtcacgccaaggccgtcgccccgtcggtccaccgtctcgtcccgtcccc

SEQ ID NO: 162585 - DNA, 522 bp, Homo sapiens
  misc_feature: GYAE6OF02IGLF1.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctcccctcctcactctctgcacaggctctgcggcctcctacgagctgacacagccaccgtcggtttctgtgtcactgggacagacggccaggatcacctgctctggagatgcattgccaaaagcaatacgcttattggtaccagcagaagccaggccaggccccctgtactgataaatatacaaaagagaatgagaggccctcagggatccctgagcgattctccggctacaatgcagggacaacagtcacgttgaccatcagtggagtccaggcaagaagacgaggctagactatcactgccactcagcggactcgagtggaggtgggtgttcgggcggaggaccgaagttcgaccgttcgtaggtcgacgccgaacggctcgcccctggtccactctccgtccctaccc

SEQ ID NO: 162586 - DNA, 521 bp, Homo sapiens
  misc_feature: GYAE6OF02JBITN.33.78.H01.1.454.CMB.1.raw
  modified_base (332)..(332): a, c, t, g, unknown or other
  misc_feature (332)..(332): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggcctcagggatccctgagcgattcncggctacaatgacaggacaacagtcacgttgaccatcagtggacgtccgaggcagaagacgaggctgactatcacgtgccactcagcgacctcgagtggtagggtgggtcgttcgggcggagggacaggttcgaccgtcgtacggcacgcccgaagccgtcgccccgtcgtccacgtcctcgttccccg

SEQ ID NO: 162587 - DNA, 519 bp, Homo sapiens
  misc_feature: GYAE6OF02FPRU6.33.78.H01.1.454.CMB.1.raw
  modified_base (401)..(401): a, c, t, g, unknown or other
  misc_feature (401)..(401): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctgagggatccctgagcgattctccggctacaatgcagggacaacagtcacgttgaccatcagtggagtcaggcagaagacgaggctgactancactgccactcagcggacctcgaggtgggtaggttgggtgttcgggcggacgggacaaggttcgaccgtcgtaggtcagcccgaaggctcgcccctcggtccactctcgtcccgtccc

SEQ ID NO: 162588 - DNA, 515 bp, Homo sapiens
  misc_feature: GYAE6OF02H6YUS.33.78.H01.1.454.CMB.1.raw
  modified_base (404)..(404): a, c, t, g, unknown or other
  misc_feature (404)..(404): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaaagcaatacgcttattggtaccagcagaagccaggccaggcccctgtactgataatatacaaagagaatgagagccctcagggatccctgagcgattctccggctacaatgcagggacaacagtcacgttgaccatcagtgagtccaggcagaagacgaggctgactancactgccactcagcgacctcagtggtaggtgggtgttcggcggagggaccaagttgaccgtcgtaggtcagccgaaggctcgcccctcggtcacgttcgtcgttacccccg

SEQ ID NO: 162589 - DNA, 515 bp, Homo sapiens
  misc_feature: GYAE6OF02FOAM1.33.78.H01.1.454.CMB.1.raw
  modified_base (447)..(447): a, c, t, g, unknown or other
  misc_feature (447)..(447): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctccggctacaatgcagggacaacagtcacgttgaccatcagtggagtccaggcagaagacgaggctgactatcactgccactcagcgacctcagtggtagggtgggtgttcgggnggaggaccgagtgaccggtccgtaggtcaggcccaaggcctcgccccgtcggtcactcgtcgttcccc

SEQ ID NO: 162590 - DNA, 541 bp, Homo sapiens
  misc_feature: GYAE6OF02H228E.33.78.H01.1.454.CMB.1.raw
tcagtacacacactcacgaccggtgctcgatttagtgtgagtagtttgggtttgggggaaaacctcattcctcctctaaagaagcccctgggagcacagcgcatcaccatggactggacctggaggttcctctttgtggtggcagcagctacaggtgtccagtcccagttccaactggtacaatctgggtctgaggtgaagaggcctgggtcctcggtgagggtctcctgcagtgtctctgggagcgccttcagcacctatgccatcacctgggtgcgacaggcccccggacaagggcttgagtggatgggggggtatcgatccctctcttcggcacatacagtacgccacaaatttcaagacagagtgcaagttttcgcgaacgaatacaacgaccacagtccacatggagttgaggagcctgacatctgaagacacggccgtatattactgtgcgagagatcaaaatgtagcgacaaaggtggttaacgggtttgacgttccgtcgggccgacgggacccgtggtcagtccgtctcccg

SEQ ID NO: 162591 - DNA, 524 bp, Homo sapiens
  misc_feature: GYAE6OF02FV8XW.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggccccctgtactgataatatacaaagagaatgagaggccctcagggatccctgagcgattctccggctacaatgcagggacaacagtcacgttgaccatcagtggagtccaggcagaagacgaggctgactatcactgccactcagcgacctcgagtggtaggtgggtgttcgggcgggagggaccgaaggttcggaccgtcgtacgggtcacgcccaagggctccggcccccgtcggtccacgtcccg

SEQ ID NO: 162592 - DNA, 558 bp, Homo sapiens
  misc_feature: GYAE6OF02JNUL4.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctcccctctcactctctgcacaggctctgcggcctcctacgagctgacacagccaccgtcggtttctgtgtcactgggacagacggccaggatcacctgctctggagatgcattcgaccaaagcaatacgcttattggtaccagcagaagccaggccaggcccctgtactgataatataacaaagagaatgagacgcctagagggactcccgtgacgcgtattcgtaccggactaacaatcgacgaagggacaacagtcacgttgacctatcagtggacgtccaggacagagacgagctagactatcactgaccaactcgagcgacctacgagtggtagggtggtcgttcggacggtaacggacgaaggttcgaccgtccgtaggtcgacgtacccgaaggtccgtaccggtccccgtggtcctacgttcgtacccgttaccccg

SEQ ID NO: 162593 - DNA, 815 bp, Homo sapiens
  misc_feature: GYAE6OF02JCCGY.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctcccctcctcactctctgcacaggctctgcggcctcctacgagctgacacagccaccgtcggtttctgtgtcactgggacagacggccaggatcacctgctctgggagatgctattgaccaaagcaatacgcttatggtaccagcagaagccaggccaggcccctgtactgaataatatacaaagagaatggagacgccctacgaagggactcccgtaggacgcgtattccgccggtactaacaagtcggacgaagggaaccaaacgacgttacaacggttacgaaccgtaatccgaaggttgggactaccgagggacaaggaaacgaccggaggtaccgtacggaaaccttaacgtacgtaaccgttcggtaacccctaaccgttaccgaaaccgggtaccgggtaaccccttacccggaaggggttttaacgggggttaaccgggggttttcggggggttaaccggggttttacccggggggaacgggggtaaaaccggggggttaacccgttaaacgggggtttacccgggtaaacccccggggttttaacccgggttaacgggggtttaaccccgaaacgggttaaccccccggtaaaccggggttacccggttcccccgggttaccccccccggttacggggtttacccccgttaacccgtttccccgggtttaccccggtttaacccccccccgg

SEQ ID NO: 162594 - DNA, 557 bp, Homo sapiens
  misc_feature: GYAE6OF02HYUZA.33.78.H01.1.454.CMB.1.raw
tcagtacacacactcacgaccggtgctcgatttagtgtgagtagtttgggtttgggggaaaacctcattcctcctctaaagaagcccctgggagcacagcgcatcaccatggactggacctggaggttcctctttgtggtggcagcagctacaggtgtccagtcccagttccaactggtacaatctgggtctgaggtgaagaggcctgggtcctcggtgagggtctcctgcagtgtctctgggagcgccttcagcacctatgccatcacctgggtgcgacaggcccccggacaagggcttggagtggagtggggggtatcgatccctctcttcggcacaatacagtacgccacaaatttcaagacagagtgctaagtttcgacgaacgaatacaacgaccacacgtcccaacataggagttgaggagacctgacatctagaagacacggaccgtatattactgtgcgagagatacaaatgtagcgacgaagtgggttacggtttcgacgttccggtgggtaccgagggtacccgtcggtaccgtatccgtctacccg

SEQ ID NO: 162595 - DNA, 535 bp, Homo sapiens
  misc_feature: GYAE6OF02HC0RP.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctcttgagatgcattgccaaagcaatacgcttattggtaccagcagaagccaggccaggcccctgtactgataatatacaaagagaatgagaggccctgagggatccctgagcgattctccggactacaatgcagggacaacagtcacgttgaccatcagtggagtccaggcagaagacgaggctgactatcactcgaccactcacggccgacctcgagtgggtagggtgggtggttcgggcgggagggtaccaaggttcgacccggtccgtaggtccacgacccgaacggcctccgccccctcggtccacgttcccg

SEQ ID NO: 162596 - DNA, 539 bp, Homo sapiens
  misc_feature: GYAE6OF02ITNUX.33.78.H01.1.454.CMB.1.raw
  modified_base (426)..(426): a, c, t, g, unknown or other
  misc_feature (426)..(426): n is a, c, g, or t
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgcggcctcctacgagctgacacagccaccgtcggtttctgtgtcactgggacagacggccaggatcacctgctctggagatgcattgaccaaaagcaaatacgcttaattggtaaccagcagaagccaggccaggcccctgtactgataatataacaaagagaatgaagagccctcgagggactccctgagcgattcctccggactacaatcgacgagggacaacgagtacaacgttgaacctagtacagtggacgtccaaggcaagaagacgagctagactancactcgaccactcagcgacctgagtggtaggtggtgtgggacggaggacaagttcgaccgtacgtaggcacgccgaaggcctcgcccgtcggtccacgtcgtcgtccccgtcc

SEQ ID NO: 162597 - DNA, 881 bp, Homo sapiens
  misc_feature: GYAE6OF02HER6O.33.78.H01.1.454.CMB.1.raw
tcagtacacacactcacgaccggtgctcgatttagtgtgagtagtttgggtttggggggggttccgaggaggcagaacgtctcgggtgtcctcgacctatggcctggtatcccttcgtacttctccccctcctcactctctgcacaggcctctggcggtccgtcctacgacgcgtgttaccacgaggccctaccggtttacggtttctcgtgtcacgtggggtacagacggtccgaggtactcggaccgtgtcgttcctgggacgtaggtcggcctagttcggaccctaaaagtcctaaagttaccggtcgtttaactttcgggtaacccgaagtacctaacggttaacggaccccgaacgggtacccctaacggggtccccccctttagggttaaccccgttacgggtaaccttaaaacgttaacgttaaacccgaaaaacggggaacggaaagtttacgggaacgggtaacggggtcccccgttacgggaacgggggtaccttaccccgtagggacggtccggtaacgttttccggtcccgggtactaacgaacgttcggaccgtaagggtaacccaaaacgtacgttaccgtaccggtttacggaacccgtacttacgtacggtcggacgttacccaagggaccaaggaacgacgtacgactacgactactacacgtcacccataccgacgtaccgaacctcgaggttcgggtacgggtcgggttacggttaccgggacgggttaacggtaaccgttaaggtttcggaccgggttaccgttaaggggaccggtaacggacccgtaaagggttccgtaccggttacccccggttacggttaccctacccggtttccttacccggttaccccctacccgg

SEQ ID NO: 162598 - DNA, 533 bp, Homo sapiens
  misc_feature: GYAE6OF02HPAE7.33.78.H01.1.454.CMB.1.raw
  modified_base (318)..(318): a, c, t, g, unknown or other
  misc_feature (318)..(318): n is a, c, g, or t
tcagtacacacactcacgaccggtgctcgatttagtgtgagtagtttgggtttgggggctgtgggtccaggaggcagaactctgggtgtctcaccatggcctggatccctctacttctcccccctcctcactctctgcacaggctctgcggcctcctacgagctgacacagccaccgtcggtttctgtgtcactgggacagacggccaggatcacctgctctggagatgcattgccaaaagcaatacgcttattggtaccagcagaagccaggccaggcccctgtactgataatatacaaagagaatgagaggccctnagggatccctgagcgattctccggctacaatgcagggacaacagtcacgttgaccatcagtggagtccaggcagaagacgaggctagactatcactgccactcgacgcgacctcaggtaggttaggtgggtgtcgggcgggagggaccgaaggttcgaccggtccgtacggtccgacggacccgaggtcctcggcccccgtcggtccacttcccg

SEQ ID NO: 162599 - DNA, 541 bp, Homo sapiens
  misc_feature: GYAE6OF02FW7UV.33.78.H01.1.454.CMB.1.raw
  modified_base (337)..(337): a, c, t, g, unknown or other
  misc_feature (337)..(337): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcgagggatccctgagcgattcnccggctacaatgcagggacaacagtcacgttgaccatcagtggagtccaggcagaagacgagctgactatcactgccactcagcgacctcgaggtggtagggtggtggttcgggcgggacgggaccgtaaggttcggacccggtccgtaacggtccgaaggccccgaaggccgtccggcccccgtcggtccctaccgttcccgg

SEQ ID NO: 162600 - DNA, 565 bp, Homo sapiens
  misc_feature: GYAE6OF02H1MXZ.33.78.H01.1.454.CMB.1.raw
  modified_base (312)..(312): a, c, t, g, unknown or other
  misc_feature (312)..(312): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (367)..(367): a, c, t, g, unknown or other
  misc_feature (367)..(367): n is a, c, g, or t
  modified_base (399)..(399): a, c, t, g, unknown or other
  misc_feature (399)..(399): n is a, c, g, or t
  modified_base (543)..(543): a, c, t, g, unknown or other
  misc_feature (543)..(543): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccagccaggcccctgtactgataatatacaagagaatgagaggccctanagggatccctgagcgattcnccggntacaatgcaggacaacagtcacgttgactntcagtgatccgagcagagacgaggctgactancactcgccactcacgcgacctagagtcggttaggtcggggttgttccgggcgggtacggggaccgtaagggttcgtacccggtacccgttagggtacccagggtaaccccgaggtacccgtcggtacccccccgtggtaacccnccttccgtaccggttacccccc

SEQ ID NO: 162601 - DNA, 519 bp, Homo sapiens
  misc_feature: GYAE6OF02F2WOR.33.78.H01.1.454.CMB.1.raw
  modified_base (405)..(405): a, c, t, g, unknown or other
  misc_feature (405)..(405): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctccggctacaatgcagggacaacagtcacgttgaccatcagtggagtcaggcagaagacgagctgactancactgccactcagccgacctcgagtggtaggtgggtgttcgggcgggagggaccaaggttcgaccgtcgtaggtcacgcccgaaggccgtccgccccgtcggtccaccgttccg

SEQ ID NO: 162602 - DNA, 563 bp, Homo sapiens
  misc_feature: GYAE6OF02HK842.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctgagggactccctgagcgtattctccggactacaattgaccgaagggaacaacgagtacgacgttacgaaccatcgagtggagtccgagggcaaggaagacgaggctagactatcactgcccactcaagccggacctcgaggtgggtaggtgggttcgttcgggcggacgggaccaggttcgaccggttcgtaggtccacggcccaacgggcctccggcccccgtcggtcctaccgttccgtcgttcccccg

SEQ ID NO: 162603 - DNA, 669 bp, Homo sapiens
  misc_feature: GYAE6OF02J063W.33.78.H01.1.454.CMB.1.raw
tcagtacacacactcacgaccggtgctcgatttagtgtgagtagtttgggtttggggggtccaggaggcagaactctgggtgtctcaccatggcctggatccctctacttctcccctcctcactctctgcacaggctctgcggcctcctacgagctgacacagccaccgtcggtttctgtgtcactgggacagacggccaggatcacctgctctggagatgcattgaccaaagcaatacgcttattggaccagcagaagccaggccacggcccctgtactgaataatataacaaagagaatgagacggccctacgaagggactcccgtgagcgtattccgtccggactacgaatcgacgaacgggaacaacgacgtcaacgttcgaacctagtacgagtgggaacgtccgaaggaccaaggaaacggacggacggtacctaggtaaccttagtacctaacgtcgaccctacgtacgaacggtccggaacctcggtaacgggttagggttacggggttgggttcggttacggggacggggtaacgggaaccgtaggttaccggacccgttccggttaacggtaccgaccggacccgaacgggtcccgtacccggtcccccgttaccgggtaccttacccgttcccgttcccgttacccccgttaaccccg

SEQ ID NO: 162604 - DNA, 513 bp, Homo sapiens
  misc_feature: GYAE6OF02I0MRD.33.78.H01.1.454.CMB.1.raw
  modified_base (446)..(446): a, c, t, g, unknown or other
  misc_feature (446)..(446): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttatggtaccagcagaagccaggccaggcccctgtactgataatatacaaagagaatgagaggccctcagggatccctgagcgattctccggctacaatgcagggacaacagtcacgttgaccatcagtggagtccaggcaagaagacgaggctagactatcactgccactcagcggacctcgagtggtaggtggtgttcgggnggaggaccgaagtcgacgtcgtaggtcagccaagctcgcccctcggtccactctcgtccctaccccg

SEQ ID NO: 162605 - DNA, 583 bp, Homo sapiens
  misc_feature: GYAE6OF02JKQHU.33.78.H01.1.454.CMB.1.raw
tcagtacacacactcacgaccggtgctcgatttagtgtgagtagtttgggtttgggggggttccgaggaggcagaactctgggtgtctcaccatggcctggatccctctacttctcccctcctcactctctgcacaggctctgcggcctcctacgagctgacacagccaccgtcggtttctgtgtcactgggacagacggccaggatcactgctctggagatgcattgccaaagcaatacgcttattggtaccagcagaagccaggccaggcccctgtactgataatataacaaagagaatgagacggccctgagggactccctgacgcggattctccggctacaatgccagggacaacgagtcacgttgaccatcagtgacgtccaggcaagaagacgaggctagactatacgactcgaccactcgaacgcgaacctcgagttggtagggttgggttggttccgggcgggacgggaaccgaggttacggaccgttaccgtacgggtccaacggacccgaagggtcctacccggtcccccgttccgggtacctaccggttccgttaccgttcccccgtccccg

SEQ ID NO: 162606 - DNA, 557 bp, Homo sapiens
  misc_feature: GYAE6OF02G6FQL.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaaagcaatacgcttattggtaccagcagaagccaggccaggcccctgtactgataatatacaaagagaatgagaggccctcgagggactccctgagcgattctccggctacaatgcagggacaacagtcacgttgaccatcagtggagtccaggcaagaagacgaggctgactatcactgccactcagcgacctcgagtggtaggtgggttgttcgggcggacgggaccgtaaggttcgacccggtaccgtaggtccaacggaccccgtaacggccttacccggcccccgttcggtacctaccgttcccgtccgttaccccccg

SEQ ID NO: 162607 - DNA, 497 bp, Homo sapiens
  misc_feature: GYAE6OF02FGU2R.33.78.H01.1.454.CMB.1.raw
  modified_base (318)..(318): a, c, t, g, unknown or other
  misc_feature (318)..(318): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaaagcaatacgcttattggtaccagcagaagccaggccaggcccctgtactgataatatacaaagagaatgaagaggccctnagggatccctgagcgattctccggctacaatgcagggacaacagtcacgttgaccatcagtggagtcaggcagaagacgaggctgactatcactgccactcagcgacctcagtggtaggtggtgttcggcggagggcagtggacgtcaggtcagccgaggctgcccctcggtcactccg

SEQ ID NO: 162608 - DNA, 598 bp, Homo sapiens
  misc_feature: GYAE6OF02G0VTG.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggaccagcagaagccaggccaggcccctgtactgataatataacaaagagaatgaagaggccctcgagggactccctgacgcgagttctccggctaacaagtcgacgagggacaacgagtcacgttgaccatcagtggactcaggcaagacgacgaggctgactatcactcgcccactcacggccgacctcgtacggtagggtacgggtggggtacggttcgggacgggagggtaaccgtaagggtttccggacccggttccgtaacgggtccgaaccggacccggaacggtcccgtcccggcccccgttcggtacccgtaccgtcccgtttacccgtccccctacccccg

SEQ ID NO: 162609 - DNA, 537 bp, Homo sapiens
  misc_feature: GYAE6OF02IQ07A.33.78.H01.1.454.CMB.1.raw
  modified_base (225)..(225): a, c, t, g, unknown or other
  misc_feature (225)..(225): n is a, c, g, or t
  modified_base (473)..(473): a, c, t, g, unknown or other
  misc_feature (473)..(473): n is a, c, g, or t
  modified_base (532)..(532): a, c, t, g, unknown or other
  misc_feature (532)..(532): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctgganatgcattgccaaagcaatacgcttattggtaccagcagaagccaggccaggcccctgtactgataatatacaaagagaatgagaggccctagagggactccctgagcgattcctccggctacaatgacgagggacaacgagtcacgttcgacctatacgagtaggacgtccgaggcaagaacgacgaggctagactatcactcgaccactcgacgaccgacctcgaggtggttagggtgggtgtcggngggacggacaaggttcgaccgttcgtaggtcacgaccgaggctcgccccgtcggtaccnctccg

SEQ ID NO: 162610 - DNA, 519 bp, Homo sapiens
  misc_feature: GYAE6OF02F74DM.33.78.H01.1.454.CMB.1.raw
tcagtacacacactcacgaccggtgctcgatttagtgtgagtagtttgggtttggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggccccctgtactgataatatacaaagagaatgagaggccctcagggatccctgagcgattctccggctacaatgcagggacaacagtcacgttgaccatcagtggagtccaggcagaagacgaggctgactatcactgccactcagccggacctcgagtggtaggtgggtgttcgggcggaggaccagttgaccgtcgtaggtcacgcccaaggcctcgcccccgtcggtccactcctcgtccctacccc

SEQ ID NO: 162611 - DNA, 804 bp, Homo sapiens
  misc_feature: GYAE6OF02IV84L.33.78.H01.1.454.CMB.1.raw
  modified_base (549)..(549): a, c, t, g, unknown or other
  misc_feature (549)..(549): n is a, c, g, or t
tcagtacacacactcacgaccggtgctcgatttagtgtgagtagtttgggtttgggggctgtgggtccaggaggcagaactctgggtgtctcaccatggcctggatccctctacttctcccccctcctcactctctgcacaggctctgcggcctcctacgagctgacacagccaccgtcggtttctgtgtcactgggacagacgtcacggagtctacctcgctcctggagatgcgacttagtaccgaaacgaacgaactaaccgtaccgtttatttacggttaaccgacgacgacgaaacggaaccaccggacccgaccggacccccgttcgttaacgttacgtaacgtaaattaaacgttaacgaaaaacggaaaaggtaagttaaggaacggaacggtaaccccgtcccggtaaggggaacgttaccccgttcggaagacggtaacgtttcctcccggggtacctaacgtaacgtcgcgaacggggaacaacagtcgtaccgtacgtaacctacgtacgaggtacggtaacggtccgaggccgaaanaacgggtaacggaccgagttcgaaactacttaccgcgttaccgacccgaccgtacgaaccgggtacccggtacccgtaacgttagggttacggggtttaacggggtttcgggggtaacggttttcgggacccgggggaaacgggggttaccctaaaaggttttcccgggaacccttaccgggtttaaccggtacggaacgtaaccccgacggggtccttccccggtcccccggtacccgggttataccccctcgg

SEQ ID NO: 162612 - DNA, 641 bp, Homo sapiens
  misc_feature: GYAE6OF02HU8L3.33.78.H01.1.454.CMB.1.raw
  modified_base (204)..(204): a, c, t, g, unknown or other
  misc_feature (204)..(204): n is a, c, g, or t
  modified_base (258)..(258): a, c, t, g, unknown or other
  misc_feature (258)..(258): n is a, c, g, or t
  modified_base (314)..(314): a, c, t, g, unknown or other
  misc_feature (314)..(314): n is a, c, g, or t
tcagtacacacactcacgaccggtgctcgatttagtgtgagtagtttgggtttggggtcgtgtgggtccgaggaggcgagaactcgtgggtgtctcaccatggcctggatccctctacttctccccctcctcactctctgcacaggctctgccggcctcctacgagctgacacagccaccgtcggtttctgtgtcacgtggganagacggccaggtactcacctgctcgtggagatgcattgaccaaagcaattacgnttattgtacagcagaagcaggaccacggcccctgtactgaataatataacaaaganatagagacggcctgagggtactccgtgaacgcgacttcgccggactaactaatgacgacgggaacaaacgagtaccgtacgtagaaccataccgaagttggaacgtaccagggacaaaggaaagacggaggactagaacgttacgtacacgtacgacctacgtacgacggaccggaccctacgacgggttaggttacgggtggggttacggtacgggtacggggacgggtaccgtaaggtttacggaaccggttaccgtagggtaccgaaccgacccggtaacggtcccgtaccggtacccccggtcggtccccgacgtttccccgg

SEQ ID NO: 162613 - DNA, 654 bp, Homo sapiens
  misc_feature: GYAE6OF02H5L1L.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagcccaccgtcggttttctgtgtcactgggacagacggccaggatcacctgctctggagatgcattgaccaaaagcaatacgcttattggtaccagcagaagccaggccaggcccctgtactgataatatacaaaagagaaatgaagaggccctacgaaggggactcccgtagacgcggaatttccgtccggactaaccaagtgacgaaggggaacaaacgagtcctaacgttcgacccatccgaaggtgggaacgtccgaagggcaaggaaagaccggaggctacgactaataccacttcgaccaactcacggaccggacccttacgaggttgggtagggttcggggttacggtttaccgggcggggtaacgggacccgtaaaggttccggaacccgttcccggttaagggtccgaacggaccccgaaggtccctaccggccccccgttcgggtacctaccgttccgttcccgttaccccctaccccccg

SEQ ID NO: 162614 - DNA, 607 bp, Homo sapiens
  misc_feature: GYAE6OF02HZ1AP.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaaagcaatacgcttattggtaccagcaagaagccaggccaggcccctgtactgataatatacaaagagaatgagaggccctcgagggactccgtgagcgtattcgtccggctacaatcgacgaacgggacaaacgagtcacgttacgactaatcgagtggacgtaccgaggcaaggaaggacgaggcgtagactagtaccacgtcgacccactcgacggccggacctacgagggttagggtagggtgggttggttccgggacgggaacgggtaccgtaaggtttacggaccggttaccggtacggttacacggtacccgtaaggccgtaccggcccccgtggtacccgtaccgttccgttaccgttacccccg

SEQ ID NO: 162615 - DNA, 529 bp, Homo sapiens
  misc_feature: GYAE6OF02FY0TD.33.78.H01.1.454.CMB.1.raw
tcagtacacacactcacgaccggtgctcgatttagtgtgagtagtttgggtttgggggaaaacctcattcctcctctaaagaagcccctgggagcacagcgcatcaccatggactggacctggaggttcctctttgtggtggcagcagctacaggtgtccagtcccagttccaactggtacaatctgggtctgaggtgaagaggcctgggtcctcggtgagggtctcctgcagtgtctctgggagcgccttcagcacctatgccatcacctgggtgcgacaggcccccggacaagggcttgagtggatgggggggtatcatccctctcttcggcacaatacagtacgcccacaaatttcaagacagagtgcaagttttcgcgaacgaatcaacgaccacagtccacatggagttgaggagcctgacatctgaagacacggccgtatattactgtgcgagagatcaaaatgtaggcgcaaagtggttaacgggttgactccgtgggccagggaccctggcatcgtctccg

SEQ ID NO: 162616 - DNA, 627 bp, Homo sapiens
  misc_feature: GYAE6OF02JV6V1.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcacgtgggacagacggccaggatcacctgctctggagatgcattgaccaaagcaatacgcttatgtaccagcagaagccaaggccaggcccctgtactgataactataacaaagacgaatagacgacggtccctagacgggactcccgtaggacgaccgtaatttccgtacccggactaacgtaagtcgaccggtaagggaaaccaacgagtaccgtacggttacgaacccatacgaggtaggacgtacccgaaggcaaggaacgacggaggtacgtgaactagtaccacgtcgacccaacgtacacggccgtaacctcgaaggtcgggtaggtcgggttagttcgggacgacgggacctaaggttcgaccgtcggtaagaccgacggaccgaaggtccgtaccggtcccgtacggttaccaccgttccgtccgtaccccg

SEQ ID NO: 162617 - DNA, 620 bp, Homo sapiens
  misc_feature: GYAE6OF02GZP0A.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagacgcctagagggatccctgagcgattccgtccggctaacaagtgacgagggaacaacgagtacacgttcgaccatcgagtggagtccgaggcaagaagacgagctgactatcacgtcgacctactcacggaccggacctacgacggttagggttacggggttggggttacgggtttccggggacggggtaacgggaacccgtaagggttccggtacccgggttaccgtacgggtcctaacgggaccccgtaacgggtccttcccggaccccccgttacggtaccctaccgttcccgttccggttacccccgtccccg

SEQ ID NO: 162618 - DNA, 529 bp, Homo sapiens
  misc_feature: GYAE6OF02GK0OB.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctgagggactccctgagcgattctccggctacaatgacagggacaacagtcacgttgaccatcagtggagtcaggcagaagacgaggctgactatcactgccactcagcgacctcgagtggtagggtggttgttcgggcggagggaccaaggttcgaccggttccgtaggtcacggcccgaaggcctcggcccccgtggtccacttccgtcgttccccc

SEQ ID NO: 162619 - DNA, 579 bp, Homo sapiens
  misc_feature: GYAE6OF02IQ7LQ.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttattggtaccagcagaagccaggccaggcccctgtactgataatatacaaagagaatgagacggccctcgagggactcccgtgagcgattcgtccggactaacaatgcgaagggacaacgagtcacgttcgaccatcgagtggacgtccgaggacaggaagacgacggcgtagactagtcacgttgacccactcgacgccggacctacgaggtgggtagggtgggttggtcgggcggtacgggaccgtaaggtcgtaccggtccgtaaggtccaggacccgaaggtccctaccgtcccccgtcggtccctaccgttccgtaccgttacccccc

SEQ ID NO: 162620 - DNA, 523 bp, Homo sapiens
  misc_feature: GYAE6OF02GL4UL.33.78.H01.1.454.CMB.1.raw
  modified_base (414)..(414): a, c, t, g, unknown or other
  misc_feature (414)..(414): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagcccaccgtcggtttctgtgtcactgggacagacggccaggatcacctgctctggagatgcattgaccaaagcaatacgcttattggtaccagcagaagccaggccaggcccctgtactgataatatacaaaagagaatgagaggccctcgagggactcccgtgagcgtattccgtccggctacaatgcgaggacaacagtcacgttgacatcagtgagtcgaggcagaagacgagctagactancactcgccactcagccgacctcgaggtggtaggtggtcgttcgggcggaggacaggtcgaccggtcgtacggtcacgaccgaggcctcgcccccgtggtccacgttccg

SEQ ID NO: 162621 - DNA, 518 bp, Homo sapiens
  misc_feature: GYAE6OF02FKECJ.33.78.H01.1.454.CMB.1.raw
  modified_base (311)..(311): a, c, t, g, unknown or other
  misc_feature (311)..(311): n is a, c, g, or t
tcagtacacacactcacgaccggtgctcgatttagtgtgagtagtttgggtttgggggggtccaagaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctnagggatccctgagcgattctccggctacatgcagggacaacagtcacgttgaccatcagtggagtccaggcagaagacgaggctgactatcactcgccactcagccgacctcagtggtaggtgggtgttcgggcggagggaccagttgaccgtccgtaggtcagcccaaggtcctcgcccctcggtccacgtctcgttcccgtcccc

SEQ ID NO: 162622 - DNA, 621 bp, Homo sapiens
  misc_feature: GYAE6OF02H1QJE.33.78.H01.1.454.CMB.1.raw
  modified_base (330)..(330): a, c, t, g, unknown or other
  misc_feature (330)..(330): n is a, c, g, or t
tcagtacacacactcacgaccggtgctcgatttagtgtgagtagtttgggtttggggggtccaggaggcagaactctgggtgtctcaccatggcctggatccctctacttcctccccctcctcactctctgcacaggctctgcggcctcctacgagctgacacagccaccgtcggtttctgtgtcactgggacagacggccaggatcacctgctctggagatgcattgaccaaagcaatacgcttattggtaccagcagaagccaggccacggcccctgtacctgataatatacaaagagaatgaagaggaccctcgaagggactcccgngtagacgattcctccggactacaagtgacagggaacacgagtcgacgttgaccatcgagtgagtaccaggacaaggaacgacggaggactacgaagtactcacgtgaccctactcgacgaccggtacctacgacggtgggtaagggtgggttcggttaccgggacgggacgggaacccgttaaggttcgacccgggttacgttacggtaccgtacggtacccgaaggtcccgtcccggtacccccgtcgggtaccttacccggtcgttaccccggttacccctacccccgg

SEQ ID NO: 162623 - DNA, 574 bp, Homo sapiens
  misc_feature: GYAE6OF02JQW8R.33.78.H01.1.454.CMB.1.raw
tcagtacacacactcacgaccggtgctcgatttagtgtgagtagtttgggtttgggggaaaacctcattcctcctctaaagaagcccctgggagcacagcgcatcaccatggactggacctggaggttcctctttgtggtggcagcagctacaggtgtccagtcccagttccaactggtacaatctgggtctgaggtgaagaggcctgggtcctcggtgagggtctcctgcagtgtctctgggagcgccttcagcacctatgccatcacctgggtgcgacacggcccccggacaagggcttcggagtggagtggggggtatcatccctctcttcggcacaatacagtacgcccactaaactttcaacgacaagagtgacaagtttcgacgaaacgaatccaacgaccaacacgtaccacataggagttagaggacgcctggacatactagacgacacggcctatattactgtagcgaagacgatacaaagtgtaggagacaaggtgggttaacgggttagacgtccgtacggggaccgacggggtaacccgtggtacgacgttcgtccgtaccg

SEQ ID NO: 162624 - DNA, 543 bp, Homo sapiens
  misc_feature: GYAE6OF02IU0NV.33.78.H01.1.454.CMB.1.raw
  modified_base (339)..(339): a, c, t, g, unknown or other
  misc_feature (339)..(339): n is a, c, g, or t
  modified_base (415)..(415): a, c, t, g, unknown or other
  misc_feature (415)..(415): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttattggtaccagcagaagccaggccaggcccctgtactgataatatacaaagagaatgagaggccctcagggactcccgtgagcgattcnccggctaacaatgcagggacaacagtcacgttgaccatcagtggagtccaggacagaaagacgaggctaggactanaccactgcccactcgacgccgacctcgacggtgggtaggttggggttgttcgggcggagggaccgtaaggttcggaccgttaccgtaggtaccacggacccaggcctcgcccccgtcggtccactccg

SEQ ID NO: 162625 - DNA, 636 bp, Homo sapiens
  misc_feature: GYAE6OF02I7SGE.33.78.H01.1.454.CMB.1.raw
  modified_base (222)..(222): a, c, t, g, unknown or other
  misc_feature (222)..(222): n is a, c, g, or t
  modified_base (328)..(328): a, c, t, g, unknown or other
  misc_feature (328)..(328): n is a, c, g, or t
tcagtacacacactcacgaccggtgctcgatttagtgtgagtagtttgggtttgggggtgggtccaggaggcagaactctgggtgtctcaccatggcctggatccctctacttctcccctcctcactctctgcacaggctctgcggcctcctacgagctgacacagccaccgtcggtttctgtgtcacgtgggacagacggccaggatcacctgctctgganatgcattgaccaaagcaatacgcttagttggtaccagcagaagccaggccaggcccctgtactgaataatataacaaagagaatgagacggcctcgaggatcccgngacgcgtattcgtaccggcttaacaagtcgacgagggaacaacgagtacacgttcgacatacgagtagacgtcgaggacagaagacgaggactagactaagtactactacgacctacgtacgacggaccgtaaccgtcgtaaggtacgggtacggggttaggggttcggttacggggaccgggtaacgggtaaccgtaaggtttcccgggaaccgttaccggtaacggttaccggaccggtacccggaacggtaccgtcccggtacccccgtccgggtacctaccctaccgttacccgttaccccccg

SEQ ID NO: 162626 - DNA, 756 bp, Homo sapiens
  misc_feature: GYAE6OF02JQEJT.33.78.H01.1.454.CMB.1.raw
  modified_base (303)..(303): a, c, t, g, unknown or other
  misc_feature (303)..(303): n is a, c, g, or t
tcagtacacacactcacgaccggtgctcgatttagtgtgagtagtttgggtttgggggggtccaggaggcagaactctgggtgtctcaccatggcctggatccctctacttctcccctcctcactctctgcacaggctctgcggcctcctacgagctgacacagccaccgtcggtttctgtgtcactgggacagacgccaggatcactgctcgtggagatgcattcgaccaaagcaatacgtcttatcggtaccagcagaacgccaggccacggcccctgtactagataatactaacaaaganaatggagacggaccctacgagggtaactcccgtagacgtacgtacgttaccgccggtacctaacgaacgttcgaccggtaacggggaaccctaaaacgtacggttaccgtaacccggtttacgaaccctaagttccgtaaggtacgggtaccgttacccgaagggtaccgaaacggtaaacggaccgggaagtccgttaacgggaaccttaacgtaccgaacgttcgaccctaacgttccgaaccggtcccgggtaacccgttaggaccggttagggtaacggggtttcggggttacggttccggggacggggtaaacggaacccgttagggttacccgtacgggttacccggttacgggaccggtaacccgccggtaaacggtcccgttaaccggtcccccggttaacggtcccgtacccgtttacccggtcccgtttacccccgtccccgg

SEQ ID NO: 162627 - DNA, 554 bp, Homo sapiens
  misc_feature: GYAE6OF02I6VIL.33.78.H01.1.454.CMB.1.raw
  modified_base (297)..(297): a, c, t, g, unknown or other
  misc_feature (297)..(297): n is a, c, g, or t
  modified_base (322)..(322): a, c, t, g, unknown or other
  misc_feature (322)..(322): n is a, c, g, or t
  modified_base (338)..(338): a, c, t, g, unknown or other
  misc_feature (338)..(338): n is a, c, g, or t
  modified_base (355)..(355): a, c, t, g, unknown or other
  misc_feature (355)..(355): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttatggtaccagcagaagccaggccaggcccctgtactgataatataacaaaganaatgagaggccctagagggatcccngagcgacttctccggntacaatcgcaggacaanagtacacgttgaccatcagtgatcaggcagaagacgagctagactatcgatcgaccactcgagccgtactcgaggttcggtaggttacgggtgttccgggcgggaacggaacgtaagtttccggaccgtcgtaagggtcaagacccgaaggccttacggccccgtacggtaccaccttccgttcggtccccgtaccccg

SEQ ID NO: 162628 - DNA, 533 bp, Homo sapiens
  misc_feature: GYAE6OF02IKN1P.33.78.H01.1.454.CMB.1.raw
  modified_base (407)..(407): a, c, t, g, unknown or other
  misc_feature (407)..(407): n is a, c, g, or t
tcagtacacacactcacgaccggtgctcgatttagtgtgagtagtttgggtttgggggctgtgggtccaggaggcagaactctgggtgtctcaccatggcctggatccctctacttctcccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcgagggatccctgagcgattctccggctacaatgcagggacaacagtcacgttgaccatcagtgagtcaggcagaagacgaggctgactancactcgccactcagccggtacctcgaggtggtaggttgggtggttcgggcgggagggaccaaggttcgaccggttccgtaggtccacgacccgaaggtcctccggcccccgtcggtccacgttccg

SEQ ID NO: 162629 - DNA, 549 bp, Homo sapiens
  misc_feature: GYAE6OF02HZBL6.33.78.H01.1.454.CMB.1.raw
  modified_base (426)..(426): a, c, t, g, unknown or other
  misc_feature (426)..(426): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcacgtgggacaggacggccaggatcacctgctctggagatgcattgaccaaaagcaatacgcttatggtaccagcagaagccaggccaggcccctgtactgataatataacaaagagaatgagaggccctcgagggactcccgtgagcgattcgtccggctacaatgacaggacaacagtcacgttcgaaccatcagtggagtccgaggcaagaagacgaggctgactatcactgccacncagcgacctcagtggtaggtgggtgttcggcgggaggaccgtaaggttcgaccgtacgtaggtccacggacccgaaggccgtacgcccccgttcggtacctaccttccgttccgttacccccg

SEQ ID NO: 162630 - DNA, 552 bp, Homo sapiens
  misc_feature: GYAE6OF02JHNOA.33.78.H01.1.454.CMB.1.raw
  modified_base (425)..(425): a, c, t, g, unknown or other
  misc_feature (425)..(425): n is a, c, g, or t
tcagtacacacactcacgaccggtgctcgatttagtgtgagtagtttgggtttgggggggtccgaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttattggtaccagcagaagccaggccaggcccctgtacctgataatatacaaagagaatgagacggccctacgagggactccctggacgcgattctccggctacaatgacagggacaacgagtcacgttgaccatcagtgagtccgaggcaagagacgaggctagactatcactgaccacncgacgcgacctcgaggttcggtagggtggttcgtcggacgggagggaccgtaggtcgaccgtacgtaggtaccaggacccgaggcctccgcccccgtcggtccaccgtcgtccgttcccctaccccg

SEQ ID NO: 162631 - DNA, 589 bp, Homo sapiens
  misc_feature: GYAE6OF02HH5UK.33.78.H01.1.454.CMB.1.raw
  modified_base (384)..(384): a, c, t, g, unknown or other
  misc_feature (384)..(384): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgttcggtttctgtgtcacgtgggacagacggccaggatcacctgctctggagatgcattgaccaaaagcaatacgcttattggtaccagcagaagccaggccacggcccctgtactgataatataacaaagagaatgagacggccctagagggactcccgtgacgcgacttctaccggttacaagtgacagggacaacagtcacggttnactatcagtggacgtcgaggacagaaagacgaaggctagactatccactcgccactcacgccggacctcgagtgggttacgggtgggttcggttcgggacggtacggggaaccgtaggttcggacccggttacgtacgggttcaaccggacccgaagggtcccgttccggcccccggttacggtacctaccgttccgttccccgg

SEQ ID NO: 162632 - DNA, 863 bp, Homo sapiens
  misc_feature: GYAE6OF02H1QJL.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttattggtaccagcagaagccaggccacggcccctgtactgaataatataacaaagagaatgagtacgccctacgagggactcccgtagacgcgtacttcgtcccggcttaacaagtcgaccgaacggggaacaaaccgaggttaccgtaaacggtttacggaaaccctaagttacccgtaagggttacgggtaaccggttacccggaaacggggaccgaaacgggaaaacgggtaaccgggaaacggggtaccgttaagggtaaaccttaaacgttacccgtaaaccggttaccggaaccccgtaaaccgttaccgaaaccggggtaccccggggtaaaccccgttacccggtaacggggttacgggggtttaaaccggggggttcgggggttttaaccggggtttacccggggggacgggggtaaaccgggggtaacccgggtaaacgggtttacccggggtaaccccgggttttaccccgggtaacgggttacccggaacccgggtaacccccggtaaaaccgggtccccgttaccccggggtaccccccccggtttaccgggttaccccggtaacccggtttccccggtttaccccggtttaacccccccccgg

SEQ ID NO: 162633 - DNA, 537 bp, Homo sapiens
  misc_feature: GYAE6OF02F5PL2.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatataacaaagagaatgaagaggccctcgagggatcccgtgagcgattctccggactacaatgacaggacaacagtcacgttgaccatcagtgacgtcgaggcagaagacgaggctagactatcactgccactcgagcgacctcagtggtggtgggtgtcgggcggacgggacgagttcgaccgtccgtaggtaccgacggcccgaaggcccgtcgcccccgtcggtccacctccgttaccgttcccccg

SEQ ID NO: 162634 - DNA, 525 bp, Homo sapiens
  misc_feature: GYAE6OF02GPO6U.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaaagcaatacgcttattggtaccagcagaagccaggccaggcccctgtactgataatatacaaagagaatgagaggccctcgagggatccctgagcgattctccggctaacaatgcaggacaacagtcacgttgaccatcagtggagtcgaggcaagaagacgaggctgactatcactcgccactcagccgactcgagtggtaggtgggtgttcgggcggtaggacgtaagttcgaccgtcgtaggcacggacccgaggctccggcccctcggtcaccgttctccgttcccc

SEQ ID NO: 162635 - DNA, 572 bp, Homo sapiens
  misc_feature: GYAE6OF02GF16A.33.78.H01.1.454.CMB.1.raw
  modified_base (313)..(313): a, c, t, g, unknown or other
  misc_feature (313)..(313): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatataacaaagagaatgagacggccctnagggactcctgagcgattctccggctacaatgcgagggacaacgagtcacgttagaccatcagtggacgtccgaggcagaagacgaggctgactatcactcgaccactcacgcggacctgaggttggtagggttgggttcggttcgggcgggacgggaaccgtaaggttcggtacccgttccgtacgggtccaacggcccgaaggtccgttccgcccccgttcggtaccctaccgttccttccgttaccccctaccccg

SEQ ID NO: 162636 - DNA, 519 bp, Homo sapiens
  misc_feature: GYAE6OF02GQ3B0.33.78.H01.1.454.CMB.1.raw
  modified_base (366)..(366): a, c, t, g, unknown or other
  misc_feature (366)..(366): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggccccctgtactgataatatacaaagagaaatgagaggccctcgagggactcccctgagcgattcgtccggactacaatgacagggacaanagtcacgttgaccatcagtgagtccaggcagaagacgaggctgactatcactcgccactcacgcggacctcgagtgggtaggtgggtgttcgggcggagggactaggtcgaccgtcgtaggcacgcccaggctcgccccgtggtccacgtccg

SEQ ID NO: 162637 - DNA, 534 bp, Homo sapiens
  misc_feature: GYAE6OF02IZXHK.33.78.H01.1.454.CMB.1.raw
  modified_base (338)..(338): a, c, t, g, unknown or other
  misc_feature (338)..(338): n is a, c, g, or t
  modified_base (418)..(418): a, c, t, g, unknown or other
  misc_feature (418)..(418): n is a, c, g, or t
tcagtacacacactcacgaccggtgctcgatttagtgtgagtagtttgggtttgggggctgtgggtccaggaggcagaactctgggtgtctcaccatggcctggatccctctacttctcccccctcctcactctctgcacaggctctgcggcctcctacgagctgacacagccaccgtcggtttctgtgtcactgggacagacggccaggatccacctgctctggagatgcattgccaaagcaatacgcttattggtaccagcagaagccaggccaggcccctgactgataatatacaaagagaatgagaggccctcagggatcccgtgagcgattcnccggctacaatcgcgagggacaacgagtcacgtcgaccatcagtggagtccaggcagaagacggaggctagactatcacncgccactcgacgccgactcgaggtggtacgggtgggtcgttcgggcggagggacctaaggtcggaaccggttccgagggtcacgacccgaacggctccgccccgtcgtccgctccg

SEQ ID NO: 162638 - DNA, 587 bp, Homo sapiens
  misc_feature: GYAE6OF02IMY6P.33.78.H01.1.454.CMB.1.raw
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgcggcctcctacgagctgacacagccaccgtcggtttctgtgtcactgggacagacggccaggatcacctgctctggagatgcattgaccaaagcaaatcgcttaagttcggaccagacagaagccaggaccaggcccctgtactgataanatacaaaganaatgaagacggcctacgagggactcccgtgagcgattctccggntacaatgacgaggacaacgagtcacgttgaaccatacagtggacgtccgaggacaggaagacgaggctagactatacactcgaccactcagccgaacctcgacggttgggtagggttgggtacgggttccgggacgggtacgggaaccgtaaggttccggtacccggtacgttacggcgtaacgccgtaacggccgtaccggcccccgttacgccgtacctccgttccgtccctaccccg

SEQ ID NO: 162639 - DNA, 787 bp, Homo sapiens
  misc_feature: GYAE6OF02IV5OX.33.78.H01.1.454.CMB.1.raw
  modified_base (221)..(221): a, c, t, g, unknown or other
  misc_feature (221)..(221): n is a, c, g, or t
tcagtacacacactcacgaccggtgctcgatttagtgtgagtagtttgggtttggggggggtccgagggaggcagaactctgggtgtctcaccatggcctggatccctctacttctcccctcctcactctctgcacaggctctgcggcctcctacgagctgacacagccaccgtcggtttctgtgtcactgggacagacgccaggatcacctgctctgganatgcattgccaaagcaatacgacttagttcggtaccagcagaagccaggccaggcccctgtactgactaatataacgaaagagtaataggaagacggaccctagagggtactcccgtgacgcgtaacttccgtaccgggactaacgaaacttcggaccgtaaggggtaacctaaacgtacggttacccgaacggtttcggaacccgtaaggttacccgtaaggttacggggtaaccgtacccggtaaacgggaccgaaacggaaaacggtaccggaacggggtacctaacggtaacctacgtaccgtaactcggaccccttacgtaccggtaacggaccggtaaccgttacgtaacgggttacgggttaacggggttcggggttacgggtttaccggggacggggtaaaccgggtaaaccgttaacgggtttccggtaccccgggtttaccgtaacgggggttcccaaaccgggtaccccggaagggtaccccgttcccggtaaccccccggttcggttacccgtaacccggtcccgtttaccccggttaccccctaaccccccgg

SEQ ID NO: 162640 - DNA, 546 bp, Homo sapiens
  misc_feature: GYAE6OF02ID7NW.33.78.H01.1.454.CMB.1.raw
  modified_base (305)..(305): a, c, t, g, unknown or other
  misc_feature (305)..(305): n is a, c, g, or t
  modified_base (321)..(321): a, c, t, g, unknown or other
  misc_feature (321)..(321): n is a, c, g, or t
  modified_base (446)..(446): a, c, t, g, unknown or other
  misc_feature (446)..(446): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgttcggtttctgtgtcactgggacagacggccaggatcacctgctctggagatgcattgaccaaaagcaatacgcttattggtaccagcagaagccaggccaggcccctgtactgataatatacaaaganaatgagacggccctanagggactcccgtgagcgtattccgtccggctaacaatgacgagggacaacagtcacgttgaccatcgagtaggacgtccgaaggcaagaaaggacggtaggctaggaactattcgactgccactnagcgtactcgagtggtaggtgggtgtcggcggaggacaaggttcgaccggtcctaggaccacgacccgtaggcctccggcccccgtcggtacctctcccg

SEQ ID NO: 162641 - DNA, 705 bp, Homo sapiens
  misc_feature: GYAE6OF02JYKOD.33.78.H01.1.454.CMB.1.raw
  modified_base (488)..(488): a, c, t, g, unknown or other
  misc_feature (488)..(488): n is a, c, g, or t
tcagtacacacactcacgaccggtgctcgatttagtgtgagtagtttgggtttggggctgtgggtccaggaggcagactctggtggtctcaccactggcgtcgagtcctcctacttctcccctccctcactctctgcacaggctctcgcggccgtcctaccgagctcgacaccacgccgacccgttccggtttcgttgtgtcactgggacgacgacggccgtagatcacctgctctggagatgcattgccgaaacgacaattacgtcttatttacggtaccgaacgacagaaacgacccgagggtaacccgccgggaccccccgttcgttaacgtacgtaagtaaacttaataaccgaaaacgaaaggattaaggcgggaacggcccccgttaccaggggtaactcccctcggaaggccggtaactttccgtcccgggtctaaactaagtgacggacgggaacaacacggtctacgtcgaccactagnggtaggacgtaccgagacgtagaacggacgtacgacggtctaagtacactaccgcgtaccacctgacggaccgccgtaacgcggttaagggttacgggtggttacgggttacgggccggggaggaaccgtagtttacggtcccggttccgttacggacgtcggaccccgtaaggtcccgtccgtaccccccggttacgttcccggacccttttccgg

SEQ ID NO: 162642 - DNA, 964 bp, Homo sapiens
  misc_feature: GYAE6OF02IBY00.33.78.H01.1.454.CMB.1.raw
tcagtacacacactcacgaccggtgctcgatttagtgtgagtagtttggggtttgggggggtccaggaggccagaactctgggtgtctcaccatggcctaggactcctctacttctccccctcctcactctcgtgcacaggctctcgcggtcctccgtacgagctgacacagccgaccgtccggtttctcgtgtcacgtgggacagacggccgaggacgtcaccgtggctacgtagggacgtagtcgactagtttcggaacctaaaacggtcctaaagttaccggtacgtttttaacgtttcggggtaaacccgaaggtaccgtaaaacggtaaaaccggtaccccgtaaacgggggacccctaaaccggggttaccccccctttagggtttaacccgtaggtaaacgttaaaaacggtttaacgttaaaacccggaaaaaacgggtaacgggtaaaaccgttaggggaaacgggtaaccggggtacccccgtttacgggaacggggggttaaccttacccccggttaggggaaccggtacccggtaaaccgttttacccggttacccggtaacgttaaccggtaaagttccggaacggtaaaccggggaacctaaaaccgtaacggttacccgtaaacggtttacggaaccgtacggtaccgaacgggttacgggaaccgttcccgaacgggtaccaaacgggaaacggtaccgggtaacggtccgtaagaccttaacgtaccctaacgtccgtacctaaccgttacggacggtccggtacgttacggaacgggttacgggtagggttcggggtcggtttacggggaccgggtacggggtaaacccgtaagggttccgtacccggttcgttacgggtccgtaaccggtacccggtaagggtacccgtccggtaccccgttacgggtacccttaccgttcggttacccggtccccttaccccgg

SEQ ID NO: 162643 - DNA, 567 bp, Homo sapiens
  misc_feature: GYAE6OF02GL1E2.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgtggcctcctacgagctgacacagccaccgtcggtttctgtgtcactgggacagacggccaggatcacctgctctggagatgcattgaccaaagcaatacgcttattggtaccagcagaagccaggccaggcccctgtactgataatataacaaagagaatgagacggccctacgagggactcccgtgacgcgattccgtccggctaacaatgacaagggacaacagtcacgttcgaaccatcagtggagtccgaggcagaagacgagctagactatacactcgccactcgacggccgtacctcgaggttcgggtagggttgggtcgttcgggacgggacgggactaaggttcgacccggttacgtacggtacacggtacccgaaggccgtaccggcccccgttcggtcctaccgttcccg

SEQ ID NO: 162644 - DNA, 569 bp, Homo sapiens
  misc_feature: GYAE6OF02IJAIQ.33.78.H01.1.454.CMB.1.raw
  modified_base (215)..(215): a, c, t, g, unknown or other
  misc_feature (215)..(215): n is a, c, g, or t
  modified_base (395)..(395): a, c, t, g, unknown or other
  misc_feature (395)..(395): n is a, c, g, or t
  modified_base (424)..(424): a, c, t, g, unknown or other
  misc_feature (424)..(424): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
  modified_base (532)..(532): a, c, t, g, unknown or other
  misc_feature (532)..(532): n is a, c, g, or t
tcagtacacacactcacgaccggtgctcgatttagtgtgagtagtttgggtttggggggttcgaggaggcgagaactctgggtgtctcaccatggcctggatccctctacttctcccctcctcactctctgcacagctctgcgcctcctacgagctgacacagccaccgtcggtttctgtgtcacgtgggacagacggccaggatcacctgcctntggagatgcattgaccaaaagcaaatacgcttattggtacagcaagacgacagccaggcccctagtacctgataatataacaaagagaatgaagaggaccccttgacgggtactcccgtagacggacgtattaccgtccgacgtacaaatgacgacggaacaacagtcgaacttgaaccntacagtaggactcgacggcaagaagacgngacagactancacgtnccacanagaccgactgacgtaggtagtgggttagtccgggtaggaggtaccgaagttcggaccgtagtacggtacaacggcccgaaggtccnccgtcccgtacggtccaccgtctaccgtcccgtcccc

SEQ ID NO: 162645 - DNA, 557 bp, Homo sapiens
  misc_feature: GYAE6OF02GN2FF.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttatggtaccagcagaagccaggccaggccccctgtactgataatataacaaagagaatgagacggccctcgagggactcccgtagacgcgtacttccgtcccggactaacaatcgacgagggaacaacgagtcgacgttcgaccatacgagtggagtccgaggcaagaagacgaggctagactatcactcgaccactcgacggccgacctcgaggtgggttagggttgggttgttcgggcgggaaggaccgaaggttcgaccgtcgtaggtcacgccgaagccgtcgccccgtgtccacgtcgtcgtccccg

SEQ ID NO: 162646 - DNA, 907 bp, Homo sapiens
  misc_feature: GYAE6OF02HJTAU.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatcccctacttctccctccctcactctctgcacaggcgtctgcggccgtcctaccgagctgacgacagccgaccgtcggtttcgttgtgtcgactgggacgacgacggccgaggagtcacctcgcgtctggaggatgcattgccgaaagacaatacgtcttattggtaccagcgagaaaggccacggccgacggacccccgtcgtacgtagataaatataacaaaacggaagaagtacgaggacgggaccccttcgaaggggacgtaccccttggaaggcgtactttaccttcccggggcctaaactaaacgtggccgaacgggggtaaccgaaaacctaggttcccgtaaccggtttacgggtaaaccccaacgtttccgtaacggggttagggggtaacggttacccccgaaaccgggggacggaaaacgggtaaaaagggaaaccccggggtaaggggacccgtttaccggtaaacgtttaaacctttaccccggtaaacccgttacggtacccccggaaacccttaccggtaaccgggacccgggggtaacccccttccgttaaagggggttaggggggttttaacgggggtttcgggggggtttcgggttttaccccgggggaccggggggaaacggggggttaacccccgtaaagggtttttaccggggtaccccccgggtttacccgggtttaaacggggttaccgaaccggtaccccccggtaaacggggtccgttccccgggtaccccccccgttcccgggggtttaacccgttaccttcccgttttccccggg

SEQ ID NO: 162647 - DNA, 692 bp, Homo sapiens
  misc_feature: GYAE6OF02HH84T.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgttcggtttctgtgtcactgggacagacggccaggatcacctgctctggagatgctattgaccaaagacaatacgcttattggtaccagcaagaacgccacggccgacggcccctagtactagataaatataacaaagagaatagagacggacctacgagggactcccgtgacgcgtacttccgtaccggactaacgaatcgacgaacgggaacaacgacgtactacggttacaacctatacgaggtacggaacgtaccgaaggtacaaaggaacggaaccggaaggtcgtaacggaacttacgtaccaacgtagacccacgtcgaacggaccggtaccctacgtaacggttacgggttacggggtaggggttcggttaccggggacgggtaacggggtacccgtaagggtttccgggtaacccggttaccggttaacggtccgtaaccggttaccccggaacggttcccgtacccggtacccccccggttacgggttacccgtacctttaccccgg

SEQ ID NO: 162648 - DNA, 577 bp, Homo sapiens
  misc_feature: GYAE6OF02HG9IB.33.78.H01.1.454.CMB.1.raw
  modified_base (334)..(334): a, c, t, g, unknown or other
  misc_feature (334)..(334): n is a, c, g, or t
  modified_base (429)..(429): a, c, t, g, unknown or other
  misc_feature (429)..(429): n is a, c, g, or t
tcagtacacacactcacgaccggtgctcgatttagtgtgagtagtttgggtttggggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgtcttattggtaccagcagaacgccgaggccacggcccctgtactgataataataacaaagagaatagagacggccctacgagggactcccngagcgtacttcgtccggctacaatgcgagggacaaacagtacacgttacgacatcgaggtggagtccgaggcgaagaaggacgaggactgactancactcgccactcgacgccggacctcgtaggtgggtagggtgggttggttcgggacgggacgggaccgtaggtcgaccgtcgtacggtcgaccgacccgaaggccgtaccgccccgtcggtcctacgtcccgttccgttccctaccccg

SEQ ID NO: 162649 - DNA, 551 bp, Homo sapiens
  misc_feature: GYAE6OF02IBIGF.33.78.H01.1.454.CMB.1.raw
  modified_base (256)..(256): a, c, t, g, unknown or other
  misc_feature (256)..(256): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggttttctgtgtcactgggacagacggccaggatcacctgctctggagatgcattgaccaaagcaatacgcttattggtaccngcagaagcaggccacggcccctgtactgataatatacaaagagaatgagacggccctagagggactccgtgagcgtattccgtcggactacgaatcgacgagggaacaacgagtcaacgttcgaccatcagtgagtcgaggacggaagacgagcagactatacactcgcctatcagcgacctgaggtggtagtgggtgtcggacggaggacaggttcgaccgtcgtaggtcacggacccgaaggccctaccgccccgttacggtccaccgttccgtcgttacccccaccgtcccg

SEQ ID NO: 162650 - DNA, 516 bp, Homo sapiens
  misc_feature: GYAE6OF02F27NV.33.78.H01.1.454.CMB.1.raw
  modified_base (315)..(315): a, c, t, g, unknown or other
  misc_feature (315)..(315): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagagccctnagggatccctgagcgattctccggctacaatgcagggacaacagtcacgttgaccatcagtggagtccgaggcagaagacggagctgactatcactgccactcacgcgacctcgagtggtaggtgggtgtcgggcggaggactaggtcgaccggtcgtacggtcacgcccgaaggcctccgccccgtcggtccacgttccg

SEQ ID NO: 162651 - DNA, 527 bp, Homo sapiens
  misc_feature: GYAE6OF02FOPFP.33.78.H01.1.454.CMB.1.raw
  modified_base (403)..(403): a, c, t, g, unknown or other
  misc_feature (403)..(403): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcgagggatccctgagcgattctccggctacaatgcagggacaacagtacacgttgaccatcagtggagtcgaggcagaagacgagctgactancactcgccactcgagccgacctcaggtggtaggtgggtgttcgggcggagggaccagttcgaccgtccgtaggtccagcccgaaggtcctccgccccgtcggtccacgtcctcgtccctacccc

SEQ ID NO: 162652 - DNA, 534 bp, Homo sapiens
  misc_feature: GYAE6OF02FZ2YJ.33.78.H01.1.454.CMB.1.raw
  modified_base (470)..(470): a, c, t, g, unknown or other
  misc_feature (470)..(470): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagacgcctgagggactcccgtgagcgtattccgtccgactacaatgacagggacaacgacgtacacgttcgacctatcgagtcggacgtccgaggcaagaagacggaggctagactatacactgccactcgacgccgactcgagtcgggtaggtgggtgtcggngggacggacgagtcggacgtcgtacggtcacgccgacggctccgccccgtcggtccacgttccg

SEQ ID NO: 162653 - DNA, 664 bp, Homo sapiens
  misc_feature: GYAE6OF02G63L5.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaaagcaatcgacttattggtaccagcaagaagccaggccacggccccctgtactgataatataacaaagagaatgaagacggccctacgagggactcccgtgagacgtattccgtccggtactaacgaatgacgaacgggtacaaacgagtacacgtttacgactactacgaagtaggtacgtacccgaagggacaacggaaacggacggtaacggactaggaacctaatccgaactcgacctacgtccgaggacccggtaccttacggagggttgggtaaggggttcgggttcggttaccggggacggggtacgggaaccggtaaggttaccggtacccgttacggtacggtccgtaacggaccccggaaggtcccgtccggaccccccgttcgggtacctaccgttccgttacccgtccccgtaaccccg

SEQ ID NO: 162654 - DNA, 610 bp, Homo sapiens
  misc_feature: GYAE6OF02IUGB7.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttaattggtaccagcagaagccaggccaggcccctgtactgataatatacaaagagaatgagaaggccctcgagggactccctgacgacgattctccggctacaattcgacaagggacaaacagtcacgttacgaacctatccgagtggaacgtccaggacaagaaacgacggaggctaggaacttagaccaacgttgaccctataccgacgtccggaaccttcgacggttacggtacgggttggggttcgttcgggtacgggaacggaaccgtaggttacggaccgttaccgtagggtccgacggacccgaacggtcctaccggcccccttagggtccctacgtaccgttccgttacccctaccccg

SEQ ID NO: 162655 - DNA, 523 bp, Homo sapiens
  misc_feature: GYAE6OF02HADX6.33.78.H01.1.454.CMB.1.raw
  modified_base (315)..(315): a, c, t, g, unknown or other
  misc_feature (315)..(315): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaaagagaatggagaggccctnagggatccctgagcgattctccggctacaatgacagggacaacagtcacgttgaccatcaggtgagtccaggcaagaagacgagctgactatcactgccactcacgcgactcgagtgggtaggtgggtgttcgggcggaggacgagttcgaccgttcgtaggtcacgccgaaggtctccggccccgtggtccacgtcctcgtaccccc

SEQ ID NO: 162656 - DNA, 571 bp, Homo sapiens
  misc_feature: GYAE6OF02F60RX.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgttcggtttctgtgtcacgtgggacagacggccaggatcacctgctctggagatgctattgaccaaaagcaaatacgctttattggtaaccagcagaagccaggccacggcccctgtactgataatataacaaagagaatgagacggccctgagggactccctgacgcgtattccgccggactacaatcgacgagggaacaacgagtacacgttgacctatcgaggtggacgtccaggcaggaagacggagactagactatacactcgacctactcgaggaccgacctcgaggtgggtacgggttggggtcgtcgggacggacgggtacgaggttcgaccgttcgtaggccacggccctaaggcctccggtcccctggtcctcgttccgtccgtccccg

SEQ ID NO: 162657 - DNA, 650 bp, Homo sapiens
  misc_feature: GYAE6OF02H0LQS.33.78.H01.1.454.CMB.1.raw
  modified_base (298)..(298): a, c, t, g, unknown or other
  misc_feature (298)..(298): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttattggtacagcagaacgcaggccaggcccctgtactgataatataacaaaganaatgagaggccctcgagggatacccgtgagcgatctccggctacaatgacagggacaacgagtctacgttgaaccatcgagtggacgtcgagcgaagaaagacgaggactacgacgtatacgaactcgaccacgtcgacgtacccggacctaccgtaaggtcgggttaagggttcggggttacggtttccggggcggggtaaacgggaacccgttaagggttaccggtaccccggttaccgttaacggggtacccgtaacgggaccccgaaagggtacccgtcccgggtacccccccgttccgggtacccgttaaccgtttcccgttcccggtttcccccggttaccccccg

SEQ ID NO: 162658 - DNA, 662 bp, Homo sapiens
  misc_feature: GYAE6OF02GB69A.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttattggtaccagcagaagccaggccacggcccctagtactagataatataacaaagagaatgagacggcctcgagggactcccgtagagcgtactttccgccggtactaacaagtcggacgaacggggtaacaaactacggtacctaacggttacgaaccctataccgaaggttcgggaacgtacccggaggcgaaaggaacggaacggacgggctacggaacttaacgtaccgtaacgtcgaccctaccgtacgacggaccggtaccgtcgtaaggttggggtacgggtagggttcgggtaccggggacgggacgggtaccgtaaggttccggtaacccggtacggttacggtaccgacggacccgtacggtcccgttaccggcccccgttacgggtacctccggttacccg

SEQ ID NO: 162659 - DNA, 667 bp, Homo sapiens
  misc_feature: GYAE6OF02IEMSC.33.78.H01.1.454.CMB.1.raw
  modified_base (300)..(300): a, c, t, g, unknown or other
  misc_feature (300)..(300): n is a, c, g, or t
tcagtacacacactcacgaccggtgctcgatttagtgtgagtagtttgggtttgggggtgggtccaggaggcagaactctgggtgtctcaccatggcctggatccctctacttcctccccctcctcactctctgcacaggctctgcgcctcctacgagctgacacacgccaccgttcggtttctgtgtcacgtggacagacggccaggatcacctgctctaggagatgctaattgaccaaagcaatacgctttaagtcggtaccagcagaagccgaggccacggccctgtactgaataanataacgaaagagtaagtgaacgacggccctacgaagggaccttcccgaggaacgacgtattccgaccgactaacaagtgacgaggaacaacgtagtcgaacgttcgaacatacgagtaggacgtaccgaggacaaggaacgaacgacggacgtagaacgtactcgaactccgaccgtactacgacgaccgtaccgtacgtacgggtagggtaacgggttcgggttcgggttaccgggacggggtaacgggaaccgttaacgggttccggtaccggtacccggtaaggttacccgacggtacccggaaccggtccgtacccggtcccccggtaccggttccgtacccgtcccgttacccgttcccccg

SEQ ID NO: 162660 - DNA, 580 bp, Homo sapiens
  misc_feature: GYAE6OF02JASVN.33.78.H01.1.454.CMB.1.raw
tcagtacacacactcacgaccggtgctcgatttagtgtgagtagtttgggtttgggggaaaacctcattcctcctctaaagaagcccctgggagcacagcgcatcaccatggactggacctggaggttcctctttgtggtggcagcagctacaggtgtccagtcccagttccaactggtacaatctgggtctgaggtgaagaggcctgggtcctcggtgagggtctcctgcagtgtctctgggagcgccttcagccacctatgccatcacctgggtgcgacacggcccccggacaagggcttgagtggagtgggggtatcgatccctctcttcggcacaatacagtaccgcccacaaatttcaagacagagtgactaagtttcgacgaacgaatacaacgaccacacgtccaacagtggagttgaggagccgtgactatctagaagacacggcctaatacttacgtgtagcgagagatacaaatgtggacgacgtaaggttcgggtttaacgggttgtaccgttccggtacggggacccgacgggtaacccgttggtaccgtacgttccgtccttacccg

SEQ ID NO: 162661 - DNA, 536 bp, Homo sapiens
  misc_feature: GYAE6OF02FVMGX.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggccccctgtactgataatataacaaagagaatgagaggccctcagggatccctgagcgattctccggctacatgcagggacaacagtcacgttgaccatcagtggagtcaggcaagaagacgaggctagactatcactgccactcagccggacctcgagtgtagggtgggttgttcgggacggaggaccgtaggttcgaccgtctacgggtcacgccgaacggccgtcggcccccgtcggtccacgttcgtcgttccccgtccccg

SEQ ID NO: 162662 - DNA, 597 bp, Homo sapiens
  misc_feature: GYAE6OF02GLVSU.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatataacaaagagaatgagacggccctacgagggactcccgtgagcgtattccgtccggctaacaatgacgagggaacaacgagtacacgttcgaacctatcgaggtggacgtccgaggcaaggaagacggaggctagactatcactcgaccctactcacgccgacctcgaggttgggtagggttgggtcggttcgggacgggtacggaaccgtaaggttcggaccgttcgtacgggtccaacggtacccgaaggtcccgtaccggacccccgttcggttacccaccgttccgttcccggtccccgtccccg

SEQ ID NO: 162663 - DNA, 609 bp, Homo sapiens
  misc_feature: GYAE6OF02ILWST.33.78.H01.1.454.CMB.1.raw
  modified_base (225)..(225): a, c, t, g, unknown or other
  misc_feature (225)..(225): n is a, c, g, or t
tcagtacacacactcacgaccggtgctcgatttagtgtgagtagtttgggtttgggggctgtgggtccaggaggcagaactctgggtgtctcaccatggcctggatccctctacttctcccccctcctcactctctgcacaggctctgcggcctcctacgagctgacacagccaccgtcgtttctgtgtcactgggacagacggccaggatcacctgctctgganatcgcattcgaccaaagcaatacgctttattggtaccagcagaacgccaggcccacggcccctgtactgataatataacaaagagaatgagacggccctcgagggtactcccgtagacgcgtacttccgtccggactacaacgtgacgacgggaacaacgacgtacacgttacgacctagtacgtaggtcggacgtccgaggacaaggaacgacgacggctacgtactactccgactcgaccactcgacgtaccggacctacgtacggttgggtaagggttcgggtcgggttacgggacgggtaacgggaccgtaggtttacggacccggtttaccgacggtcgaacgaccgagtccgtaccgccccgtggtaccacgttcccg

SEQ ID NO: 162664 - DNA, 577 bp, Homo sapiens
  misc_feature: GYAE6OF02IMQBK.33.78.H01.1.454.CMB.1.raw
  modified_base (244)..(244): a, c, t, g, unknown or other
  misc_feature (244)..(244): n is a, c, g, or t
tcagtacacacactcacgaccggtgctcgatttagtgtgagtagtttgggtttggggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgnttattggtaccagcagaagccgacggccacggcccctgtactgaataatataacaaaagagaatggaagacggccctacgacgggactcccgtagacgacgtattccgtccggactaacaactcgacgaagggaacaaacgacgtactaacgttcgaaccgtatacgaggtggacgtaccgaggacaaggaaagacgacgctagaactatactacgtcaccactcgacgccgactgaggtggtaggtggtcggtcggcggaggacgtagtcgaccgtcgtaggcgacgccgaagccgtccgccccgtggtcctacgtcgtccgtccctacccg

SEQ ID NO: 162665 - DNA, 565 bp, Homo sapiens
  misc_feature: GYAE6OF02F23IC.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagcccaccgtcggtttctgtgtcactgggacagacggccaggatcacctgctctggagatgcattgccaaagcaatacgcttattggtaccagcagaagccaggccaggcccctgtactgataatataacaaagagaatgagaggccctagagggatccctagacgcgattcgtccggctacaatgcagggacaacagtcacgttgaccatcagtggacgtccaggcagaagacgagctagactatcactcgccactcagccggacctcgaggtggtaggtgggttcgttcgggacggacgggacctaaggttcgaccgttaccgtagggtccacggccccgaaggtcctaccggtcccccgttcggtacctccgttaccgttcccggttaccccgtccccg

SEQ ID NO: 162666 - DNA, 561 bp, Homo sapiens
  misc_feature: GYAE6OF02IB5M7.33.78.H01.1.454.CMB.1.raw
  modified_base (421)..(421): a, c, t, g, unknown or other
  misc_feature (421)..(421): n is a, c, g, or t
  modified_base (432)..(432): a, c, t, g, unknown or other
  misc_feature (432)..(432): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattcgccaaaagcaatacgtcttattggtaccagcagaacgccaggccacggcccctgactgaataatatacaaagagaatagagacggccctagagggactccctgagcgattccgtccggctaacatgacgagggacaactagtcacgttcgaccagtcaggtgacgtcgaggcagagacgagctagatnacactgccacncaggaccgacctacgaggtaggtagggtgggtcggttcggcgggaggacccgtaaggttcgacccgttacgtacgggtacgacgacccgaacggtcgtacccgtcccccgtcgggttccaccgttcccg

SEQ ID NO: 162667 - DNA, 577 bp, Homo sapiens
  misc_feature: GYAE6OF02FX91C.33.78.H01.1.454.CMB.1.raw
  modified_base (318)..(318): a, c, t, g, unknown or other
  misc_feature (318)..(318): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggatagacggccaggatcacctgctctggagatgcattgaccaaagcaatacgcttattggtaccagcagaagccaggccaggccccctgtactgataatatacaaagagaatgagacgccctnagggactccgtgagcgattctccgctacaatcgcgagggacaacgtagtaccgacgttcgaacctagtacgaaggtggtaacggtacccagggacaaggaagaacggaggcgtagaactactcactcgaccacctacacggacggacctcgaggtgggttagggtgggtcggttcgggcgggagggaccgtaaggtcggtaccggtaccgtacggccacgacccgtaaggccgtccgtccccgtacggtccaccttccg

SEQ ID NO: 162668 - DNA, 760 bp, Homo sapiens
  misc_feature: GYAE6OF02HVW2I.33.78.H01.1.454.CMB.1.raw
tcagtacacacactcacgaccggtgctcgatttagtgtgagtagtttgggtttgggggaaaacctcattcctccctctaaagaagcccctgggagcacagcgcatcaccatggactggacctggaggttcctctttgtggtggcagcagctacaggtgtccagtcccagttccaactggtacaatctgggtctgaggtgaagaggcctgggtcctcggtgagggtctcctgcagtgtctctgggagccgccttcagcacctatcgccactcacctgggtgcgacacggccccccggacgaacgggcttgaggtggagtgggggtatcactccctctcgttcggcactaatacgactaccgccctaactaaatttccaagaacagagtgactaacgttttcgacgtaacgtaactaccgaactaacccgacgtacgtacccaacgtaacgttacgggaaggttaggaacggtaacggtcccgttacggaacctaacgttaccgttacggaaacggtaacccggaaccgggtcccggtttaaattaacgttttaaacccgttagggttaccggtacggtaacggtaaggtaaccgtaaacggtaaaaaccgttgggttaccgggtaccgtaacggtaaacgggtttaccggggtttaaacggggtttacggtaacccggttcccggttacggggaaccccggtaacgggggtaaccccgttacggggttaaccgtaccggtttcccggttccttacccccgg

SEQ ID NO: 162669 - DNA, 817 bp, Homo sapiens
  misc_feature: GYAE6OF02GWWY7.33.78.H01.1.454.CMB.1.raw
tcagtacacacactcacgaccggtgctcgatttagtgtgagtagtttgggtttgggggaaaacctcattcctcctctaaagaagcccctgggagcacagcgcatcaccatggactggacctggaggttcctctttgtggtggcagcagctacaggtgtccagtcccagttccaactggtacaatctgggtctgaggtgaagaggccgtggtccgtcggtgagggtctcctgcagtgtctcgtgggagcgccttcgagctaacctatgccatccaccgtgggtggcgacgaccggcccccggacgaacgggcttggacgtggagtgggggtatcgactcccgtctccgttcggcacgaactacgacgtaccgaccccaactaaactttcgaaacgaactacggaagtacgtagtaaacggttttacgacgaaacgtaactaccgaaaccgaaccctaacgaacgtaccctaaactaaggtacgggtaagtttacgggaacgggtacgtacccgtaacggacctaagttaccgtagtaaaaccgggacaaacccggggtcccgtttaaagtactttaaccggttaggtacgggtacggtaagggtaaacgttaaacgaaacggttaaaaaacttggggttaaccggtaaccggaaacgggtaaaacgggtttttacggggtttttaaaccgggggttttaccggtaaaccggtttacccgggtaacccggggggttaacccggggaaacccggggtttaaccccggtttaaccggggtacccgtaacgggttttccccggttacccgtttaacccccgg

SEQ ID NO: 162670 - DNA, 582 bp, Homo sapiens
  misc_feature: GYAE6OF02JFKRI.33.78.H01.1.454.CMB.1.raw
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
  modified_base (471)..(471): a, c, t, g, unknown or other
  misc_feature (471)..(471): n is a, c, g, or t
tcagtacacacactcacgaccggtgctcgatttagtgtgagtagtttgggtttgggggcgtgtgggtccgaggaggcagaactctgggtgtctcaccatggcctggatcctctacttctccccctcctcactctctgcacaggctctgccggcctcctacgagctgacacagccaccgtcggtttctgtcgtcactgggacagacggccaggatcacctgctcgngganatcgcattgaccaaagcaataccgcttattggtaccagcagaagccaggccaggcccctgtactgactaatatacaaagacgaatgagngccctnaggctccctgacgcgattccgcggtctacgaatcgcgaacgggacaacaggtctacgttcaacctatcgaacgtggactccggagacgaggaaacgagacggctagaacgtactaccgatcgaccacgtacgacgccggacctacgnggtacggtagggttcgggtgttaccgggcggaacgggcgtaaggttcggaaccgttcgtacggtacgacttacccgaaggtctacccggccccgtcggtaccacttcccgg

SEQ ID NO: 162671 - DNA, 624 bp, Homo sapiens
  misc_feature: GYAE6OF02HNR4A.33.78.H01.1.454.CMB.1.raw
  modified_base (245)..(245): a, c, t, g, unknown or other
  misc_feature (245)..(245): n is a, c, g, or t
  modified_base (387)..(387): a, c, t, g, unknown or other
  misc_feature (387)..(387): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgctattgaccaaaagcaatacgnttattggtaccagcagaagccaggccaggcccctgtactgactaatataacaaagagaatgaagacggcctcgaagggactccctagaagcgtaattcctaccggctaacaatgacgagggaacaacgacgtctaacgttanaccaatcgaagtcggacgtccgaaggacgtaacgaaaggacggaggtcctaggaactagtaccaacgttcgaccaccgtacacggccggaccctagacggtagggtacgggtgggtcggttcgggacgggacgggacctaagggttcggacccgttacggtaggtcccgaacggaccctaacgggccgttccgtacccccggtcgttaccaccgttcgttacccggtccctaccccg

SEQ ID NO: 162672 - DNA, 672 bp, Homo sapiens
  misc_feature: GYAE6OF02JSH24.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctcccctctcactctctgcacaggctctgcggcctcctacgagctgacacagccaccgtcggtttctgtgtcactgggacaggacggccaggatcacctgctcgtggacgatgcattgccaaagcaatacgcttattggtaccagcagaagccagccgagcccctgtactgataatataacaagagaagtgaacgacggccctagagggtactcccgtagagcgtattccgtccggctactaagtgacgagggaacaacgagtacgacgtttacgaacctatcgaggttagacgtccgacggcaaggtaacgacggaggtactacggtaactagtaccgactacggacctacctacgacgtccgggtacctacgagggtacgggtaagggttcggggttacggttcggggcgggtaacgggtaacccgttaacgggttacgtacccggttacggttaacgggtcccggttaaacggcccgggaaacggtcccgttacccggtaccccccgttacgggtacccctacgttccccggttacccggttccccccgttcccccgg

SEQ ID NO: 162673 - DNA, 662 bp, Homo sapiens
  misc_feature: GYAE6OF02HER5I.33.78.H01.1.454.CMB.1.raw
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (328)..(328): a, c, t, g, unknown or other
  misc_feature (328)..(328): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattcgaccaaagcaatacgcttattggtaccagcagaagccaggccacggcccctgtactgaataatanaacaaaganaagtgagacggcctgagggactcccngagcgtattcgcggactacatgacgaggacaacgagtacaacgttacgaaccagtcgaggtacggacgtcccgagggacaaggaaacggacgaggactgaactactacacgtcgaccacgtcgaacggccgtaaccgttcgaaggttcgggtagggttcggggtttacggttaccgggggacgggtaaacgggaacccgttaagggttaccggtacccggtttaccgtaacggggtccgtaaccggaccccggtaaagggccccgttcccgggtaccccccgttacgggttaccccgaacccgtttccggttaccccgttccccccgtaccccg

SEQ ID NO: 162674 - DNA, 731 bp, Homo sapiens
  misc_feature: GYAE6OF02I3IK5.33.78.H01.1.454.CMB.1.raw
tcagtacacacactcacgaccggtgctcgatttagtgtgagtagtttgggtttggggggggtccaggaggcagaactctgggtgtctcaccatggcctggatcccctctacttcctccccctcctcactctctgcacaggctctgcggcctcctacgagctgacacagccaccgtcggtttctgtgtcacgtgggacagacggccaggatccacctgcctcgtggagatgctattgaccaaagacaatacgcttagtggtaccagacagaagccgacggccacggcccctgtactgataatataacaaagagaatgagacggccctgagggactccctgacgcgtacttccgtccggacctacgaatcgacgtaagggacaaacacgtacacgttcgaacctataccgaggtcggtaacggtaccgaggtacgaaaggaacggaaccggacggtacgtaacggtaaccttagttaccgtaactacgacccctaaccgttacgaccggacccgggtaacccttacgggtaagggtacggggttaggggttaccggggtttaggggttccgggggaccggggtaacgggtaaccgttaagggttaccggtacccggttaccggttaacggttacccggaaccggtaccccggtaacggggttcccgtaccccggcccccggttaccgggtaccgtacccgttcccggtttacccgttccccccgtaacccccg

SEQ ID NO: 162675 - DNA, 700 bp, Homo sapiens
  misc_feature: GYAE6OF02IP68T.33.78.H01.1.454.CMB.1.raw
tcagtacacacactcacgaccggtgctcgatttagtgtgagtagtttgggtttgggggtgggtccacggaggcagaactctgggtgtctcaccatggcctggatccctctacttctcccctcctcactctctgcacaggctctgcggcctcctacgagctgacacagccaccgtcggtttctgtgtcactgggacagacggccaggactcacctgctctggagatgcattcgaccaaaagcaatacgcttatggtaccagcagaacgccgagccgacggcccctgtactgaataatataacaaagagatgagacggccctagagggactcctggacgcgtacttcgtcccggtactaacgaagttcggaccgtaacgggaacaaacgtacggtacctacgttacgaaccctaatacgtacggtaggacggtaccgagggacaacgggaaagaacgaggcgtacgacgttaagtccaacgttcgaccctaaccgtcgaacggtaccggaccttacgtacgggttacgggtaggggttcggggttcgggtttaccgggacggggtaaacgggaccggttaacgggttacggtacccggtttaccgggtaacggttaccggtaaccggaaccccggtaacgggtcccgtacccgggtccccccggttaggtacccctaccgttccgttcccggttaccccccg

SEQ ID NO: 162676 - DNA, 616 bp, Homo sapiens
  misc_feature: GYAE6OF02IEXWU.33.78.H01.1.454.CMB.1.raw
  modified_base (340)..(340): a, c, t, g, unknown or other
  misc_feature (340)..(340): n is a, c, g, or t
  modified_base (382)..(382): a, c, t, g, unknown or other
  misc_feature (382)..(382): n is a, c, g, or t
  modified_base (423)..(423): a, c, t, g, unknown or other
  misc_feature (423)..(423): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgctattgaccaaaagcaaatacgcttattggtaccagcagaacgccaggccacggcccctgtactgataatatacaaagagaatgagacgccctcgagggactccgtgagcgtattcnccggactacaatcgacaggaacaacgagtcacgttagaccancgtagtggacgtcgaggcaaggaagacgtagactagactanctaactcgacctactcgacgaccgtcctacgtaggtcggtaagggttgggttacggttcgggacgggtaacggtaaccgtaaggtttcgacccggttccgtaagggtccgtaaccggaccccggaacggtcccgtaccggtccccccgttacgggtaccctaccgtttccgttaccccgttcccctacccccg

SEQ ID NO: 162677 - DNA, 557 bp, Homo sapiens
  misc_feature: GYAE6OF02H10YG.33.78.H01.1.454.CMB.1.raw
  modified_base (245)..(245): a, c, t, g, unknown or other
  misc_feature (245)..(245): n is a, c, g, or t
  modified_base (377)..(377): a, c, t, g, unknown or other
  misc_feature (377)..(377): n is a, c, g, or t
  modified_base (430)..(430): a, c, t, g, unknown or other
  misc_feature (430)..(430): n is a, c, g, or t
  modified_base (454)..(454): a, c, t, g, unknown or other
  misc_feature (454)..(454): n is a, c, g, or t
tcagtacacacactcacgaccggtgctcgatttagtgtgagtagtttgggtttggggggggtccaggaggcagaactctgggtgtctcaccatggcctggatccctctacttctccccctctcactctctgcacaggctctgcggcctcctacgagctgacacagccaccgtcggtttctgtgtcactgggacagacggccaggatcacctgcttctggagatgcattgaccaaaagcaatacgntttaatggtaccagcagaagccaggcccaggccccctagtactgataatataacaaagagaatgaagacgccctcgagggactccctgaacgcgtacttccgtccggactaccaagtgacgagggacaaacngtacacgttacgaccatcgagtggactcgaggcaagaagagaggctagactanacactgaccactacgagccgaccngtagtggtagggtggtcgttcggcgggagaccgagttacgaccgtcgaggtcgacgccgaacggcctccgcccgtcggtcctacgtccgtccgtccccgtccc

SEQ ID NO: 162678 - DNA, 531 bp, Homo sapiens
  misc_feature: GYAE6OF02HRE0D.33.78.H01.1.454.CMB.1.raw
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
  modified_base (501)..(501): a, c, t, g, unknown or other
  misc_feature (501)..(501): n is a, c, g, or t
  modified_base (526)..(526): a, c, t, g, unknown or other
  misc_feature (526)..(526): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctccctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccacggccctgtactgataatatacaaagagaatgagaggaccctcgaggactccctagacgcgaattcgtccggactacaagtgacgacgggacaaacacgtcacgttcgaccatcagtggacgtccgaggcagaagacgaggntagactanactactgaccctacacncgacggacctcgagtggtaggtgggtgtcggcggagacgtaagtcgacgtccgtaggcncgaccgaggccgcgccccgtcgtcnctccg

SEQ ID NO: 162679 - DNA, 700 bp, Homo sapiens
  misc_feature: GYAE6OF02IX8PE.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctcccctctcactctctgcacaggctctgcggcctcctacgagctgacacagccaccgtcggtttctgtgtcactgggacagacggccaggatcacctgctctggagatgctattgaccaaagcaatacgcttatggtaccagcagaagccaggccaaggcccctagtactgaataatatacaaagagaatgagacgcctgaagggactcccgtagagcgtaattcgaccggactaacaagtcgacgtaacgggaactaacgacgtactacggttacaacctataccgaggttacggacgtaccgtaaggacctaaggaaacgacggacgtacgtacgtaaacttactacgaccgttacgacctaaccgtcgaaccggtccggtaaccttacggtaacggttagggggttaacgggttggggttaccggttacgggggtacggtaaccggggtaaaccgttaaacgggttccgaaacccgggtttccggtaaacggttccggaaaccggtaccccggtaaacggtccgttaccccggtcccccggttaggttaccccgaccttttcccggtaacccgttcccccccg

SEQ ID NO: 162680 - DNA, 571 bp, Homo sapiens
  misc_feature: GYAE6OF02HSDA9.33.78.H01.1.454.CMB.1.raw
  modified_base (206)..(206): a, c, t, g, unknown or other
  misc_feature (206)..(206): n is a, c, g, or t
tcagtacacacactcacgaccggtgctcgatttagtgtgagtagtttgggtttggggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggntcacctgctctggagatgcattgaccaaagcaatacgcttattggtaccagcagaagccaggccacggcccctgtactgataatataacaaagagaatgagacggccctgagggactcccgtgagcgattccgtccggactacaatgacagggacaaacgagtacacgttcaacctatcgaagtggacgtaccgaaggcaaggaaaggacgaggctagactatcactcgaccactcgacgcggacctgaggtgggtaggtgggtcggttcggcgggacggaccgtagttcgacccgtcgtacggcacggacccgacggcctcccggccccgttcggtcctaccgttccgtccgttcccctacccg

SEQ ID NO: 162681 - DNA, 617 bp, Homo sapiens
  misc_feature: GYAE6OF02IV7HX.33.78.H01.1.454.CMB.1.raw
  modified_base (381)..(381): a, c, t, g, unknown or other
  misc_feature (381)..(381): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgttcggtttctgtgtcacgtgggacaggacggccaggatcacctgctctgtagatgctattcgaccaaagctaataccgcttagttcggtaccagcaaggaacgccgaggccacggcccctgtactgataatatacaaagagaatgagacgcctagagggactccgtagacgtcgattcctccggactaacatgacgaggacaacngtaccacgttgaccctatccgaggtcggtacgtacgaggacaagaacggacgaggctagactataccacgtacgcctactcgacggtacccgacctacgtaggttgggtacgggttgggttcggttaccgggacggggtacggacgtaggttaccggaccgttaccggtaggtacccgtacggacccgtaacgggccgttacccggcccccggttggtaccccgtacgttaccccg

SEQ ID NO: 162682 - DNA, 862 bp, Homo sapiens
  misc_feature: GYAE6OF02JLWZ7.33.78.H01.1.454.CMB.1.raw
tcagtacacacactcacgaccggtgctcgatttagtgtgagtagtttgggtttggggctgtgggtccaggaggcagaactctgggtgtctcaccatggcctggatccctctacttctccccctcctcactctctgcacaggctctgcggcctcctacgagctgacacagccaccggttcggtttctgtagtcacgtcgggacagaccggccagggactccacctgctcgtggagatggctagttcggacccaaaaggccaataaccgtctttaacgttgggtacccagctaagaacgaccgaacggccctaacgggtccccccttaggtaccttacggaacttaaataacgtaacaaaaggaacgaatacggaagaccggtacccgtaggaacgggtacttccccggtagacggacgtaacgtttcccgtaccggtacttaacgaacgttcggaccgaaacggggaacctaaacggtaacgtaccgtaacggtttcggaaacccttagttaccgaacgggtttacggaacgttacccggaaacggtaccgtaaaggaaacgggaacgggtacgggaaccgtttacgaaccgtttaactaccggtaacttacccggaccaaacccgttacggaaccggtacccggtaaccccgttacgggtaaaccgggtttggggtaaaccgggttgggggtttaaccggttccggggtaaccgggggtaacgggttacccgtaacgggtttaccggtaaccccgggttaccggtacggggttacccgaacccgggttacccggaaaccgggttcccggtaacccccgggttaccccccgtttaccgggtacccgtacccgtttaaccccgg

SEQ ID NO: 162683 - DNA, 664 bp, Homo sapiens
  misc_feature: GYAE6OF02G3BZD.33.78.H01.1.454.CMB.1.raw
  modified_base (222)..(222): a, c, t, g, unknown or other
  misc_feature (222)..(222): n is a, c, g, or t
tcagtacacacactcacgaccggtgctcgatttagtgtgagtagtttgggtttggggggggtccaggaggcagaactctgggtgtctcaccatggcctggatccctctacttcctccccctcctcactctctgcacaggctctgcggcctcctacgagctgacacagccaccgtcggtttctgtgtcactgggacagacggccaggatcacctgctctgganatgcattgaccaaagcaatacgcttattgtaccagcagaagccaggccaggcccctgtactgataatataacaaagagaatgagaggccctacgaggatccctgagcgattctccggctacaatcgacagggaacaacagtacacgttgaaccagtcagtggagtccaggcaagaagacgaggactgaaccgtataccaactcgaccactaccgtacggaccggtaaccgtaccgtaaggtcggggttaacggggttggggttacggtttaccggggaccggggtaaacggggaacccgtaaacgggtttacggaaccccggttcccggttaacgggtaaccgtaaccggaaccccgtaaacgggtcccgtacccgggtcccccccgttaccggggttcccgtaacccgttccgttacccgggttacccccgttccccccgg

SEQ ID NO: 162684 - DNA, 643 bp, Homo sapiens
  misc_feature: GYAE6OF02H1LI1.33.78.H01.1.454.CMB.1.raw
  modified_base (449)..(449): a, c, t, g, unknown or other
  misc_feature (449)..(449): n is a, c, g, or t
tcagtacacacactcacgaccggtgctcgatttagtgtgagtagtttgggtttggggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagccaatacgctttattggtaccagcagaagccaggccacggcccctgtactcgataatataacaaagaagaagtgagacgccctcgagggtactcccgtagacgcgtacttcgtaccggactacaagtgacgagggaacaacgagtacctacgttacgacctatccgaggttacggacgtacccgaaggtcgaagaacggacgaggctgaactanacctacgtcaccaccttcgacggccgacctcgaggttcggggtaggttacgggttcgggttacgggcgggtaacgggaaccgtaagggttccgacccgggttaccgtaggtaccgaccggtacccgaacggtccgtccccggtcccccttcgggttacctacccgtttcccgtccccggttcccctaacccccg

SEQ ID NO: 162685 - DNA, 626 bp, Homo sapiens
  misc_feature: GYAE6OF02GPIUM.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctcgtggagatgcattgaccaaagcaaatcgcttattggtaccagcagaagccaggccaggcccctgtactgataatataacaaagagaaatggaagaggccctagagggactccctgagcgattcgccggactaacaatgcgagggaacaacagtcacgttgaccatcagtgacgtccaggcaagaagacgaggctagaactagtacaacgtcgaccacgtcgacgccggtacctgaggtggtagggttgggttcggttcggggacggtacgggtaacctaagggtttcgacccggttaccgttaacgggtccgaaccggtaccccgtaaacgggcccgttacccggtccccccggttacggggtacccctaacccggtttcccgtttacccggttcccccccgtaacccccg

SEQ ID NO: 162686 - DNA, 702 bp, Homo sapiens
  misc_feature: GYAE6OF02GHBT0.33.78.H01.1.454.CMB.1.raw
  modified_base (225)..(225): a, c, t, g, unknown or other
  misc_feature (225)..(225): n is a, c, g, or t
tcagtacacacactcacgaccggtgctcgatttagtgtgagtagtttgggtttgggggttgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctgganatgcattgaccaaagcaatacgcttattggtaccagcagaagccaggccaggccccctgtactgataatataacaaagagaatgagagccctacgagggactcccgtgacgcgtacttccgtcccgggtctaaccaagttcgacggtaagggaaccaaacgtagttaccgaaccgtttcggaaccctagtcgaaggtcgggtacgtaccgaagggaccgtaaggaaacggacggaacgggtcgtacgaacttacactacgttcgaccctaacgtaccacggtccggaccctacggtagggttgggttacggggttcggggttcggttacggggacgggtaacggggtaacccgttacgggttaccgggtacccggttaccggttaaccgggtaccgtaaccggaccccggtaacgggtaccgttacccggtaccccccggttccggtacccgtaccccgtttacccgttacccccgg

SEQ ID NO: 162687 - DNA, 579 bp, Homo sapiens
  misc_feature: GYAE6OF02GRYKE.33.78.H01.1.454.CMB.1.raw
  modified_base (337)..(337): a, c, t, g, unknown or other
  misc_feature (337)..(337): n is a, c, g, or t
  modified_base (363)..(363): a, c, t, g, unknown or other
  misc_feature (363)..(363): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatataacaaagagaagtgagaggccctgagggactcccgtagagcgtattcnccggactacgaatgcgaggacaacgngtcacgtgaccatcagtggagtcgagcagaacgagagctagactatcacgtcaccactcacgtccggacctacgaggtaggtagggttcgggttacggttcgggacgggtacggaaccgaaggttcgaccggtaccgtacggtcgaccgcccgaaggtccctaccggtcccccgttcggtacccgtaccgtccgttacccgttcccctaacccccg

SEQ ID NO: 162688 - DNA, 608 bp, Homo sapiens
  misc_feature: GYAE6OF02IST5H.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagcccaccgtcggttttctgtgtcactgggacagacggccaggatcacctgctctggagatgcattgaccaaagcaatacgcttattggtaccagcagaagccaggccacggcccctgtactgataatatacaaagagaatgagaggccctgagggactccgtgagcgtattccgtccggactaacaagtcgacgaagggacaacacgtcacgttacgaacctatacgagtggacgtccgaaggcaaggaagacgaggctacgacgttatccaacgtcgaccaccgtcgaacgccggtaaccctcgaggttgggtaacgggttgggtacgttcgggacggaacgggtaacctaagggtttcgaaccgttccgtaggttaccacggtacccgtaggtccctaccggtcccccgtacggtacctaccgtccgttccgtacccccg

SEQ ID NO: 162689 - DNA, 870 bp, Homo sapiens
  misc_feature: GYAE6OF02HGQEX.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggttctgtgtcacgtgggacagacggccaggatccacctgctctgggagatgactattgacccaaagtccaaactacggtactttagttcggttaaccagtaccaaggaaaacggcccgaacgggtaccccaacgggtccccccgttacggtaacccgttaggtaaacgttaaaacgttaacgttaaaaccgtaaaaaaggaacggaaaagttagggaaacggaaccggggtcccccgtaacggtaacggggtaccgttaccccgtaacgggtaacggtacgtaccggtttacccgtacccgggtaccttaaaccgaaaggtttcggaccggtaaacgggggaaaccctaaaaccgtaacgttacccgtaaacggtttacggtaacccgtacgtaaccgtaacgggtacgggtaaccggttacccggaaacgggtaacgaacggaaacggaaccggaaggtcgaacgttacgtaacgtaccacgttacgaccctaccgtaccgaacggtacccggacccgtaacggtacggttaggggttaacggggttcgggggtacggttccggggacgggtaacgggaccggttaaggttacccgggtacccggttaaccggttacggtaccggtaccggacccggtaacggtcccgtaccccggtaccccggtccgggttacccttcccgttacccgg

SEQ ID NO: 162690 - DNA, 650 bp, Homo sapiens
  misc_feature: GYAE6OF02GGZDU.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaaagcaaatacgcttagttggtaccagcagaagccaggccacggcccctgtactgataatataacaaagagaatgagacgcctcgagggatcccgtgacgcgattcgtccggactaacaacgtgacgtagggaaccaacgagtctaacgttcgaccagtcgagtacgggacgtaccgtaggacaagaacgacgacggacgtacgtaactaatctacgtgcccaacgtcgaggaccggacccgttcgagggttacgggtagggttcggggttaggttccggggtacgggaacggggactaaacgggtccggttaaccggtccggttaacggtccgaacggtaccccggaaacggtcccgtaccggtccccccgttcggggtccctaccggttcccgttcccggttcccccgtacccccg

SEQ ID NO: 162691 - DNA, 708 bp, Homo sapiens
  misc_feature: GYAE6OF02GNBRR.33.78.H01.1.454.CMB.1.raw
  modified_base (223)..(223): a, c, t, g, unknown or other
  misc_feature (223)..(223): n is a, c, g, or t
tcagtacacacactcacgaccggtgctcgatttagtgtgagtagtttgggtttgggggtgggtccaggaggcagaactctgggtgtctcaccatggcctggatccctctacttctccccctctcactctcgtgcacaggctctgcggccctcctacgagctagacacagcccaccgtcggtttctgtgtcactgggacagacgcaggatcacctgctctgganatgctattcggacctaaagctaaacgtacgtctttagttcggtaccaggcagaacgccgaaggccgaacggtccccctgtactgaataatacgtaacgaaaagtacgtaagtaggacggacggtacccgtacgacgggtaacctcccgtaggacgcgtaactttccggtacccggtactaacgattcgaccgacgggtaacaactacgtaccgtaacgttacgacctagtacaggtggacgtcccgagacgagacggacgcggactaggaccttagtacacgttccgaccgtactcgaacgccggacctcgtaagggtcgggttagggttcgggttacgggttccgggacggggtaacgggtaaccgtagggttaccgtaccggtttaccgtaacgggttaccaacccgggaaccccgtaagggttccctaccgggttccccccgtacgggtacccctacgtttcccggttacccttaccccccg

SEQ ID NO: 162692 - DNA, 790 bp, Homo sapiens
  misc_feature: GYAE6OF02FZYS1.33.78.H01.1.454.CMB.1.raw
  modified_base (293)..(293): a, c, t, g, unknown or other
  misc_feature (293)..(293): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttattggtaccagcagaagccaggccacggcccctgtactgaatntaaaaaaaaaaatcaaaagagaatagaagacggccctacgagggtactccccgtagaggcgtactttccgtaccggtacctaacaagttcggaccgaacgggaaccgaaacgtacggttaccgtaaccggtttacgaacccgtaacttaccgaaggtacgggtaacggtacccggaacgggtacgaaacggaaacgggaaccgggtaacgggtccgtacggtaaccttaacgttaccaacccgttccggaccctaacccgttaccgaaccggacccgggtaacccgttaccggtaagggttacggggttaacgggggttacggggtttacgggtttaccgggggaccggggtaaccgggggtacccgttaaacggggtttaccggtaacccggtttaacccggttaacgggtacccgtaaccggtaccccggtaacgggtcccgttaccccggtacccccccggtttaccgggttaccccgtaaccgtttaccccgg

SEQ ID NO: 162693 - DNA, 676 bp, Homo sapiens
  misc_feature: GYAE6OF02GX7VK.33.78.H01.1.454.CMB.1.raw
  modified_base (221)..(221): a, c, t, g, unknown or other
  misc_feature (221)..(221): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactggtacagacggccaggatcacctgctcnggagatgcattgccaaagcaatacgcttatggtaccagcagaagccaggccaggcccctgtactgataatatacaaagagaatgagacggccctcgagggactccctagacgcgaattcgtccggctaacaatcgacgaggggtaaccaaacgaacgtccaacggtttacgaaccacgttaccaaggtgggaacggtcctagggacaaacggaaacgacggaggaccttaggaaccgtaacttacaaccgttacgcccgtaacctcgtaacggcccgggaaccttccgtaagggttcgggttaacggggtacggggttcggtttaccggggacgggtaacgggggtacctaacgggtttcggtaaccccggttaccgttaacggggtccaacggaccccggtaaacgggtaccgttccggtacccccccggttcgggtaccctaccgtttcccgg

SEQ ID NO: 162694 - DNA, 619 bp, Homo sapiens
  misc_feature: GYAE6OF02GDBD6.33.78.H01.1.454.CMB.1.raw
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
  modified_base (308)..(308): a, c, t, g, unknown or other
  misc_feature (308)..(308): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagcccaccgtcgtttctgtgtcactgggacagacgcaggatcacctgctctgganatgcattgaccaaagcaatacgtnttattggtacccagcagaacgccaggccacggcccctgtactgaataatataaccaaaganaaatgaagacggccctgaagggactcccgtagacgcgattccgtccggtactacaatcgacgaagggaaccaactacgtactacgttcgaaccatcaaggtggtacgtccgaggacgaagaacggacggaggcgtagactactacacgtcgaccactcgtacgccggacctacgtaggttagggttagggttgggttaggtttccgggacgggtaaccgggaccgtaaggttcggtaacccgttccggttacggtaccgacgacccggaacggtcccgtacccgcccccggtacggtcctacgttccccgg

SEQ ID NO: 162695 - DNA, 591 bp, Homo sapiens
  misc_feature: GYAE6OF02FRA4O.33.78.H01.1.454.CMB.1.raw
  modified_base (356)..(356): a, c, t, g, unknown or other
  misc_feature (356)..(356): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagcccaccgtcggtttctgtgtcacgtgggacagacggccaggatcacctgctctggagatgcattgaccaaagcaatacgctttattggtaccagcagaagccaggccacggcccctgtactgaataataataacaaaagagaaatggaagacgaccctacgagggactcccgtagacgcgtattcnccggtctaacaatgacgaggaacaacgagtcacgttcgaaccatacgagtcggagtaccgaggacaaggaacggacggaggcgtacgaactactacactcgaccactacgacgaccggacctacgaggtgggttaggtgggttcgttcgggacgggtacgggaccgtaaggtcgacccggtcgtaacgggtccacggaccgacggcgtccggccccgtacggtccctacgttccg

SEQ ID NO: 162696 - DNA, 679 bp, Homo sapiens
  misc_feature: GYAE6OF02GF2FK.33.78.H01.1.454.CMB.1.raw
  modified_base (227)..(227): a, c, t, g, unknown or other
  misc_feature (227)..(227): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagcccaccgttcggttttctgtgtcacgtgggacagacggccaggatcacctgctcgtgganatgccattcgaccaaagcaataccgtctttagttcggtaaccagtacgaaggaacgccgaacggcccgaacggcccctgtactagaataataataacgaaagaagaagtgaaggacggccctacggaagggtacctcccgtaggacgacgtacttccgtccgtactaacaagtcgacgacgggaacaacgagttacgacgttacgacctatacgtaggtaggtacgtaccgagggacaaggaacgaacggacggtactacgacttagactacgtcgaccgtactcgacggaccgtacgtacgagggttagggttggggttagggttcgggttcgggacgggaacgggtacgtaaggttacgtaccggttaccggtacggtccgaaccggtaccggaacggtcccgtaccggtccccgtacggtcccgtaccgttccgttcccgttacccccg

SEQ ID NO: 162697 - DNA, 830 bp, Homo sapiens
  misc_feature: GYAE6OF02GHRN6.33.78.H01.1.454.CMB.1.raw
tcagtacacacactcacgaccggtgctcgatttagtgtgagtagtttgggtttggggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttatggtaccagcagaagccaggccacggcccctgtactgataatataacaaagagaatggaagacggccctacgagggactcccgtggacgacgtacttccgtccggtactaacgaagttcggaccgaacgggggaaaccaaacgaacggttaccgtaaccggttacgaaacccgtaagttaccgtaaggttacgggaacggttacccgaaggggtaaccgtaaagggaaacgggaaaccgggaacggggtaccgttaacggtaaaccgttaacgtacccgtaaccgttaccggaaccccgtaaccgttaccgaaccgggtacccgggtaacccgttaccggtaacggggtttacgggggttaacgggggtttcggggggtttcggggtttaccgggggtaccgggggtaaacggggtaaacccggttaaacggggtttaccggtaaccccgggttaccggttaacggggttacccggtaaccggaacccccggtaaacgggcccgtttacccgggacccccccggttcgggttaccccgtaacccggtttcccgtttacccggttaccccccgtaaccccccgg

SEQ ID NO: 162698 - DNA, 715 bp, Homo sapiens
  misc_feature: GYAE6OF02JR2BL.33.78.H01.1.454.CMB.1.raw
tcagtacacacactcacgaccggtgctcgatttagtgtgagtagtttgggtttggggggtccaggaggcagaactctgggtgtctcaccatggcctggagtccctctacttctccccctctcactctctgcacaggctctgccggcctcctacgagctgacacagccaccgtcggtttctgtcgtcactgggacagacgcaggactcacctgcttcgtagagatgacagttcgaccaaagcaattacgctttattcggtaccaggacaagaagccaaggaccacggccccttagtacctgaataatactaacgaagaagatagaaggcgacctacgaggactccgtagagtacgtacttccgaccggactaagaacgtggaccgaagggaaccaaacgtacgtacctaacggttacgaacctatacgaagtcggtaaccgtccgaacggcaaagggaacgacggtaacgcgtacggaccttacgaccgtaacgtccgacctaacgtccaaacgggtccggtaccgtacgtaacggttcgggttacgggtcgggttacggtaccggggacggtaaacggggttacctaagggtttaccgacccggtttaggtaaccgggttccggaaccgtacccggtaaaccggtcccgttacccggtaccccgttccggttaccgtaacccgtttccggttacccgttcccccgttaaccccgg

SEQ ID NO: 162699 - DNA, 607 bp, Homo sapiens
  misc_feature: GYAE6OF02FVUX6.33.78.H01.1.454.CMB.1.raw
  modified_base (229)..(229): a, c, t, g, unknown or other
  misc_feature (229)..(229): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgttcggtttctgtgtcacgtgggacagacggccaggactcacctgctctggganatgcattgaccaaagcaatacgcttattgtaccagcagagccagccagccctgtactgataatatacaaagagaatgaagaggcctgaggactcccgtagacgacgacttctaccggctacgaatgacagggacaaacgagtactacggttcgaacctagtaccgagtacggacgtaccgtaggtacaaggtaaacggaacgaaggcctaggaactagtacaacttcgacctaactcgacgccggacccttagacggtagggttagggtgggttcggttacgggcgggaacggtacgtaaggttcggaacccggttacgtaggtaccgtacggacccgtaacggccgtaccgtccccgtcggttacctaccgttcccg

SEQ ID NO: 162700 - DNA, 626 bp, Homo sapiens
  misc_feature: GYAE6OF02JFATP.33.78.H01.1.454.CMB.1.raw
  modified_base (220)..(220): a, c, t, g, unknown or other
  misc_feature (220)..(220): n is a, c, g, or t
  modified_base (460)..(460): a, c, t, g, unknown or other
  misc_feature (460)..(460): n is a, c, g, or t
tcagtacacacactcacgaccggtgctcgatttagtgtgagtagtttgggtttggggggggtccaggaggcagaactctgggtgtctcaccatggcctggatccctctacttctccccctcctcactctctgcacaggctctgcggcctcctacgagctgacacagccaccgtcggttctgtgtcactgggacagacggccaggatcacctgctctgganatgcattcgaccaaagcaatacgcttatcggtaccagcagaagccaggccacggcccctgtactgataatactacaaagagaatgaggacgtcctcgagggtactccccgtgacgcgtattccgtcccggactaacaatcggaccgaagggacaaacgacgtcgaacgttcgaaccatacgagtcgggacgtacccgaggcaaggaacgacggaggcgtagactgtccacgtcacctacncgacgcggtacctcgtaggtcgggtagggtgggtcggttacgggcgggacgggaaccgtagttccgaccgttaccggtacggttccgaacggtacccgaacgggtcccgtcccggtacccccgttccggtacctacccgttcccgttcccggttcccccgtacccg

SEQ ID NO: 162701 - DNA, 695 bp, Homo sapiens
  misc_feature: GYAE6OF02JF4DZ.33.78.H01.1.454.CMB.1.raw
  modified_base (184)..(184): a, c, t, g, unknown or other
  misc_feature (184)..(184): n is a, c, g, or t
tcagtacacacacttcacgaccggtgctcgatttagtgtgagtagtttgggtttgggggtgggtccaggaggcagaactctgggtgtctcaccatggcctggatccctctacttcctccccctctcactctctgcacaggctctgcggcctcctacgagctgacacagcctaccgttggtttcngtgtcacgtgggacagacggccaggatacacctgctcgtggagatgctattcgaccaaaagcctaaatcgactttattcggtaaccagaccaaggaacgccagggccacggcccctaggtaacctgaataactaactaacaaaagagaatgaacgacggacccctagaagggtactaccctaggaactcggatttaccgtaccggaactaacaagtacgacgaacgggaacaaaccgacgttacctaacggttacggaaaccctagtacaaggttacggaagtacccagggaccaagtaaacggacgaaggtactagaactataccgacttcgaccgtactacgaccgccgaaccgtcgtaacggtagggtacgggttaggggttccggttacgggacgggtaacggggtaacctaaggttccgggtaaccgttccggtaaggaccgacgtacccggtaagccgtcccgacccccggtcggtccaacccggtttctaccccggttaccccc

SEQ ID NO: 162702 - DNA, 670 bp, Homo sapiens
  misc_feature: GYAE6OF02IY7TY.33.78.H01.1.454.CMB.1.raw
  modified_base (611)..(613): a, c, t, g, unknown or other
  misc_feature (611)..(613): n is a, c, g, or t
  modified_base (615)..(616): a, c, t, g, unknown or other
  misc_feature (615)..(616): n is a, c, g, or t
  modified_base (618)..(618): a, c, t, g, unknown or other
  misc_feature (618)..(618): n is a, c, g, or t
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
  modified_base (628)..(628): a, c, t, g, unknown or other
  misc_feature (628)..(628): n is a, c, g, or t
  modified_base (631)..(631): a, c, t, g, unknown or other
  misc_feature (631)..(631): n is a, c, g, or t
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
  modified_base (637)..(638): a, c, t, g, unknown or other
  misc_feature (637)..(638): n is a, c, g, or t
  modified_base (642)..(642): a, c, t, g, unknown or other
  misc_feature (642)..(642): n is a, c, g, or t
  modified_base (646)..(646): a, c, t, g, unknown or other
  misc_feature (646)..(646): n is a, c, g, or t
  modified_base (656)..(656): a, c, t, g, unknown or other
  misc_feature (656)..(656): n is a, c, g, or t
  modified_base (661)..(661): a, c, t, g, unknown or other
  misc_feature (661)..(661): n is a, c, g, or t
  modified_base (663)..(663): a, c, t, g, unknown or other
  misc_feature (663)..(663): n is a, c, g, or t
  modified_base (667)..(667): a, c, t, g, unknown or other
  misc_feature (667)..(667): n is a, c, g, or t
  modified_base (669)..(669): a, c, t, g, unknown or other
  misc_feature (669)..(669): n is a, c, g, or t
tcagtacacacactcacgaccggtgctcgatttagtgtgagtagttttgggtttggggggggtccaggaggcagaactctgggtgtctcaccatggcctggatccctctacttcctccccctcctcactctctgcacaggctctgcggcctcctacgagctgacacagccaccgtcggtttctgtgtcacgtgggacaggacggccaggatcacctgctcgtggagatgacattcgaccaaagcaaatacgacgtttattcggtaaccagacgaacgaacgccgaaggtaccccgaacggcccccttaggttacctaggtaaataaaattaaataaacaaaaggaagaaaagtaggaacggacggtacccgtacgaaggggtacttaccccgtagacgtacgtaactttccgaccggtacctaaactaaatcggacgaaggggaaacctaaacgtaagttaccgaaccggtttacgaacccgtaaacttcggaacggttacgggtaaccgtaccggaacggtaaccgaaaggaaacggaacgggaacgggtacgtaacggtaaaccgtaacgttaaccgtaaccgtaccgaacccgtaaccgttaaccccnnnannananananaganagnananannatanacanagtacgaganacgananatanana

SEQ ID NO: 162703 - DNA, 693 bp, Homo sapiens
  misc_feature: GYAE6OF02HVWDG.33.78.H01.1.454.CMB.1.raw
  modified_base (458)..(458): a, c, t, g, unknown or other
  misc_feature (458)..(458): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattcgaccaaagcaaatacgcttattggtaccagcagaacgccaggccacggcccctgtactagaataataataacaaagagaatgagacgccctcgagggctccgtgacgcgtacttcgtccgactaacaatgacgaagggaacaaacagtacctacggtttacgaacctaataccgaaggtacggacgtaccgaggacaaggaacgaacgaggactaggaaccttanacctacgtcgacctaccgtacgacggaccggaccctcggtaagggttacgggttacggggttcggggttacggtttccgggggacggggtaaccggggtacccgttaaacgggttacccggtaacccgggtttacccggttaacgggtacccgtaaccggtaaccccggaaacggggtcccgttaccccgggtacccccccggttacccgggttacccgtaacccgtttccccgg

SEQ ID NO: 162704 - DNA, 647 bp, Homo sapiens
  misc_feature: GYAE6OF02JDQ11.33.78.H01.1.454.CMB.1.raw
  modified_base (229)..(229): a, c, t, g, unknown or other
  misc_feature (229)..(229): n is a, c, g, or t
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
  modified_base (331)..(331): a, c, t, g, unknown or other
  misc_feature (331)..(331): n is a, c, g, or t
tcagtacacacactcacgaccggtgctcgatttagtgtgagtagtttgggtttgggggtgggtccaggaggcagaactctgggtgtctcaccatggcctggatccctctacttcctccccctcctcactctctgcacaggctctgcgcctcctacgagctgacacagcctaccgttcggtttctgtgtcacgtgggacaggacggccaggactcacctgcctcgtggantgctatcgacaaagcaatacgtcttagttcgaccagcagacgcacggccgacgccctgtactagataatanaacaaagaagaangagacgcctagaggtacnccgtagacgacgtcttccgacgactaacgactcgacgacggaacaacgtacgtacgtaacgttcgaacctatccgaggtcggacgtaccgacggtaacaggtaacgacggtacggacgtagaacttacgactaacgcgtaccgactaccgacgtaccgtacctacggtacggtagggttaggggttcgggttcgggttcgggaacgggagggtaaccggttacggtacggtaaccggtaccggtacggttacgaaccggtccggaacgtccgtcccgtcccgtacggttaccgaccgttcggttccccgtaccccg

SEQ ID NO: 162705 - DNA, 781 bp, Homo sapiens
  misc_feature: GYAE6OF02HXEF0.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgccgcctcctacgagctgacacagccaccgttcggtttctgtgtcacgtgggacaggacggccaggatcacctgctcgtggagatgctattcgaccaaagctaagtcgtctttagttcggtaaccgagaccagaaacgccgacggccgacggcccctacgtactcgaattaaactataacaaaagaagaagtaggacggacggccctacggacgggtaccgtacccgtagacgacgtacttccgtaccgggacctaaccaacgtcggtacgaacggggaaaccaacgtacgtacgtacgttacggacctacgtacgaaggttcggaacggttaccgaacgggacgaaggtaaaggaccggtaagggacgttaacgacttaactaaccttaccgtaccgtccaacctaccgaccggacccggtaaccgttaccggaagggttcggggttaaggggtttcgggggtttacgggttcgggggtaccggggtaaacgggtaaccgttaacgggttaccggttaacccggttaccggtaacgggttaaccgaaccggtaaccccggaacggtacccgttacccggtacccccgttcccggggtacccttccgtttacccgttccccgttcccccgttaacccccg

SEQ ID NO: 162706 - DNA, 668 bp, Homo sapiens
  misc_feature: GYAE6OF02FJOOG.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttagttcggtaccagcagaagccaggccacggccccctgtactgataatataacaaagagaatagagacggccctacgacgggactccccgtgacgcgtacttcgtccggactaacatgacgagggaacaacgacgtacacgttcgaccctatccgaggtcggtacgtccgaaggacgaaggaaacggaccggaggtacctagaacctagtaccgtactacgcccgtactacgacggaccggtacctcgagggttgggtacgggttgggttacggttccggggacgggtacgggtaaccgtaagggttccggacccgttaccggtaacggtacccgaaccggaccccggtaacggttcccgtacccggtccccccgttacgggttaccctaccgttcccggttccccggtttcccccgtcccccg

SEQ ID NO: 162707 - DNA, 703 bp, Homo sapiens
  misc_feature: GYAE6OF02HE006.33.78.H01.1.454.CMB.1.raw
  modified_base (225)..(225): a, c, t, g, unknown or other
  misc_feature (225)..(225): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcacgtgggacagaccggccaggatcacctgctctggganatgcattcgaccaaagcaatacgcttattcggtaccagcagaagccaggccacggcccctagtactgaataataataacaaagagaatgagacggccctagagggactcccgagagcgtattccgccggactaacaatcggacgaagggaaccaacgtagtacctaacgttcgaacctatcgaggtaggacgtccgaggacgaagaacggacggaggtactagactacgtacacgtacgacccaacgtccgaaggtacccggacccgttacgtagggttacggggttacggggttggggttacgggttccggggacggggtaaccggggtaaccgttaacgggttaccgggtaacccggttacccgggttaacgggtacccgaaccggggtacccccgtaacgggtccccgtacccgggtcccccccggttacgggttacccctacccggtttcccgttaccccggtttacccccccg

SEQ ID NO: 162708 - DNA, 566 bp, Homo sapiens
  misc_feature: GYAE6OF02FJCMY.33.78.H01.1.454.CMB.1.raw
  modified_base (430)..(430): a, c, t, g, unknown or other
  misc_feature (430)..(430): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatcgcttatggtaccagcagaagccaggccacggcccctgtactgataatataacaaagagaaatgaagacggcctgagggactccctgagcgacttcgtccggactacaatgacagggacaacagtcacgttgaaccatacgagtaggacgtccaggcgaagaacgacgaggctagaactatcgacngccactcagaccgtcctcgagtacgggtagggtgggtaggttccgggacgggacgggtaccgaaggttcgaacccggtccgtaggtccgacgacccgacggtcctcccggtccccctcggtccctaccgttcccgg

SEQ ID NO: 162709 - DNA, 714 bp, Homo sapiens
  misc_feature: GYAE6OF02JDOS0.33.78.H01.1.454.CMB.1.raw
  modified_base (243)..(243): a, c, t, g, unknown or other
  misc_feature (243)..(243): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacagctctgcggcctcctacgagctgacacagccaccgtcggtttctgtgtcactgggacagacggccaggatcacctgctctggagatgcattgaccaaagcaatacgtnttattggaccagcaagaagccaggccaggccccctgtactgaataatataacaagagaagtgaggacggccctcgacgggaacttccccgtagacgtacggtacttccgtccggtacttaacgaaacgtgaccgaaggggaacaaacgacgttccgtaacgtttacgaccgtaactacgtaaggtggacgttaccgacggacgtaaggaaacggacggaggtaccgtagtaaccgttaagtccgtaacgtcgacccgtacgtaaccgacggacccgggtaccttccggtaacgggtcggggttacgggttacgggggttcgggtttaccggggccggggtaaacgggaacccggtagggtttcggacccggttcggtacgggtccgtaccggacccggtaacggtcccgtaccggtaccccccggtgggttacccctacccgttccggtttcccggtcccccgtacccccg

SEQ ID NO: 162710 - DNA, 642 bp, Homo sapiens
  misc_feature: GYAE6OF02FVAGX.33.78.H01.1.454.CMB.1.raw
  modified_base (312)..(312): a, c, t, g, unknown or other
  misc_feature (312)..(312): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgtcggtttctgtcgtcactgggacagacggcaggatcacctgctctggagatcgctagttgacccaaagcaatacgctttattggtaccagtcagaagccaggccacggcccctagtactgataatataacaaaganaatgagacggccctgagggactccctaggagctattccgccggtactaacatcgacgacggacaagcgtcgacgttcgaacctatcgtaggtacggacgtccgaggtaccaaggaaacggaccggaaggtccgtaagtaaccgtacgtactacgtccgaccaccgttacgacgccgggaccttcgtacggtcgggttagggtcggttacgggttcgggacgggtacggggacctaaggtttccgggtaacccgtccgggttaaggtaccgacccggtaacccgtacgggccgttccccggtacccccggtcgttaccgacgtttccccgg

SEQ ID NO: 162711 - DNA, 677 bp, Homo sapiens
  misc_feature: GYAE6OF02I5OCN.33.78.H01.1.454.CMB.1.raw
  modified_base (136)..(136): a, c, t, g, unknown or other
  misc_feature (136)..(136): n is a, c, g, or t
  modified_base (399)..(399): a, c, t, g, unknown or other
  misc_feature (399)..(399): n is a, c, g, or t
tcagtacacacactcacgaccggtgctcgatttagtgtgagtagtttgggttgggggggtaccaggaggcagaactctgggtgtctcaccatggcctggactccctctacttcctccccctctcactctctgcacnggctctgcggcctcctacggagcctgacacacgccctaccggttcggtttctgtcgtaccacgtgggaccaggaccggcctaggactccgacctgcctgtgggatactgctattcgacctaagcctaaagtccggctttaagtcggaaccacgacagaacgccaaggccacggtcccctgttactagataataacgtaacaaaggtagaagtaggacgtcggtaccacggtacggacctcgagcgacttacgtccgtaccgtntaacgcgcgtaacgagtaaccacggtctaccgttacgtaaccgacgtacgtacgtacggtagtaccggtacaacggtcgaaacggaaccggtacgtacgtacgtaataacctacgtccgttaacggaccgtacctaacgccgtacgggtacctacgaccggtaggtttagggtacggtcgggtttaccgacggtacgggtacgtaccgtagtccgtacgttacgtacgtcgacggccgtacgccgtacgaccgtctactccgtacttccgaccctcgg

SEQ ID NO: 162712 - DNA, 729 bp, Homo sapiens
  misc_feature: GYAE6OF02H3L0M.33.78.H01.1.454.CMB.1.raw
  modified_base (160)..(160): a, c, t, g, unknown or other
  misc_feature (160)..(160): n is a, c, g, or t
  modified_base (187)..(187): a, c, t, g, unknown or other
  misc_feature (187)..(187): n is a, c, g, or t
tcagtacacacactcacgaccggtgctcgatttagtgtgagtagtttgggtttgggggctgtgggtccaggaggcagaactctgggtgtctcaccatggcctggatccctctacttctcccccctctcactctctgcacaggctctgcggcctcctacgngctgacacagcccaccgttcggtttcngtgtcacgtgggacaggaccgccgaggactccaccgtgctatggagatgctattgaccaaagcaaagtcgcttagttcggaccagacagaacgccgacggccacggccccttagtaccgtgtaataactataacgaaagagtaatggagacgtcccgtagagggtacctccgtagacgtcgtacttccgtaccggacttaacgactcggacggaaggaccaaacgtcgtaccgtaacggtttacgaacctacgtcgtaacggtgggacgtaccgagggtacaacggaaagggtaccggaggtacgtaacggtactaacgtaccgttaccacgtacccaccgtacgaccgggtaccgtaacccgtggtagggtcggggtttaggggtcggggtttaacgggtccggggaccggggtacgggtaaccggttacggttaccgggtaacccggttaccggtacgggttaaccggacccggtaccggtaaccgtccccggttaccccggacccccggtttaccggtcccgttacccggttcccccgg

SEQ ID NO: 162713 - DNA, 814 bp, Homo sapiens
  misc_feature: GYAE6OF02JY4ZC.33.78.H01.1.454.CMB.1.raw
tcagtacacacactcacgaccggtgctcgatttagtgtgagtagtttgggtttggggggggtccgaggaggcagaactctgggtgtctcaccatggcctggatccctctacttctccccctcctcactctctgcacaggctctgcggcctcctacgagctgacacacgcctaccgtcggtttctgtgtcactgggacaggaccggccaggatacaccgtgctaaacgtggagatgctagttcgaccaaagactaaacgtacgtactttaagttacggtaaccagacgaaggaacgccgaacgggacccaacggtccccccttaggtacctacggtaataaactaaataaaccaaaaggaagaaataggaaggaccggtacccctaccggaacgggtacgtaccccgtggtaacgtacgtacgtttaccggtacccggtactaacgaaagtcggacggaacgggaaactaaacgacgtaccggtaacgtttacgaaccgtaagtaccgaggtacgggacgtacccggagggacaaacggtaaacggacggagaccgttagaacctacgacctaacgtacccgctacccgtacgacggtaccggtacctagggtacggttaggggttaacggggttgggttcgggttaacggggaccgggtaacgggtaaccgtacgggttaccgacccgggttacgtaccgggttaccgaaccgggtccccgttaaacgggtccccgtaccccggggttacccccgtacggggtaccccttaccccggtttacccgtttacccggttacccccccttaaccccgg

SEQ ID NO: 162714 - DNA, 690 bp, Homo sapiens
  misc_feature: GYAE6OF02IQXF2.33.78.H01.1.454.CMB.1.raw
  modified_base (315)..(315): a, c, t, g, unknown or other
  misc_feature (315)..(315): n is a, c, g, or t
  modified_base (330)..(330): a, c, t, g, unknown or other
  misc_feature (330)..(330): n is a, c, g, or t
  modified_base (365)..(365): a, c, t, g, unknown or other
  misc_feature (365)..(365): n is a, c, g, or t
tcagtacacacactcacgaccggtgctcgatttagtgtgagtagtttgggtttggggggtccaggaggcagaactctgggtgtctcaccatggcctggatccctctacttcctccccctcctcactctctgcacaggctctgccggcctcctacgagctgacacagccaccgtcggtttctgtgtcactgggacagcggccaggatcacctgcctcgtggagatgcattggaccaaaagcaatacgtctttagttacggtaccaggcaagaacgccaaggccacggcccctgtactgaatactaatacaaagtanaatgaagagccctanaggtactcccgtagacgacgtacttcgacgctaanaacgtgacgaagggacaaacgtgtactaacgttggaaccctagacgtaggtacggaacggttacccgaaggacgaaggaaacggaaccgaggtactacggtacgttaacaccggtacgtacgtacccgtaactacgtacggaccgtaaccgtacgtaaacggttcggggtagggtcgggttacgggtccgggtaaccgggacgggttaaaccaagggttccgaacccggttacgtacgggtaactaccggtacccgaacggttccgtacccggtccccgtaccgggttacctaccggttaccggttccgttaaccccgtccccgg

SEQ ID NO: 162715 - DNA, 549 bp, Homo sapiens
  misc_feature: GYAE6OF02GGP6K.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgaccaaagcaatacgcttattggtaccagcagaagccaggccaggccccctgtactgataatatacaaagagaatgagaggccctacagggactccctgagcgattctccggactacaatgcagggacaacgagtcacgtttcgacatcagtggacgtccgaggcaaggaagacgaggctaggactagtacactcgccactcagccgactgagtggtaggtggtcgtcgggcggaggactagttcggaccgtcgtaggtcacgtcccgaaggtcctccggccccgttcgggtaccaccgttcgttaccgttcccctaccccg

SEQ ID NO: 162716 - DNA, 739 bp, Homo sapiens
  misc_feature: GYAE6OF02FWC2I.33.78.H01.1.454.CMB.1.raw
  modified_base (285)..(285): a, c, t, g, unknown or other
  misc_feature (285)..(285): n is a, c, g, or t
tcagtacacacactcacgaccggtgctcgatttagtgtgagtagtttgggtttgggggggtccaggaggcagaactctgggtgtctcaccatggcctggatccctctacttcctccccctcctcactctctgcacaggctctgcggcctcctacgagctgacacagcccaccggtcggtttctgtgtcactgggacagacggccaggatcacctgctctggagatgacattgaccaaagcaatacgcttatcggtaccagcagagccaggccaggcccctgtacngataatatacaaagagaatgagacggcctacgagggtactccgtgacgacgtacttcgtccggactaacgaatcggacgaacggggaaccaaacgtagtacctaacggtttacggaaccctaagttaccgaagggtttacggggaaccgttacccgaagggaccaaacggaaacgggtaacggaacgggtcctaacggaacttaacgtaccgaaacctcggacccaacgttccgaacggtcccggaacttccgtaagggttcggggttaacggggtcggggtttacgggttacggggaccggggtaacgggtacccgtaaacgggtttccggtacccggttaccgtaacggggtccgaaccggtaccccggtaaacgggtcccgtaccccgtaccccccggtttacgggtaaccctaccggtttcccgttaccggtttaccccccctaccccgg

SEQ ID NO: 162717 - DNA, 693 bp, Homo sapiens
  misc_feature: GYAE6OF02JKMLN.33.78.H01.1.454.CMB.1.raw
  modified_base (203)..(203): a, c, t, g, unknown or other
  misc_feature (203)..(203): n is a, c, g, or t
  modified_base (273)..(273): a, c, t, g, unknown or other
  misc_feature (273)..(273): n is a, c, g, or t
tcagtacacacactcacgaccggtgctcgatttagtgtgagtagtttgggtttgggggcgtgtgggtccgaggaggcgagaactctgggtgtctcaccatggcctggatccctctacttctccccctcctcactctctgcacaggctctgcggcctcctacgagctgacacagccaccggtcggtttctgtgttcactggganagacggccaggatcacctgctctgggagtatgacattgaccaaagcaatacgacttagttacggtaccancgaacgaacgccgtacggcccgaccggcccccgttagaccttaggaattaaactaagttaaaccgaaaggaacgaaagttaggaacggacggtacccctacgaagggtaactcccgtaggaacggaccggtactttccggccggtactaaccgtaagtcggacgacgggaaaccaacgacgtaccgaccgttcgaacctagtacaacgggtagtagacccgtaaggacccgtaagggaaacgtacggaacggagtaccggaactacgtaccgaacgtcgaccctacgtaccgacggaccgtccctaggtacggtagggtacgggttgggttacgtggggaacgggtacggtacgtaggtacgccggttacgtaggtccgacgtacccgaggtcgccgaccccgtcggaccttacgtcccg

SEQ ID NO: 162718 - DNA, 762 bp, Homo sapiens
  misc_feature: GYAE6OF02IEYV5.33.78.H01.1.454.CMB.1.raw
  modified_base (186)..(186): a, c, t, g, unknown or other
  misc_feature (186)..(186): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (301)..(301): a, c, t, g, unknown or other
  misc_feature (301)..(301): n is a, c, g, or t
  modified_base (508)..(508): a, c, t, g, unknown or other
  misc_feature (508)..(508): n is a, c, g, or t
tcagtacacacactcacgaccggtgctcgatttagtgtgagtagtttggggtttgggggggggtccaggaggcagaactctgggtgtctcacatggcctggatccctctacttctcccctctcactctctgcacaggctctgcgcctcctacgagctagaacacaggccaccggttcggtttttgngtcatgggacaggacgcaggatcacctgctcgtggagatgctatgaccaaaagcaatacgcttaagtggtacaagcagaagccaggccaggccctgtacngataanataacaaanagaagtgaagacggcctacagggactcccgtagagtacgaattccgaccggtctaacgaactgacgtagggaacaaacgtaggccgtaacgttcgaaacccactacgtaaagggtcgggtaacgtacccggtaagggaaccgtaaacggaaacggtaaaccggtagggacttacgggtaacctaacgtaccacgttcgacccgtaanacccggtaagacccggtaccgttaacgtacggttagggggttaacgggttggggttcggtttaccgggggacggggtaaacggggtaacccgggtaaacgttaccggggtacccggttacccgggtaacgggttacccggaaccgggtaccccggaaaccgggtacccgtaccggtaccccccccggtttcgggttaaccccgtaaccgttccccggttccggtttaccccccgtcccccggtttaacccccgg

SEQ ID NO: 162719 - DNA, 771 bp, Homo sapiens
  misc_feature: GYAE6OF02FOC4P.33.78.H01.1.454.CMB.1.raw
  modified_base (179)..(179): a, c, t, g, unknown or other
  misc_feature (179)..(179): n is a, c, g, or t
  modified_base (548)..(548): a, c, t, g, unknown or other
  misc_feature (548)..(548): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtggtttcngtgtcacgtggacagacggcaggactccaccgtgcctcgtaggagtatcgctagttcgaacccgaaagctaaagtaccgtctttagttacggaccagcgaaggaacgccgacggacccgtaccggtcccctagtaacgtagtaacttaaagtaactaaaacgaaaaggataacgtaggaacggtaccggcccctaggagggtacccttcccggtagaccgtacgtactttccggtacccggtactaacgtaacgtcgacggtaacggaacaacgtcggtacctaacggtacaacccgtatacgtagggtacgaccgtaccggaggacgaaggaaccgacggtacgcgtaacactacgtacctaccgacncctacgtacgacccgggtacgacccgttagtacggggttgggttacgggttggggttacgggttaccgggggaacgggtaaccggtaaccgtttaaccgggtcccggttacccgttacggtaccgggtaccgaacccggtaacccgtaccggggtccccttccccggtaccccggttcgttaacccttccggttaccccgttcccccgttaccccctacccgg

SEQ ID NO: 162720 - DNA, 710 bp, Homo sapiens
  misc_feature: GYAE6OF02FWGJF.33.78.H01.1.454.CMB.1.raw
  modified_base (225)..(225): a, c, t, g, unknown or other
  misc_feature (225)..(225): n is a, c, g, or t
tcagtacacacactcacgaccggtgctcgatttagtgtgagtagtttgggtttggggggggtccaggaggcagaactctgggtgtctcaccatggcctggatccctctacttctccccctcctcactctctgcacaggctctgcggcctcctacgagctgacacagccaccgtcggtttctgtgtcacgtgggacaggacggccaggatcaccgtgctcgtgganatgctattcgaccaaagcaatcgcttattcggaccagcagagccaggccaggcccctgtactgattaatataacgaaagagaactgagaggcccctagacggggactccccgtagacgtacgtacttccgtccggtacctaacgaattcggaccgtaagggaaccaaacgtacggtaccgtaacggtttcgaacctaacgtcgaagggtcgggaacgtaccggagggaccaagggaaacggaacggtaacgggtactacggtaacttacgtactaccgtacgacccgaacttacggacggtaccggaccgttacgaagggtttcgggtacgggggtttagggttcgggttaccgggaccggggtaacgggaacccgttaaggttccgggtacccggtacggttacggtccgacggtacccgaacgtacccgtacccggccccgtttcggtaccctacgttccgttacccgttccccgttaccccg

SEQ ID NO: 162721 - DNA, 559 bp, Homo sapiens
  misc_feature: GYAE6OF02HBP49.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttatggtaccagcagaagccaggccaggcccctgtactgataatatacaaagagaatgagaggccctcgagggactccctgagcgattcgtccggctacatgcagggacaacgagtacacgttgaccatacagtggaacgtccgaggcagaagaccgaggctaggactatcactcgccactcgagccggactcgaggtcggtaggtgggttcgttcgggcgggacggtaccgtagttccgaccggttcgtacgggtcgaccgaccgaacggtccgtccgtccccgtcgtccgtactcccgttcggtcccctaccccg

SEQ ID NO: 162722 - DNA, 730 bp, Homo sapiens
  misc_feature: GYAE6OF02HP5E3.33.78.H01.1.454.CMB.1.raw
  modified_base (184)..(184): a, c, t, g, unknown or other
  misc_feature (184)..(184): n is a, c, g, or t
  modified_base (657)..(657): a, c, t, g, unknown or other
  misc_feature (657)..(657): n is a, c, g, or t
tcagtacacacactcacgaccggtgctcgatttagtgtgagtagtttgggtttgggggtggtcaggaggcacgaactcgtgggtgtctcaccatggcctgatccctctacttctcccctctcactctctgcacaggcttcgtgcggccttccgtagagctgacactagccaccgttcggtttcngtgtcacgtgggacaggacggccaggatcacctgctcgtggagatgctattgaccaaagcaatcgctttagtggtaccagcagagtccgaggccgacggtcccctgtactgaagttaactataacgaaagacgaagtggaagacggcctacgagggactcccgtaggacgtacggtaacttccgaccggaccttaaacagttacggacgaaagggtaacaaacggtacgtaacttacggttacgaacccgaagttcgtaaagggtcggtaaccgtaccggaacgggacccaaagggaaacggaacggtaacggtacgtaaacggtaactaacgttacgtaaccgttacgaccctaacgtacgaccgggccgtaaccgttacgaacgggttgggtaacggggttcggttaggggtccggggaccgggtaaacgggtaccgtagggtttaccgcccggtttaacgtcgggtaacnccgggtaaccgtaacgggtcctcccggtaaccccggttcgggtaccctacggttccgtcccggttaacccccg

SEQ ID NO: 162723 - DNA, 738 bp, Homo sapiens
  misc_feature: GYAE6OF02H4YIH.33.78.H01.1.454.CMB.1.raw
  modified_base (140)..(140): a, c, t, g, unknown or other
  misc_feature (140)..(140): n is a, c, g, or t
tcagtacacacactcacgaccggtgctcgatttagtgtgagtagttttgggtttgggggctgtgggtccaggaggcagaactctgggtgtctcaccatggcctggatccctctacttcctcccccctcctcactctctgnacaggctctgcggcctcctacgagctgaccacagccaccggttcggtttcgtgtcacgtgggacaggtccggccaggtactcaccgtgctcgtagggagtattcggctacgttacggaaccaaaaaggccaaagttaccggtacctttaagttacggttaaccagtaccgaaggtaaacgccgacggcccaacggtcccccttaggtactagaattaaactaataaacgaaacgaagtaagtaggaacggacgacccgttacgagggtaccaccgtaggaagtccgttattccccgtacggtactaaacgtaagttcgacggaaacggtaacccaaagtacgttacgtaaccgttagaacccgttatacgaacggtacggaacgttaccgaaaggaccgaaggaaacgtaccggaggtctaagtactaacgtaccgaacgtaccgcctaacgtacgaccgaccggacctacggtaggtacgggttaagggtcgggtttacggttacgggacggaggtaaccgtaggttacgaccgttacggtaacgcgaaccgacccgtaacggtcctacccggtacccctggtacctaccgttcccg

SEQ ID NO: 162724 - DNA, 654 bp, Homo sapiens
  misc_feature: GYAE6OF02GY5XA.33.78.H01.1.454.CMB.1.raw
  modified_base (369)..(369): a, c, t, g, unknown or other
  misc_feature (369)..(369): n is a, c, g, or t
  modified_base (477)..(477): a, c, t, g, unknown or other
  misc_feature (477)..(477): n is a, c, g, or t
  modified_base (491)..(491): a, c, t, g, unknown or other
  misc_feature (491)..(491): n is a, c, g, or t
tcagtacacacactcacgaccggtgctcgatttagtgtgagtagtttgggtttgggggctgtgggtccaggaggcagaactctgggtgtctcaccatggcctggatcccctctacttctcccccctcctcactctctgcacaggctctgcggcctcctacgagctgacacagccaccgttcggtttctgtgtcactgggacaggacggccaggatcacctgctctggagatgctagttcgaccaaagacaatacgtcttagttcggtaaccagacgaagaacgccgacggcccgacggccccttgtacgtagtaataatataacaaagagaagtagacggaacggcccgtacgtaacgggactacccgnggacgacgtacttccgtaccgtacctaacaagtcgacgaaggaacaacgtacgttacgtacgttacgaccgtatacgaaggtcggtaacgcgaggcaaaggacgacgnggtactagacttancactcgacactcgacgtcccgtactcgaggttcgggtagggttgggttgtacgggccgggtaacggtacgtacgggttaccggccggttaccggtagggtaccaccgtacccggacggtacccgtccccggtacccccgttcggtaaccttccccgttcccgg

SEQ ID NO: 162725 - DNA, 734 bp, Homo sapiens
  misc_feature: GYAE6OF02FXBOG.33.78.H01.1.454.CMB.1.raw
  modified_base (181)..(181): a, c, t, g, unknown or other
  misc_feature (181)..(181): n is a, c, g, or t
  modified_base (298)..(298): a, c, t, g, unknown or other
  misc_feature (298)..(298): n is a, c, g, or t
tcagtacacacactcacgaccggtgctcgatttagtgtgagtagtttgggtttggggggggtccaggaggcagaactctgggtgtctcaccatggcctggatccctctacttctccccctctcactctctgcacaggctctgcgcctcctacgagctgacacagccaccgtcgtttctgtntcacgtggacagacggcaggatcacctgctcgtggagatgctattcgaccaaagcaaatcgctttagtcggtaaccagccagaagccaggccacggcccctagtactagaataatanaacaagagtaatgagacgcctacgacgggactcccgtagaggccgtattccgtccggactaacaacgttgacgtaacgggaaccaacgtacgttaaccgacggttacaaccctaagtacgaggtacggtacgtaccgaagggtacgaaacggtaaacggacggaacggtccgtaacgaaaccgttataacccgtacggtaccaacctaccgtacggaacccggccgggttaaccaccggttaggtacggggttacggggttcgggttccgggttaacgggcggggaaacccggtaacttaacggggttcggacccggtttaccgtacgggtaacccgaacgggacccccgtaacggggtccccgtttaacccggcccccccgttgggtaaccccgttaccgttcccgtttaccccggttaaccccccttcccccgg

SEQ ID NO: 162726 - DNA, 692 bp, Homo sapiens
  misc_feature: GYAE6OF02JTRKY.33.78.H01.1.454.CMB.1.raw
  modified_base (223)..(223): a, c, t, g, unknown or other
  misc_feature (223)..(223): n is a, c, g, or t
tcagtacacacactcacgaccggtgctcgatttagtgtgagtagtttgggtttggggggtccgaggaggcagaactctgggtgtctcaccatggcctggatccctctacttcctccccctcctcacctctctgcacaggctctgcggcctcctacgagctgacacagcccaccgtcggtttctgtgtcacgtggacaggcggcctagactccacctgcctcgnggagatcgctagttcgaccaaagtcaagtccgtactttatcggtaacccagacagaacgccgaggccgaccggcccctgtactagataactaataacgaaagacaagtagagtacgacccgtagacggtatcccgtgtacgccgtattccgtccgacgtacaacgtgaccgaaggtaacacgtacgtacaaccgttgaccctagtacgtacgtaacggacgaacgtacggacgaaggaaccgaacggtcggtacgtacgtaccgtaacgtacccgtacgtctaaccccgaccgttacgaccgtacccgtcgtaacggtcggttacggtacgggttgggtaacccgggttgaaccgggtacggtaacgtccggtaccgtaccggtaccgtggtaccgaccgtacggaccgtcccgtaacccggttcccgtccggttaccgtaccgtcccgttccccgtaccccgtacccg

SEQ ID NO: 162727 - DNA, 834 bp, Homo sapiens
  misc_feature: GYAE6OF02HY49M.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagacggccctacgagggactcccgtgacgcgattccgtccggactacgaaatcggacgaacgggaacaaacgacgttacaccggtttacgaaccctaagtaccgaagggttacgggacggttacccgaagggtacccgaaagggaaaacgggtaccgggaacgggtaccgtacggtaaccgttaaactacccgtaaaccgtcggtaaccccctaaccgttacccgaacggtaccccgggggtaaacccttccggtaaacggggtttcgggggttaacgggggtttcggggggttttacgggttacccggggggtaccggggggttaaacggggtaaaccccgttaacggggtttacccgggtaaccccgggtttcccggtttaaacgggggttaccccgaaccggggttaacccccggtaaaccggggttccccgttacccccgggtccccccccggttttaaccggggtaccccgttaacccccgggtttcccggttttaccccgggtttccccccccggttaaccccccgg

SEQ ID NO: 162728 - DNA, 969 bp, Homo sapiens
  misc_feature: GYAE6OF02JJ2KI.33.78.H01.1.454.CMB.1.raw
  modified_base (164)..(164): a, c, t, g, unknown or other
  misc_feature (164)..(164): n is a, c, g, or t
tcagtacacacactcacgaccggtgctcgatttagtgtgagtagtttgggtttgggggggtccaggaggcagaactctgggtgtctcaccatggcctggatccctctacttctccccctctcactctctgcacacggctctggccgccctcctacgagctgacncagccctaccgtcggttttctggtgtccacgtggggacaggtaccggccaggactccgacctcggctcggtaggagagttcgctaacgttcgaaccaaacgtccaaagttaccgtactttaagtcggaacccaggacctaaggaacgacccgaaggtaccccgtaacggccccttaggtaacctaggtaaacttaaaacgttaagaaaccgaaaaggtaacgtaaacggttacggtaacggggaccgtacccgttaacggacgggttaacccgtaccccggtaggtaccgggtaaccgtttaacgttcccggtaaccccggtaactttaaacgaacggttcgggaaccgtaaaccggggaactaaaaccggtacgggttcctaaacgggtttaacccgtaaccgtaagtacccgggttaagggtcgggttaacccggaaccgtaacgggaaccggtaaacgggtaaccgggaaccgggtaaccgggtaacggttaaccggttaaaccgtaaaccggtttccggaaaccgttcccgggtaacccttaaccgggtcccggtaaacccgggtacccggttaaccccgttaggggttaacccgggtttagggggtaccggggtttacccggggttaggggttcccgggggtaaacggggtaccggttaaacggtaaccgggtttcccgggtaacggtttacccggtaacgggtccgtaaacccgggtacccggttaaccggtaccgtaaccccggttcccgtaccggtaaacccgtccggtttaccctaccccggtaccccgttacccg

SEQ ID NO: 162729 - DNA, 756 bp, Homo sapiens
  misc_feature: GYAE6OF02H8DOP.33.78.H01.1.454.CMB.1.raw
  modified_base (155)..(155): a, c, t, g, unknown or other
  misc_feature (155)..(155): n is a, c, g, or t
  modified_base (223)..(223): a, c, t, g, unknown or other
  misc_feature (223)..(223): n is a, c, g, or t
  modified_base (527)..(527): a, c, t, g, unknown or other
  misc_feature (527)..(527): n is a, c, g, or t
tcagtacacacactcacgaccggtgctcgatttagtgtgagtagtttgggtttgggggggggtccaggaggcagaactctgggtgtctcaccatggcctggatccctctacttcctcccctctcactctctgcacaggctctgcgcctcctacgngctgacacagccaccggttcggtttctgtgtctacgtgggacaggaccggccaggatccactgctcgnggagatgctagttcgaccaaaggactaatacgtcttagttggtaccagaccaaggaacgccgacggccgacggtccccctagtacgtagaattaaataactaacgaaaagtaacgaagtacggaggacggtcccctacggacgggtactcccgtaggacgtcgtacttcgtccggactaacgtagtcggacggaacgggacaacgtacggtactacggttacgaccctagtccgtaaggtcggacgtccggacggacgaacggaaacggacggacggtagtaccgtaataccgtactacgtacncctacgttccgacggtaccggtaccgttaggtaacggggttgggttaacgggggttcgggttacgggttacggggaaccgggtacgggtaaacccgtacgggttaccggtacccgggttacggtaccgggtccgtaaccggtaacccgtaacccgggtccgtccccgggttaccccgttccgggtacccttacccggtttccgtttaccccgtcccctttaacccccgg

SEQ ID NO: 162730 - DNA, 953 bp, Homo sapiens
  misc_feature: GYAE6OF02I0QF3.33.78.H01.1.454.CMB.1.raw
  modified_base (187)..(187): a, c, t, g, unknown or other
  misc_feature (187)..(187): n is a, c, g, or t
tcagtacacacactcacgaccggtgctcgatttagtgtgagtagtttgggtttgggggtgggtccaggaggcagaactcctgggtgtctcaccatggcctggactcctctacttctcccctctcactctctgcacaggctctgccggcctcctacgagctgacacagcccaccgttcggtttctgtntcgacgtgggacagaccggccaggtactccgaccgtgcctcgttagggacgagtcgcttaggttacgacccgaaagtcctaacgttaccgtactttacgttacggtacctaggaccgtaagggaacgtcccggaacggacccgaccggtaccccccggttaggttaaccgtaggtaaccgttaaatttaacggaaccgaaacggtaagaacggtttacgggaccggttaaccggcccccgttagggtaacgggttacccttacccggttaggtaacgtacgttacgtttcccggaccggttaaccgttaaacgaaccggttagaacccggtaacggtaaaccgtaaccttaaccggttacccgttaacggtttaccgaaaccgttacgttacccggtaaaggtccggggtaacgttaaccccggaacggggaacccgtaaaacgggtaagggaacccggttacgggaaaccgttccgggtaaaaccctttaggccccgtttaaacggtacccgttacccttaaccggtacccggtaaaccggggtaacccgtcccgttacggggttaccgtttacggggggttaggtccggggtttaaccggtttcgggggaaccggggttaacggtaacccgggtttaaggtacccggttacccggttaacccgggtcgggttaaccaccggggtttaacccgacggtttccccgggttacccaccccgggtttccggtaccccgtaccgtttacccgttcccgttaaccccccg

SEQ ID NO: 162731 - DNA, 624 bp, Homo sapiens
  misc_feature: GYAE6OF02J2YFH.33.78.H01.1.454.CMB.1.raw
  modified_base (181)..(181): a, c, t, g, unknown or other
  misc_feature (181)..(181): n is a, c, g, or t
  modified_base (221)..(221): a, c, t, g, unknown or other
  misc_feature (221)..(221): n is a, c, g, or t
  modified_base (249)..(249): a, c, t, g, unknown or other
  misc_feature (249)..(249): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
tcagtacacacactcacgaccggtgctcgatttagtgtgagtagtttgggtttgggggctgtgggtccaggaggcagaactctgggtgtctcaccatggcctggatccctctacttctcccctctcactctctgcacaggctctgcggctcctacgagctgacacagccacgtcggtttcngtgtcactgggacagacggccaggatcacctgctctgganatgctattcgaccaaaagctaataccgnttaattggtaaccagtcagaacgcctaggccaggcccctggtactgaataatactaacgaaagnaatcgaagnggcccctgacgggtactccctgacgcgtactcgtccgctacaagtcgcgaagggtcaaacgtgtacacgttacgaccctagtacctaggtcggtacgttacccgaagggtcaaacgggtaaacggacggaacggtcctcggaacttaacgctaacgtcgacctcgtacgcggaccggtactcgtaggtcggtaggtcgggtcgttcggacggggtaacgtaccgtaaggttcggtaacccgtcgtaacggtccgacggacccgagggaccctccggtccccggtaggttaccacgttcccgg

SEQ ID NO: 162732 - DNA, 761 bp, Homo sapiens
  misc_feature: GYAE6OF02FM6DL.33.78.H01.1.454.CMB.1.raw
tcagtacacacactcacgaccggtgctcgatttagtgtgagtagtttgggtttggggggggtccaggaggcagaactctgggtgtctcaccatggcctggatccctctacttctccccctcctcactctctgcacaggctctgcggcctcctacgagctgacacagccaccgttcggtttctgtgtccacgtgggacagacggccaggatccacctgctcgtggagatgactattgaccaaagctaaagtaccgtatttagttacggtaccaggcaagaagccaaggcccacggcccccttgacctgattaatactaacgaaagagaatggagacggccctagacgggaacttccccgtaggacgtccggtaactttccgtacccggaccttaaccgaagtcgggaccgaaaggggacccaaaacgtacggttaccgtaacggtttaccgaaccgtaacttaccgaagggttacgggaacgtacccggaagggtacgaaacgggtaaacggaccggaggaccgttacggtaacctacgtccaccgtacgaccctactacgaccggaccggtacctacgtacgggtacgggttagggttcggggttacgggttaccggggcgggtaacgggtaaccgtaacgggttaccgggtacccgtaccggttacgggacccgtaacggtacccggaacggtcccgtacccgggtcccccgtccggttacccgtacccgtttccgtttaccccggtcccccttaccccg

SEQ ID NO: 162733 - DNA, 810 bp, Homo sapiens
  misc_feature: GYAE6OF02JFLQN.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgccggcctcctagagctgacacagccaccgttcggtttctgtcgtcactgggacagacggccaggactcacctgctcgtaggagtatggacctaagttcgacccaaaaggtcctaaaagtaccgttcgtttaagtttcgggttaacccagacaagaaacgcccgaagggccccgaaccgggtcccccccgttaggttaacccgttacggaaagttaaacgttaacttaaaaccgaaaaaaggaaaccggtaaaagttacggaaacggtacccggtaaccccgttaaccgggtaacggggtaaaccgtttaccccccggttaggaacggtaccggtaagttttccccgtaacccggtacctaaacgtaacgtagacgaacgggaacaaacgacgtaccgtacgttagaaccctagtacgacggtaaggtacgtaccgaggacaaacgtaaggaacgacggacgtcgaacgttacctacgacttaccgactaaccaccgagtacccgggtacctaacggtcgggttaaccggggtgggttagggtaccggtttacggggacgggacccggtaacggttaacggtcggtaacccgtaggtttacggacgtaccggaccgttacggacccgtacccggtcccggtacccggttgtccccgttaacccg

SEQ ID NO: 162734 - DNA, 683 bp, Homo sapiens
  misc_feature: GYAE6OF02FK9FG.33.78.H01.1.454.CMB.1.raw
  modified_base (489)..(489): a, c, t, g, unknown or other
  misc_feature (489)..(489): n is a, c, g, or t
tcagtacacacactcacgaccggtgctcgatttagtgtgagtagtttgggtttggggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctcgtggagatgacattcggaccaaagacaactacgtcttagttacggtaccagcaagaagccgaggccacgaccccgtagtactacgataaatactaacgaaagaagaagtagacgacggaccctaggacggtactacccgtagacgtacgtacgttccgtccggtctaaacaatcggacgaacgggacaaacgtacgtactacgtttacgacctataccgtaggtacggacgttaccgaaggtcgaaggaacggtacggaacgacctagacctntaaccacgtacgacccgactacgacggtacccgacgtacgtaggtacgggttagggtcggggttacggttacgggcgggaaacggtaacgtaagggttccgacccggttacgtacggtaccgaccgtaaccgacggtacccgtccggtaccccgttcggtaccctaccgttccgtcccgttaccccgtaccccg

SEQ ID NO: 162735 - DNA, 863 bp, Homo sapiens
  misc_feature: GYAE6OF02G2LHP.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatcccctctacttcctccccctcctcactctctgcacgaggctctgccggcctcctacgagctgacacacgccaccgttcgttctgtgtcacgtggacaggaccgaccgaggactccaccgtcgctcgtaggagagtcgactagttcgaccaaagacaacttacgtactttagttacggtaccagacaaggaacgccgacggacccgacggtacccctagttaaccgtagtaattaactaactaaacgaaagaacgtaagtaggaacggtaccggtccctacggaacgggtacctcccgtaggacgtacgttactttcccggtaccggactaacaagtcgacggaacggaacaacgtacgtaccgtacggttaccgacgtagtacgtagggtacggtacgtacccggaaggacgaaacggaaacgggaccggacggtacgtaacggtaacgttaaccgttaccgtaaccgttaccgtaccctaaccgttaccggaacccgggtaaccccggttacccgtacgggtaacgggggttttacgggggtttacggggggttacgggggttttccggggtaaacccggggggtacgggggtaacccggggttaaccgggttaaacgggttttacccgggttaacccccgggttaaccggtttaaaccgggtacccggaaccccgggtacccggttaacccggttccccggtaccccccgggtacccccggtttaccggttaccccgttaccgtttaccccccgg

SEQ ID NO: 162736 - DNA, 904 bp, Homo sapiens
  misc_feature: GYAE6OF02HCNI8.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctctcactctctgcacaggctctgcggcctcctacgagctgacacagccaccgtcggtttctgtgtcacgtgggacagacggccaggactcacctgctctggagactgcattcggacctaaagctaaataccgtactttaattcggtaacccaagtccgaaagaacggacccgacgggaccgtaacgggcccccttaggtaacctaggaataaacttaataaacgtaaaaggaacgtaagtagaacggaacggtccctacggaacgggtactccccgtaggaacggtacgtacgttacccgtaccggtactaactaacgtacggaacggaacgggtaaccaaacgtacgttacgaacgttaccggaacctaacgtcgtaagggtcgggttaacgcccgtaaacgggacgaaacggaaaacgggttaccgggtaaacggtaccgttaagggtaaaccttaacgttaacccgaacgttaccggtaaaccccttcgttaaacccgtacgggtaaccccggttaaacccgtacggttaacggggtttacccgggggttaaagggggtttccggggtttaccggggttttacccggggggaaccgggggttaaaccggggtaacccgtttaaagggttaccccggttaaccccgggttttacgggtaaaccgggtaacccggttaacccgggaaccccggttaagggttacccccgtacccggtttacccccccgggaccggtttaccggtaacccccggtttttcgtaccccgggtttaaacccccccg

SEQ ID NO: 162737 - DNA, 701 bp, Homo sapiens
  misc_feature: GYAE6OF02FP06M.33.78.H01.1.454.CMB.1.raw
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccgaggccacggcccctgtactgataatatacaaagagaatgagacgccctagagggtactcccgtgacggcgtacttccgtccggactaactaagtcggacgaagggaaccaacgtacgtacctacggtttacgaacctatcgagttaggacgtccgaggacgtaaggaacggacggaaggacctagaaccttatccgtaacgtcgtaccctacttaccgaccggtccggtacctacggacgggttaggggttacggggttagggtttacgggtttcccggggacggggtaaccgggtaaccgggttaaacggttccgggttaacccggttccgggttaacgggttcccggaaaccggttaccccgaaggtccccgtcccggtacccccggttccgggtaccctacccggttacccgtttcccggtttacccccccg

SEQ ID NO: 162738 - DNA, 648 bp, Homo sapiens
  misc_feature: GYAE6OF02IQPJT.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagcccaccgtcggtttctgtgtcactgggacaggacggccaggatccacctgctctggagatgctattcggaccaaaagcaaataccgtcttagttcggtaaccagcgaagaagccaggccaggccctgtactgataatatacaaagagaatgagacggcctacgagggatcccgtgacgcgacttctccgactacaatcgacgaagggacaacacgtactacggttcgacctatacgtagtaggacgtccgaggacgtaagaacgacggacggacgtacgtaactactacacgtacgtaccctaacctacgacggtaccggacctacgtacggttagggtacggggttacgggtggtttaccggggacgggtaacgggtaccgtaaggttaccgggtaaccggttaccggtacggttaccgaaccggacccggtaacggccgtacccggtcccccggtacggtacccgtacttccccgg

SEQ ID NO: 162739 - DNA, 847 bp, Homo sapiens
  misc_feature: GYAE6OF02FOR42.33.78.H01.1.454.CMB.1.raw
  modified_base (201)..(201): a, c, t, g, unknown or other
  misc_feature (201)..(201): n is a, c, g, or t
tcagtacacacactcacgaccggtgctcgatttagtgtgagtagtttgggtttgggggaaaacctcattcctcctctaaagaagcccctgggagcacagcgcatcaccatggactggacctggaggttcctctttgtggtggcagcagctacaggtgtccagtcccagttccaactggtacaatctgggtctgagtgaagnggctgggtcctcggtgagggtctcctgcagtgtctctgggagcgccttcacggaccaccgttatcgacctactaccaccgtggggtcgccgaacgaccgggccccccggaacgtaacggggtccttgggacggtggggtacggtgggggggtacttaccgacgttcccgttccgttcttcgggtactaaccgtaagttaccgttaacgtacccgtacccctaaaccgtaaacttttaccgaaacgactaacggaggttcgacgttaaaggttttccgaacgaaacgtaacgtaccgtaaacccgaaccgtaacctacgtaaccaccgtacggttacgggtaaacgttacggtaacgggaacgttacccgtaagtaccgtacgtacgtaacggaaacgtaaccgtaaccgggacccgtttaaagttaaccgtttacgtaggtttaccgggaacgttaggaacgtttaacgtaaacccgtaaaaggttaacgggttacgggaccggtaacggttaaacggttacgggggttttaaacgggtttacgggttaacccgttcccggggtaccgggttaaccccgggttaaacccggggtaccgggttacccggtttacggttaaccggttcccggttacccgtttacccgg

SEQ ID NO: 162740 - DNA, 732 bp, Homo sapiens
  misc_feature: GYAE6OF02JM7DP.33.78.H01.1.454.CMB.1.raw
  modified_base (224)..(224): a, c, t, g, unknown or other
  misc_feature (224)..(224): n is a, c, g, or t
tcagtacacacactcacgaccggtgctcgatttagtgtgagtagtttgggtttgggggggtccaggaggcagaactctgggtgtctcaccatggcctggatccctctacttcctccccctcctcactctctgcacagctctgcggcctcctacgagctgacacagccaccgttcggtttctgtgtcactgggacagacggccaggactcaccttgctcgagganatgctattgaccaaagcaactacgtctttatggtaccgagtaccgagaacgccgacggaccacggtcccctgtaaccgttgaactaataataaccgaaaagacgtaaagtaggaacggaaccggtcccgtacggaaggggtacctacccggtacggacgtacgttaccttacccggtcccggaccttaaccgaacgttacggacggaaccgggaactaaaccgtcggtacctaacggttaccgaacctaagtcgtaacggtcgggtaaccgtaccggaacgtaccgtaaagggaaccgtaacggtacggtacgtacgaccttaacgtccgacgtcgacccgtacgacgtacggaccgaccgtacgtagggttcgggtaggtcgggttcggtaccgggtacgggaacgtaccgacggttaccggaccgttaccgtaagggtccgaaccgttacgaacggtccgtcccggacccgttacgacccttacggtcccttacgtcccctaccgg

SEQ ID NO: 162741 - DNA, 643 bp, Homo sapiens
  misc_feature: GYAE6OF02HE7BY.33.78.H01.1.454.CMB.1.raw
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
  modified_base (377)..(377): a, c, t, g, unknown or other
  misc_feature (377)..(377): n is a, c, g, or t
tcagtacacacactcacgaccggtgctcgatttagtgtgagtagtttgggtttgggggaaaacctcattcctcctctaaagaagcccctgggagcacagcgcatcaccatggactggacctggaggttcctctttgtggtggcagcagctacaggtgtccagtcccagttccaactggtacaatctgggtctggaggtagaagagccgtgggtcctcggtgagggtctccgtgcagtgtctcgtgggacgcgtccttcacgctacctatcgccatccaccgtggtcgccgacacggcccccgganaacgggctggagtggaggtgggggtatcnctccctctctcgcacaatactagaccgcctaacaattacgaanacaaggacgtgtacgtaacgtttcgaacgaaactaagtaaccaaaccgtaccacaccgtaccaactagtaggtagttggaaggacgtacctagactagtacgtagaacgtaccgacgtacctatacgttcgtacggtgcggagtaagacgtaactaaacgtggtaggtacgtagtaacgggtttgggtttaacgggttacgtaccggtccggtcggggacccgtacgggtacccggtggtacccgttacgttccgtccttacccgg

SEQ ID NO: 162742 - DNA, 763 bp, Homo sapiens
  misc_feature: GYAE6OF02HFSB5.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctcccctcctcactctctgcacaggctctgcggcctcctacgagctgacacagccaccgtcggtttctgtgtcactgggacagacgcaggatcacctgctctggagtatgcattgacaaagcaatacgctttagttcggtaccagcgagaagccgaggccacggcccctgtactgaactaagtaataacaaagtaacgaaagtggaacggacggccctacgaacggggtactcccgtaggacggaccgtacgttccgtaccggaccttaacgtaaagtcggacgaacgggtaacctaaacgtacgttaccgtaacgtttacgaaccgtagtacgacggtacggtacgtaccgaggacgaaggaacgtaacggacggctacgtaactataccgaacgttccgacctaacgtccgaacgtcccggtaaccctggtaaacggttcggggtacgggttacggggttcgggtttaccggggaccggggtaaacgggtaacccgtaagggttaccgggtaccccggttaccggtaccgggttacccgaaccgggtaccccggtaaaacggtccccgttacccgggttacccccccggttcggggtaacccctttaacccgggttccccgtttacccggttaaccccccttacccccgg

SEQ ID NO: 162743 - DNA, 798 bp, Homo sapiens
  misc_feature: GYAE6OF02H40JN.33.78.H01.1.454.CMB.1.raw
  modified_base (228)..(228): a, c, t, g, unknown or other
  misc_feature (228)..(228): n is a, c, g, or t
tcagtacacacactcacgaccggtgctcgatttagtgtgagtagtttgggtttgggggggtcaggaggcagaactctgggtgtctcaccatggcctggatccctctacttcctccccctcctcactctctgcacaggctctgcggcctccgtacgagctagacacacgccaccggtcggtttctgtgtcacgtgggacaggacggcaggactcacctgctcgtagganatcgctattcgaaccaaagctaatacgtctttagttcggaccagcaagaacgccgacggaccgaccggtcccctagtactagtaattaaattacaaacgaaagaagtaaacgtacggaacgaccggcccgtacggaacggggtaccttaccccggagacggtaccgttacgttccgtacccggtactaaacgtacgtacgggaacggaacgggaaacaacgtacgttacgtaacggttacaacctacgtacgagggtacggtacgtacccggaaggaccgaaaggaacggaacgggtacggtacgacgtaaccttaacgtccttaacggctaacccgaccttcggaaccggtacccggtacctcgggtagggttagggtttcgggggttgggttaccggggttccggggaacgggtacgggtaaaccggtttcggtaaccggttacccgggtttaacggtccgggttaaccggacccgggacccggttaaaccggtcccgttcccccggtcccggttaccgggttaccttaccccgggtttccgtcccccggtttaccccctaaccccgg

SEQ ID NO: 162744 - DNA, 961 bp, Homo sapiens
  misc_feature: GYAE6OF02HB53W.33.78.H01.1.454.CMB.1.raw
  modified_base (223)..(223): a, c, t, g, unknown or other
  misc_feature (223)..(223): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacagctctgcggcctcctagagctgacacagcccaccgttcggtttctgtgtcacgtggacaggacgccaggactcacctgctcgtggagntgctatcgacaaagctaagtcgtactttagttcggtaacccagacaaggaacgacccgacggacccgacggtcccccgttacgtaaccgtagaaactttaaaacgtaaacgttaaaacgaaaaacggaaaggttaaagtaacgggaacgggtaacccgggtacccccgttaaccgggaacgggggtaacccttaccccggttacggacggtacccggttaaccgtttccccgtacccgggtaaccttaaacgaaacggttcgggaacccggtaaaacggggaaccctaaaccggtaacggttaaccgtaccggtttaaccgaaacccgtacgtaccgttagggtacgggtaccgtcccgaagggaaccgaaagggaacggtaacggacggttaccgtaacggtaaccttaacttccgaaaccgtacccgtacccgtaaccgtaccgggtaaccggtacccggttaaccgttaccggggttaacgggttacgggggtttaagggggtttaccggggtttacgggggtttaacccggggaaccgggggttaaaccgggttaaacccgttaacggggttacccgttacccggggttaaccggttaccgggtaaaccccggtacccgggttaaccccggggaaccgttaccccggtaccccccgggttaccccggttacccgggtttacccttaacccccgggtttcccccgtttaccccggtttacccccccgttaccccg

SEQ ID NO: 162745 - DNA, 760 bp, Homo sapiens
  misc_feature: GYAE6OF02HEXXR.33.78.H01.1.454.CMB.1.raw
  modified_base (222)..(222): a, c, t, g, unknown or other
  misc_feature (222)..(222): n is a, c, g, or t
tcagtacacacactcacgaccggtgctcgatttagtgtgagtagtttgggtttgggggggtccagggaggcagaactctgggtgtctcaccatggcctggatccctcgtacttcctcccctcctcactctctgcacaggctctgcggcctcctacgagctgacacagccaccgtcagtttctgtgtcactgggacagacggccaggatcacctgctctgganatgcagttcgaccaaagcaatcgctttattggtaccagcagaagccaggaccaggcccctgtactgataatagtacaaagagaatgaagacggccctcgagggtactccctaggacgcggacttccgtaccggacttaacaaagttcggaccgaaggggaaccaaacgtacgttccgaaacgtttcgaacctactcgaagttacggaacgtccgaggactaacggaaacgacggaacggacttaggaacttaacgtacctaacgtcgaccctaaccgttacgaacggtacccggaacccgttacgtaacgggtttacggggttaacggggttttcggggtttacgggtttaccgggggtaccggggtaacggggtaacccgttaagggttacccgggtaacccgggtttacccgggttaacgggttacccggtaaaccgggtaacccccggtaaacggggtcccgttacccgggtacccccccggtttacgggttaccccgtaacccgtttcccggttacccgttttaacccccccgg

SEQ ID NO: 162746 - DNA, 814 bp, Homo sapiens
  misc_feature: GYAE6OF02JP3BR.33.78.H01.1.454.CMB.1.raw
tcagtacacacactcacgaccggtgctcgatttagtgtgagtagtttgggtttgggggcgtgtgggtccaggaggcagaactctgggtgtctcaccatggcctggatccctctacttctcccctcctcactctctgcacaggctctgccggcctcctacgagctgacacagccaccggttcggtttctgtagtcacgtggacacgacggccaggatccaccgtgcctacgtcggagtactgacctagttacggacccaaaaggtcctaaacgttaccgtaccgtttaagttacgggttaacccagaccgaacggaaacggcccgttaagggaccccgttaaccggcccccccgtttaggtaaccttaggtaacttaaacttaacgttaaaacgaaaaacggtagtaaagtacggaacgggacgtaccccgttaacggacgggtaaccttccccgttagggtaaccgaccggttacgtttacccggtacccggttaacaaccgtaaacggtttcgaaaccggtacgggaaacccgtaaaccgtaccggtttaacgtaacccggtttaacgaaacccgtttacgtaacccgtagggtttaccgggaacgggttaaccccgagggttaaacccgaagggtaaaaccgtacggggtaacggtaccgttaagtacgtaaccttacggacctcggtacccacacgaccggtactacccgtggtaaggttgggtacggttgggtacggccgggtaagggacgacgtagtcgtacgtacgtgccgacgtacgcgtccgccgtcccctacggtcacggttccc

SEQ ID NO: 162747 - DNA, 759 bp, Homo sapiens
  misc_feature: GYAE6OF02FP85E.33.78.H01.1.454.CMB.1.raw
  modified_base (505)..(505): a, c, t, g, unknown or other
  misc_feature (505)..(505): n is a, c, g, or t
  modified_base (537)..(537): a, c, t, g, unknown or other
  misc_feature (537)..(537): n is a, c, g, or t
tcagtacacacactcacgaccggtgctcgatttagtgtgagtagtttgggtttggggggggtccaggaggcagaactctgggtgtctcaccatggcctggatcccctctacttcctccccctcctcactctctgcacaggctctgccggcctcctacgagctgacacagccaccgttcggtttctgtgtcacgtgggacagaccggcaggactcactgctcgtggagatgctattcgaacaaagacaatacgtcttagttacggaccagacaagaacgccgtacggccaccggcccctgtactagtaactaataataaacgaaaggaacgtaagtaggacggaccggtacccgtacggacggggtaccttccgtaggaacgcgttacgttcccgtaccggtactaaacacgtacggaccgaacgggaacctaaacggtacgtaccgtaacgttaacgacctattcggaagttagggaacgtcggagaacgaacggaacgtaacgnggtactacggactactaccgctcgaccgtacncgtaacggtccgaacgttaggtagggtttaaggggtcgggttacggggttacgggttaccgggggaacgggtaccggttaaccggttaacggttcccgggttaccgttcccgggtaacggtaccgaaccggttacccgggaaccggttcccgtaccccggtaccccggttaccggttacccgtacccgtttacccgtttaccccggtacccccttaccccgg

SEQ ID NO: 162748 - DNA, 670 bp, Homo sapiens
  misc_feature: GYAE6OF02FTV8L.33.78.H01.1.454.CMB.1.raw
tcagtacacacactcacgaccggtgctcgatttagtgtgagtagtttgggtttgggggaaaacctcattcctcctctaaagaagcccctgggagcacagcgcatcaccatggactggacctggaggttcctctttgtggtggcagcagctacaggtgtccagtcccagttccaactggtacaatctgggtctgaggtgaagaggcctgggtcctcggtgagggtctcctgcagtgtctcgtgggagcgccttcagccacctatcgccatccaccgtgggtgcgacacggcccccggacgaagggcttgagtggagtgggggtatcgactccctctctcggcacaatacacgtacgccaactaaactttcaagacagagtgactaagtttcgacgtaacgaatacaaacgaccacacgtaccaacacgtggtagttaggaggacgcctagactatcgtagaacgacgaacggtccgtaagttacttactagtcggacgaagagtaactaactaaaacggttggtacgggaccggtacgtaaaacgggtttacgggggttttaacggggttttacggttaacccggttacccgggttacggggggtaacccggtaaccggggtaaccccggttcgggttaaccgtacggtttacccggttcccttaccccgg

SEQ ID NO: 162749 - DNA, 591 bp, Homo sapiens
  misc_feature: GYAE6OF02G6UCA.33.78.H01.1.454.CMB.1.raw
  modified_base (309)..(309): a, c, t, g, unknown or other
  misc_feature (309)..(309): n is a, c, g, or t
  modified_base (458)..(458): a, c, t, g, unknown or other
  misc_feature (458)..(458): n is a, c, g, or t
  modified_base (574)..(574): a, c, t, g, unknown or other
  misc_feature (574)..(574): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacagctctgcggcctcctacgagctgacacagcccaccgtcggtttctgtgtcactgggacaggacggccaggatccacctgctcgtggagtatgcagttcgaccaaagcaacgtacgtacttagttaggtaccaggacaagaacgaccgtagccgacggcccctgtactagataanaactacgaaagagaagtagagacggtcctacgaggtactacctagagtcgtagttccgccgtatacagtcgacgaagggacaacgtagtcacgttacgaactacgtcgagtggtacgtaccgaggcgaagacgacggagtctagactanacacgtcgacctcgtacaggtccgacgtcgacgtagggtggtcggtgttacggagggtacgtacgtaggtccgaccgtcgacgtcacgcgtaacgccgtccgcccgtcaccgtacncgttaccgcccgtaccc

SEQ ID NO: 162750 - DNA, 834 bp, Homo sapiens
  misc_feature: GYAE6OF02JVGWS.33.78.H01.1.454.CMB.1.raw
  modified_base (88)..(88): a, c, t, g, unknown or other
  misc_feature (88)..(88): n is a, c, g, or t
  modified_base (185)..(185): a, c, t, g, unknown or other
  misc_feature (185)..(185): n is a, c, g, or t
tcagtacacacactcacgaccggtgctcgatttagtgtgagtagtttgggtttgggggtgggtccaggaggcagaactctgggtgtcncaccatggcctggatccctctacttctccccctctcactctctgcacaggctctgcggacctcctacgagcctgacacagcccaccgttcggtttcngtgtccacgtgggaacaggaccggtaccaggactccaccgtggcctcgtagggatacttggacctagttgaccgaaaacgtctaaacgttcgtaccttaagttacggtaacccagacacgaacggtccaacgggtcccaaccggtcccgttacgtaacctggtaacttaaagtaactaaccgtaaaacggtaggaacttaggaacgttaccggcccgtaacgagggtaacctacccctggtaacggccgttacgttaccgtacccggtaccttaaccggaaagttccgaaccggtaacggggtaaccctaaacggtaacgtacccggtaacgtttcgaaacccgtacgtacgttacggtacggaccgttaccgacgggtacaaagggtaaccgtaacgggttaacgcgtaacggtaactacgttaacctaacgtccggtaccgtaaccgtacgtaccgggaaccgttaccgtaacggttaccgggttacgggttaacggtcggggtttaaccggtttccggggaaaccggttaaccggggaactttacgggtaccgtacccggtacggtcgggtaaccgtaaccgacccggtaacgtcccgtacccgcccggttaccgttacgtaccgttacccggtcgttacccccgg

SEQ ID NO: 162751 - DNA, 768 bp, Homo sapiens
  misc_feature: GYAE6OF02JEXQK.33.78.H01.1.454.CMB.1.raw
  modified_base (156)..(156): a, c, t, g, unknown or other
  misc_feature (156)..(156): n is a, c, g, or t
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
tcagtacacacactcacgaccggtgctcgatttagtgtgagtagtttgggtttgggggaaacctcattcctcctctaaagaagcccctgggagcacagcgcatcaccatggactggacctggaggttcctctttgtggtggcagcagctacaggtntccagtcccagttccaactggtacaatctgggtctgaggtgaagagcctgggtcctcggtgacgggtctccgtgctagtgtcctgtgggganccgccttcgacgcaacctntcgccatccaccgtggtcncgacacggcccccggagaacgggcttgacggtggacggtagggggtatccgactccgtctcgttcgacacgtaactacgagtaccgcctaacgtaactttaccgaaacgaccgtaagacgttcgaccgttaagtttccggacgtaaaccgtaataccggtaaaacccgaccgtaacgtaccgtacccgaacctaaggttacgggtaaacggtttaggaacgggtacgtaccgttaacggtacgtaacgttacgtaacgggaaacgtaccgtaaaccgggtacccggtttaaagttaacccgtttaacggttacggtaacggttaccggaaacggtaacggtaacctaaacggtaaaaacgttcgggtaacggtaccggtacgtaaacgggttcgggtttaacggttaccggtacgttcccgggtacgggtacccggtaacgggtacccgtcggtaccgtacgttcccggttacccgtacccg

SEQ ID NO: 162752 - DNA, 913 bp, Homo sapiens
  misc_feature: GYAE6OF02HIOSE.33.78.H01.1.454.CMB.1.raw
  modified_base (236)..(236): a, c, t, g, unknown or other
  misc_feature (236)..(236): n is a, c, g, or t
tcagtacacacactcacgaccggtgctcgatttagtgtgagtagtttgggtttgggggaaacctcattcctcctctaaagaagcccctgggagcacagcgcatcaccatggactggacctggaggttcctctttgtggtggcagcagctacaggtgtccagtcccagttccaactggtacatctggtctgaggtgaagaggcctgggtcctcggtgagggtctcctgcagtgtctntgggagcgccttcagcacctatcgccatcacctgggtcgacgaccgacggtcccccggacaacggggcttaggaggtgggacgtgggggggtactcgaacgtcccctcgttccgtttaccgggacctaacgtaacttaaccgtacggttaaccggacccccaaacgtaaaaccgtttttaccgaaaaccggtaactaacgggtaacggtttacgaacgtaaaccgggttttttacggaacccggtaaaacggtaaaaccgttaacccggaaaaacccggaacccctaaccgtaaaccgttaaccccgtaaaccgtaaaccgttaggggtaacggttttacggggaacgggttaacccggtacccgtttaaggaccgtaaccgttaccggtttaaggaaacggtaaaccgtaaaccggggtaccccgttaaacgtttaaccgtttaaaccggttacgggtttacggaaccgggtaacgtaaacggtacgttaaaccgtaaaaagtttcgggtacgggtacccgtaaacccggttaaagggtttacggggttttaacggggtttaacggttaacccggttaccgggttacccggggggtaacccggttaaccgggggtaaacccgggttaccgggtttacggttaacccgtttaccgggttacccgtttaacccccggg

SEQ ID NO: 162753 - DNA, 654 bp, Homo sapiens
  misc_feature: GYAE6OF02JGZ1C.33.78.H01.1.454.CMB.1.raw
tcagtacacacactcacgaccggtgctcgatttagtgtgagtagtttgggtttgggggaaaacctcattcctacctctaaagaagcccctgggagcacagcgcatcaccatggactggacctggaggttcctctttgtggtggcagcagctacaggtgtccagtcccagttccaactggtacaatctgggtctgaggtgaagaggcctggtcctcggtgagggtctccgtgcagtgtctcgtgggacgccgtcttcgagcctaccgtatcgccatccaccgtggtgcgacgacggccccgacgaacgggctacggacgtgggaggtggggtactcgacgtcctcgtcgtcggcacaatacagtacgcctaacgaattacaagtacagacgtgacgtaacgtttacgacgtaaacaagtaccgaacgaacctacgacgtaccacgtacgtaggtacgtaggtacggtacgaccgtacgaacgtacgttcgtaacgaacgtaaccggaccgaacgttaggttaacttaacgtcgtacgtacggacgtaacgtaagtacgtaaaagtggtacgacgacgtaaggttacgggtttacggtagtaccgtcggttacgggacgtaccggtacgtcggtacgcgttccgtccgttacccgg

SEQ ID NO: 162754 - DNA, 555 bp, Homo sapiens
  misc_feature: GYAE6OF02GF33F.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttatggtaccagcagaagccaggccaggcccctgtactgataatatacaaagagaatgagagccctcagggatccctgacgcgattctccggctacaatgcagggacaaacagtcacgtttgaccatcagtggagtccaggcagaagacgaggctagacctatcactcgacctactacagccgacctcgagtggtaggtgggtcgttcggcggtaagggaccgaacgttcggaccgttacgtaggtcacggtcccgaaaggtcctacggccccccgtacggtaccctaccgtcgttccgttacccctaccccg

SEQ ID NO: 162755 - DNA, 683 bp, Homo sapiens
  misc_feature: GYAE6OF02JPBD2.33.78.H01.1.454.CMB.1.raw
  modified_base (190)..(190): a, c, t, g, unknown or other
  misc_feature (190)..(190): n is a, c, g, or t
  modified_base (239)..(239): a, c, t, g, unknown or other
  misc_feature (239)..(239): n is a, c, g, or t
  modified_base (279)..(279): a, c, t, g, unknown or other
  misc_feature (279)..(279): n is a, c, g, or t
  modified_base (298)..(298): a, c, t, g, unknown or other
  misc_feature (298)..(298): n is a, c, g, or t
  modified_base (314)..(314): a, c, t, g, unknown or other
  misc_feature (314)..(314): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacgaggctcgtggcgcctcctacgagctgacacacgccaccggttcggtttcngtcgtacacgtgggacacggacggccaggactcgaccgtgctcgtggantgctagtcgaccaagcatcgtcttatcgaccagcagaacncacggccacggtcctgacngtataatatacgaaanagtaatgacggacgtacctagacggtacctccgtagacgactagttcccgggtccgtactaacgagtcggaacgtacggtaaccaacgtacgtacgtacgtacgtaaccacgtacgagttacgtacggacgacggtacctaaggacgtacggaacgtcgtactaacgtctaccgacgtacacctaccgacgacggtaccgacctaggggttaccggtagggttaacggggtcggttaaccggtcggggtaaccggtaacgggacggttacgggtcgggttaacccgacggttaccggtaacgacccggtaccggtaaccgggtcccgtacccggtaccccggttaccggtaccgttacccgttacccgg

SEQ ID NO: 162756 - DNA, 770 bp, Homo sapiens
  misc_feature: GYAE6OF02HZ61C.33.78.H01.1.454.CMB.1.raw
  modified_base (183)..(183): a, c, t, g, unknown or other
  misc_feature (183)..(183): n is a, c, g, or t
tcagtacacacactcacgaccggtgctcgatttagtgtgagtagtttgggtttgggggtgggtccaggaggcagaactctgggtgtctcaccatggcctggatccctctacttctccccctcctcactctctgcacaggctctgcggcctcctacgagctgacacacgccaccgtcggtttcngtgtcactgggacagaccggccaggactcaccgtgctcgtggagatgctattcgaaccaaaagctaaataccgtctttaagttcggtaaccagacgaacgacgccgacggccgacggtcccctagtactagtaaataaattaataaaccaaagaacgaagtaggaacggaccggaccctagacgggtactcccgtaggacgacgtacttccgtccgactaacgaatcggacggtaacggaacaacgtacgtacgtacgttacgaacctatacggtaggtacgggtacgtacccggaaggacgaaggaaacgacggacgggtactacgtaactaactacctaaccgtacgtaccctaacgtaccgaaccggtacccggtaaccgtacggtaacggggttaggggttaggggttacggggtttacgggtaccgggggtaacgggtaacggggtaaccgttaaagggttacccgtacccggttacggtaaccgggtaacccggtaccggaacccggtaacggtccccggtacccggttcccccggttaccggttaacccgtacccgttaccccggtacccgttacccccg

SEQ ID NO: 162757 - DNA, 808 bp, Homo sapiens
  misc_feature: GYAE6OF02JK7XS.33.78.H01.1.454.CMB.1.raw
tcagtacacacactcacgaccggtgctcgatttagtgtgagtagtttgggtttggggggggtccaggaggcagaactctgggtgtctcaccatggcctggatccctctacttcctccccctcctcactctctgcacaggctctgtcggccctcctacgagcctgaccacgacgccctaccggttcggtttctgtacgtcacgttgggacacggacggaccaggtactccaccgtgcctggtaggacgtagtcgactacgttcggaaccaaacgtactaaacgttacgtacgtttaacgttaccggtaccaacgacgaacgacggaccgacggaccgtaccggtacccgtacgtaccgtagtaacgtaaacgtaacgtaaacgaaaggtaacgtaaggtacggaacggtaccggtaccggtacggtaacggtaccgttccggacggtacggtacgttaccgttaccgtaccggtaacctacgtacggtaccggaacggtaaccggacctaaccgtaacggtaccgtaacgtaccgtaaccgtacgtacggtacggtaccggtacgtacggaacggaacgaacggacggacgtacgtacgtacgtactacgtacgtaccgtacgtactaccgacgtacgtaccggtacgtacggtacggttacgggtacgggtcggttacgggacgggtaccggtaacgggtaccgtacgtaccggttccgtacggtaccggtaccgtaccggaccgtaccgtacccgtcccggtacccgttacgtacccgtccgtttacccgttcccgtacccgtaccg

SEQ ID NO: 162758 - DNA, 803 bp, Homo sapiens
  misc_feature: GYAE6OF02JGYOH.33.78.H01.1.454.CMB.1.raw
  modified_base (180)..(180): a, c, t, g, unknown or other
  misc_feature (180)..(180): n is a, c, g, or t
tcagtacacacactcacgaccggtgctcgatttagtgtgagtagtttgggtttggggggggtccaggaggcagaactctgggtgtctcaccatggcctggatccctctacttctccccctctcactctctgcacaggctctgcggcctcctacgagctgacacagccaccgtcggtttcngtgtcactgggacagacggccaggatcacctgctcgtggagatgctattcgaccaaagcaagtacgtcttagtggtaaccagactaaggaacgccgaacggcccacggtcccccgtagtaacctaggtaataaacttaacgtaacgaaaacggaacgtaagtaggtaacggtaaccgggtaccctacggaacggggtaccttcccgtaggaccggtacgtacgttccgtaccggacttaaccgaagtacgacggaacgggaacaacggtacgttacgaacggtttacgaccctagtaccgtaggtaccgggtacgtacccgaacgggtacgaacggaacggtaacggtacggacgttaacgaaccgtacgttaccgtacgtaacctacccgtacgtaaccggaccggtacccggtaaccgttaccggtaagggttaccggggttaggggttacggggttaccggttaccggggacggggtaaaccggttaaccggtaacgggtttacccggtacccggttaccggtacggttaacccgaaccggtacccggtaaccggtccgtacccggtcccccgttacgggtaccctaccggtttcccgttccggttacccccgtacccgg

SEQ ID NO: 162759 - DNA, 684 bp, Homo sapiens
  misc_feature: GYAE6OF02F1D1D.33.78.H01.1.454.CMB.1.raw
  modified_base (182)..(182): a, c, t, g, unknown or other
  misc_feature (182)..(182): n is a, c, g, or t
tcagtacacacactcacgaccggtgctcgatttagtgtgagtagtttgggtttggggggggtccgaggaggcagaactctgggtgtctcaccatggcctggatccctctacttctccccctcctcactctctgcacaggctctgcggcctcctacgagctgacacagccaccgtcggtttcngtgtcacgtgggacagacggccaggatcacctgctcgtggagatgctattgaccaaagcaatacgcttagttggaccagacacggaagccaggacccaacggcccccttagtaccgttaggaattaaactaacttaaacgaaaaggtaacgaaataggaacggaacggtacccgttacgaacgggtacttccccgtagacggcgtaacttccgtccggacttaacgaacgtgcgaagggaaccaaacgacgtacgaacgttcgaaccatcgaggtcgagtccaggacacgaaaggacgagacgtgaactacgtacgtacacgccgtaacgtcgacgtaccggaccttcggaaacggttggttacggggtcgggttacgggttccgggaccgggaaacgggtaccgtagggttaccggtacgtcccgtaaggtccgaacgacccggaaggtccgtacccggtccccggtacggtccgtacttcccgtccgttccccgtccccg

SEQ ID NO: 162760 - DNA, 763 bp, Homo sapiens
  misc_feature: GYAE6OF02I3NMS.33.78.H01.1.454.CMB.1.raw
  modified_base (205)..(205): a, c, t, g, unknown or other
  misc_feature (205)..(205): n is a, c, g, or t
  modified_base (252)..(252): a, c, t, g, unknown or other
  misc_feature (252)..(252): n is a, c, g, or t
tcagtacacacactcacgaccggtgctcgatttagtgtgagtagtttgggtttgggggaaaacctcattcctcctctaaagaacgcccctgggagcacagcgcatcaccatggactggacctggagttcctctttgtggtggcagcagctacaggtgtccacgtcccagttccaagtggtacaactcgtggtactgaggtgaagnggcctgggtcctcgggtgacgggtctccgtgactaggtgtctacggngggacgccgtccttacgacgtacctaccgtatcgcctactacccgtaccggttggggtcgaccgtaaccgaccgggcccccggtaaagacgggttcctaggtacgggtaggacggggttcggggtactccgttacccgttcccgtacgtccggtcggacctaaacgtaacgttaacgaccggttaacccacccgttaaataaacgttacaacggtaaccgaggtaccgtagacgttacgttaccaaggtaaacgactacccgaaacacccgtaagtaccgtaccgaacgttaggtacggtacgtagtaacggacgttcgtaacgacgtcgtaacgtacggaaaccgtccgtaacggtacgttacgtactaaccggttgaacccgtagtaacggaactaataccggtaaagtcggaacgacgtaacgttagggtcggttacggtaacgtcctaccgggggaccgtacgggtaaccgtccggtagggtaccctaccggttgtcccgtaacccg

SEQ ID NO: 162761 - DNA, 711 bp, Homo sapiens
  misc_feature: GYAE6OF02GBLAZ.33.78.H01.1.454.CMB.1.raw
  modified_base (192)..(192): a, c, t, g, unknown or other
  misc_feature (192)..(192): n is a, c, g, or t
tcagtacacacactcacgaccggtgctcgatttagtgtgagtagtttgggtttgggggctgtgggtccaggaggcagaactctgggtgtctcaccatggcctggatccctctacttctcccccctctcactctctgcacaggcctctggcggcctaccgtacgagctgacacgagcccaccgttcggtttcngtcgtcacgtgggacaggaccggccaggactccacctgcctcgtgggacatcgacttagtacgaccaaaagtcctaaagttaccgtactttaagttacggtaaccaagacgaacggaacgacccgtacgggccccgaacgggtccccccttaggtaaccgtaaggtaacttaaacgttaacgaaaaccgaaaaggtaacgtaaaccgtaggaaccggtaacgtacccgtacggaacgggtacctaccgtacgacgtaaccgttacgttccgtccggtaacctaacgtaaggtcgaacggtaaacggaaccgtaaacgtcggttaccgtaacgttcgaacgtacgtacgtacggtagtaccgtacggtacggacgtaacggaacggagacgcgtaagttacgtactacgactcgacctacgcgacgaccgtctagtcgggtaggtggtcggtcggtgggaacgtacgacgtacgtacggacgtcgtacggcacgcgacgtcgcccgccgtcgctcgtccg

SEQ ID NO: 162762 - DNA, 663 bp, Homo sapiens
  misc_feature: GYAE6OF02GAXCS.33.78.H01.1.454.CMB.1.raw
  modified_base (179)..(179): a, c, t, g, unknown or other
  misc_feature (179)..(179): n is a, c, g, or t
  modified_base (298)..(298): a, c, t, g, unknown or other
  misc_feature (298)..(298): n is a, c, g, or t
  modified_base (472)..(472): a, c, t, g, unknown or other
  misc_feature (472)..(472): n is a, c, g, or t
tcagtacacacactcacgaccggtgctcgatttagtgtgagtagtttgggtttgggggggtccaggaggcagaactctgggtgtctcaccatggcctggatccctctactctcccctcctcactctctgcacaggctctgcggcctcctacgagctgacacacgccaccgtcggtttcngtgtcacgtgggacagaccggccaggactcacctgctcgtgggagatgctattcgacaaagcaatcgtacttagtcgacagcagacgcgacggcctacgcccctagtactgaacttaanactaacgaaagagtaataggacgacggtcccgtacgacgggtactccgtagacgtcgtacttccgtccgtactacgatcggacgaggtacaacgtcgtacgtacgtcacctgtccgaagtcggaccgtccaagggacctaagggaaccgaagtcgacgttacgaacctagtccncgtacgacccgtactaaccggagtcccggtaccttagtaacgggtgggttaggggttccgggttggtaaccggggcgtaacgggaaccgttacggttcgaaccggttcgtacggaccacggtacccgacggtcctaaccccgggtccccttaggtaacccccggttttacccacccgggtttcccctaccg

SEQ ID NO: 162763 - DNA, 899 bp, Homo sapiens
  misc_feature: GYAE6OF02G31UH.33.78.H01.1.454.CMB.1.raw
  modified_base (219)..(219): a, c, t, g, unknown or other
  misc_feature (219)..(219): n is a, c, g, or t
tcagtacacacactcacgaccggtgctcgatttagtgtgagtagtttgggtttgggggctgtcgggtccaggaggctagaactcgtgggtgttcgtcgaccatggcctggatccctctacttctccccctctcgactcctctgcacaggtctctcgccggcctctacgagctcgaccacacgtcccaaccggttcggtttactgtgtacacgtgggacncgaccggcaggactcaccttgcttacgtagggaacgatcgacctacttcgaaccgaaaggacctaaacgtcgtagttaacgttacgggtaaccaagtaacctaacggtaacgtccgtaacgggaccgtaaccgggtaacccctaggttaactacgggtaaactaaacgttaaccgtaaaaccgaaaacgttaacggtaaacgttacggtaacggtaccggtaacccgttacggaaacggggttaaccgttaaccccggttaagggaacgggtaccggttaacgtttacccggtacccgggtaactaaaccgtaacgtacggtaaccggaacggaaaccgtaaacgtacggttaaccgtaaccggttacgaaaccgtaacttaccggaacgggttaccggaaacgttacccgaacgggtaaccgaaaacgggttaaacggtaaccggaacgggtacccttaaggttaaaccgtttaacttccgtaaacttaccgggaaccctttaccggtaacgtaaccggaccggtaaccgttagaaacgggttacgggttaaacggggttcggtaacggttccggggaacgggtaacggggtaccgtaagggttaccgtacggtaaccgtacgtaacggaaccgtaaccgaacggttcacccggtacccgttcgtacccttacgtccgg

SEQ ID NO: 162764 - DNA, 860 bp, Homo sapiens
  misc_feature: GYAE6OF02H5RU9.33.78.H01.1.454.CMB.1.raw
  modified_base (109)..(109): a, c, t, g, unknown or other
  misc_feature (109)..(109): n is a, c, g, or t
tcagtacacacactcacgaccggtgctcgatttagtgtgagtagtttgggttgggggtgggtccagggaggcagaactctgggtgtctcaccatggcctggatcccctntacttcctccccctctacactctctgacactaggctctgccggcctacctacggagtctgacaacgcgcctaccggttcggtttctggtcgtctaacggtgggaacacggaccggcctaagggacctccgtaccgtggtccttgggtagggaagccttggacctaagtttaccggaaaccaaaagggttcctaaaaccgtttggtccttttaaaaggtccggtacgaacgtacgaacggaacgaccggacggaccgtaccggtaccgtacgtacgtaagtaataaactaacgtaaacgaaagtaacgtaagtacggacggtaccgtaccgtaaggtaacggtaccgtacccgaggtacgtacggtacgttaccggtacgtaccgtaagtacggacgaacggtaacggtaactaacgtacgtaacgtaccggtacgaacgtagtaccggtaggtacggtaccgacggtaagacgaacgaacggacgtacggtacgtacgtaacgtccgtaaccgactacgaccgttaacgaccgaccggtaccggtaaccgtacggttagggttaaccggggttaggggttaccgggttacggggtaccgggacgggtaaaccggtaaccggtacgggttacccggttacggtacccggttaacgggtacccgtaaccggtaaccccgtaacgggttcccggttacccccggtacccgttaccgttacccggttcccgttacccggttccccggtaccccgg

SEQ ID NO: 162765 - DNA, 684 bp, Homo sapiens
  misc_feature: GYAE6OF02I7NKI.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcgcctcctacgagctgacacagccaccgtcgtttctgtgtcacgtgggacaggacgccaggatccacctgactcgtggacgattcgctagttcgacctaaagcctaataccgtcttagttcggtaaccagtaccgagaaccggccaacgggcccgtaacgggtcccccttaggttaaccttaggtaacttaaagtaacttaaccgaaaaggacgtaagtaggaacggaacggtccctaggtagggacctccggtagacggtacgtacttccgtaccggtactacacgtcggacgtacgggaacacgtacgtcgtacgtttacgaacctctcgtaacggtcgacgtcgacggacagtaaggacgtacgtcgtacgtactacgtactacgtccgcctaacgtcgacgacgtaccgccgtaagttcgggtaagggttcggtacggttacgggacggtaacggtacggtaggtaccgtaaccggtcgtacggtacgacgtacgtacggccgttaccgcccgtacggtaccaccgttaccgg

SEQ ID NO: 162766 - DNA, 786 bp, Homo sapiens
  misc_feature: GYAE6OF02HMMZ6.33.78.H01.1.454.CMB.1.raw
tcagtacacacactcacgaccggtgctcgatttagtgtgagtagtttgggtttgggggggtccgaggaggcagaactctgggtgtctcaccatggcctggatccctctacttctccccctcctcactctctgcacaggctctgcggcctcctacgagctgacacacgccaccgttcggtttctgtgtcacgtgggacaggacggccaggatcacctgctcgtaggagatgctagttcgaccgaaacgacgtaattaccgtacttttagttacggtaaccacggacgaacggaacggaccgacggaccgaccggtaccccgtacgtactacgtaacttaaacgtaacgtaaacgaaaggaagtaaacgtaggaacggaccggtacccgtacggaacggtaccgtaccgtacggtacggtaccgttaccgttccgtaccggaactaacgtaacgtacggaacggaacgggaactaaccgtagtaccgtaacgtacgacctaagtacgtaggtacggtacgccgaaggacgaaacggaacggacggacggtacgtacgtaacgttactacgtacgtaccgaccgtaccgacgtaccggtccggtaaccgtagggtacgggttaggggtacggggtttaggggttcggggtaccgggacgggtacgggtaaccgttacgggtaccggtaccggtaccggtaacggtccggtacccggtaccggtacccggtaccgtccccggtacccggttccgacccttaccgttcccggttcccgttccccgtacccg

SEQ ID NO: 162767 - DNA, 832 bp, Homo sapiens
  misc_feature: GYAE6OF02I08UQ.33.78.H01.1.454.CMB.1.raw
  modified_base (136)..(136): a, c, t, g, unknown or other
  misc_feature (136)..(136): n is a, c, g, or t
  modified_base (626)..(626): a, c, t, g, unknown or other
  misc_feature (626)..(626): n is a, c, g, or t
tcagtacacacactcacgaccggtgctcgatttagtgtgagtagtttgggtttgggggggggtccaggaggcagaactctgggtgtctcaccatggcctggatccctctacttctccccctctcactctctgcacnggctcgtgccggtccctaccgtacggagctgaactaccacggtccctaccggttcggtttctggtcgttaccgacggtggggaacacggaccggcctaggtactccaccgtgactcgtgggaatagtcgtcctaagttacgaaccgtaaaagcctaaagttaccgtacgttttagttaccggaacccgtaggtaccgaaggaaccgacccggtacggccccgaacggtaccccgtagtactacggtaattaaacgtaacgtaaaacgaaaacggaagtaacgtaggaacggacccggtaccctacggggaacggttaccgtaccccggtagggaaccggtcgttacgttcccggtaccggtacttaaacggacgttcggaacggacggaaactaacgtacgtaccgtacgtacgacctacgtacgtacggtacggaaccggtacggaacggtccgaaaggtacgggacggagtaccgtactaaccggtanaccgtacgccgtacgtacgtaccgacgtccggtaaccttcgggtacgggttagggttggggttacgggtcgggtacgggaccgggtaccggtaacgtacgggtttaccgaccggttacggtacggaccggaccggtaccgggttaacgcccgttaccccggacccgttcggtaccccgtactttccggtccccgttacccctcccg

SEQ ID NO: 162768 - DNA, 810 bp, Homo sapiens
  misc_feature: GYAE6OF02JN19M.33.78.H01.1.454.CMB.1.raw
  modified_base (185)..(185): a, c, t, g, unknown or other
  misc_feature (185)..(185): n is a, c, g, or t
  modified_base (229)..(229): a, c, t, g, unknown or other
  misc_feature (229)..(229): n is a, c, g, or t
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagccaccgttggtttcngtgtcacgtgggacaggaccggccaggatcacctgctcgtgganatgactattcgaccaaagcaagtaccgtcttagttcggtaccagctaagacgtccaggcctaacggccccctgtacctgaataaatactaacgaaaagagtaactggaacggaccggtccctacggaacgggtaccttaccccgtagggaccgtacgtaacgtttcccgtacccgggtacttaaacgtaacgtaggaccggaaacgggtaacctaaacgtacggtacccgtaacggtttacccgaaaccgtagtacgtaacggtacgggtaaccgtaccggaaggaccgaaacggaacggaaccggacgggtacgttaacggaaaccgttactaaccgtaccgtcgtaccctacgttaccgacgggtaacccggtaccgtccgtaagggtttaccggggttaaggggttcggggttaccgggttaccggggtaccggggtaacgggtaacccgtacgggtttacccgggtaccccgtttaaccggttacgggtacccgaaccggtaccccgggtaacggtccccggttaccccgggttacccccggttaccccggttaccgtaaccccggttttcccccgg

SEQ ID NO: 162769 - DNA, 641 bp, Homo sapiens
  misc_feature: GYAE6OF02FNBDX.33.78.H01.1.454.CMB.1.raw
tcagtacacacactcacgaccggtgctcgatttagtgtgagtagtttgggtttgggggaaaacctcattcctcctctaaagaagcccctgggagcacagcgcatcaccatggactggacctggaggttcctctttgtggtggcagcagctacaggtgtccagtcccagttccaactggtacaatctgggtctgaggtgaagaggcctgggtcctcggtgagggtctcctgcagtgtctctggggagcgtccttcagtccacctatcgccatcacctgggtgcgacacggcccccgacgaagggcttgagtggagtgggggtatcatcccgtctcgttcggcacaactacgagtaccgcctaactaaactttacaagacagacgtcgactaagtttcgacgtaacgaataccgaaaccgaccacacgtaccaacgtagtagggtacgttggacggacgccgttacgactatcgtagaacgaccgacggtacctattagttacgtgtgacgaagagtactaacgtaaagtcgtacgacgtacgtaaggttcgggtttaaccgggttacgtaccggttccggtacggggtacccgtaacggggtaacccgttcggttaccgtacggttaccggtccctacccgg

SEQ ID NO: 162770 - DNA, 734 bp, Homo sapiens
  misc_feature: GYAE6OF02FQE15.33.78.H01.1.454.CMB.1.raw
  modified_base (108)..(108): a, c, t, g, unknown or other
  misc_feature (108)..(108): n is a, c, g, or t
  modified_base (221)..(221): a, c, t, g, unknown or other
  misc_feature (221)..(221): n is a, c, g, or t
  modified_base (300)..(300): a, c, t, g, unknown or other
  misc_feature (300)..(300): n is a, c, g, or t
tcagtacacacactcacgaccggtgctcgatttagtgtgagtagtttgggtttgggggtgggtccaggaggcagaactctgggtgtctcaccatggcctggatccctntacttctccccctcctcactctctgcacaggctctgcggcctcctacgagctgacacagccaccgtcggtttctgtgtcacgtggacagacggccaggatcactgctctgganatgcattgaccaaagcaatacgtcttagttggtaccagcagaagccagccacggcccctagtactagaataataataanaagagaatgagacggcctagagggactcccgtagagacgtacgttcctccggactaacaacgttgaccggaagggaacctaacgaacggtcctaacggttacgaacctacgtactaaggtaggaacgttaccggaacgggaacgtaaaggaaacggaacggtaacggccgtacgaacgttaaacgaccgaccttacggaccctaaccgtccgaacggcccggtaaccgttccgtaacgggttagggttaacggggttcggggtttacggttacccggggtacgggtaaccggggaacccgttaacgggttaccggaacccggttaccggttaacggtaccgtaaacggtacccccggtaaacggtcccgtacccggtaccccccggttaccgggttaaccctaccccgtttaccggtaccccgtttaacccccg

SEQ ID NO: 162771 - DNA, 745 bp, Homo sapiens
  misc_feature: GYAE6OF02GLN5A.33.78.H01.1.454.CMB.1.raw
  modified_base (115)..(115): a, c, t, g, unknown or other
  misc_feature (115)..(115): n is a, c, g, or t
  modified_base (259)..(259): a, c, t, g, unknown or other
  misc_feature (259)..(259): n is a, c, g, or t
  modified_base (628)..(628): a, c, t, g, unknown or other
  misc_feature (628)..(628): n is a, c, g, or t
tcagtacacacactcacgaccggtgctcgatttagtgtgagtagtttgggttggggggggtccaggaggcagaactctgggtgtctcaccatggcctggactccctctacttccncccctcctcacttctctgcacacggctctggccggtcctccgtacgacgcgtcgaacacgacgtcctaccggttcggtttctgtacgtcacgttacggggaccaacggccggccaagggtactccgaaccgttcgcctttcggngggaacgtacttcggacttacgttcgaacctaaagtcgaaacgttcgtactttaggtacggtaaccgacgtacgaaaggaaacgccgaacggaccgtaccgggtacccccttaggtacctaggtaactttaaactaacgtaaaccgaaaaggtaggtaaacgtaggtaacgaccggaccgttacggacgggtctaccgtggacgtacgtacttccgtacggacttaagagtcgacggacggaactaacgctaccgtcgtaacacctagtactacggtacggactcggacgagaacgtcggacgtagtacgtacgtactcgtaagtacgtcgaccgtataccggacgaacgtcctagggacgttacgggngggtttcggacgggttacgggacgacgggtaactaggtccgtaccgttcgtaggaaccctgggaccgacgttccgtacccgccgttacggtaccttcggccttcccggtacctaccg

SEQ ID NO: 162772 - DNA, 826 bp, Homo sapiens
  misc_feature: GYAE6OF02IMUOJ.33.78.H01.1.454.CMB.1.raw
tcagtacacacactcacgaccggtgctcgatttagtgtgagtagtttgggtttgggggggggtccaggaggcagaactctgggtgtctcaccatggcctggatccctctacttcctccccctcctcactctctgcacaggctctgccggccctcctacggagctagaccacacgcccaccggttcggttttctggtcgtcacgtgggacaggacggaccaggtactccacctgctcgtaggagatgactacttacggacccaaagacctaaacgtacggtacttttaagttcggtaaccagacaacgaacgccgaacggaccgaccggtaccccctaggtacctaagtaacttaaataactaaacgaaagaagtaagtcggaacggaccggacctacggacgggtacctacccgtaggacgacgtaccgtttacccgtaccgacctaacgacgtcggaccggaacggaaccaacgtacgtacgtaaccgttgaccctatacggaacggtacgggaccgacgtacggaacgtaaggaacggtaacgggacggtaccgtacgttaactaacgtaccctaccgtaccgtaccaacccgtgggaccctacccgggttaaccgttacggacggggttaaggggtttcggggttaccgggggtttacgggtccggggaaacggggtaccgggtaaaccggttaacgggtttccccgggtaccggttaccggtaaccgtccgggaacccgtaccggtaaccggaccggtttcccccgtaccccgggttcggttacccgacccgtttccccttacccgttacccccgtaccccg

SEQ ID NO: 162773 - DNA, 785 bp, Homo sapiens
  misc_feature: GYAE6OF02I4QU9.33.78.H01.1.454.CMB.1.raw
tcagtacacacactcacgaccggtgctcgatttagtgtgagtagtttgggtttgggggaaaaccgtcattccgtcctctaaagaagcccctgggagcgacagccgcagtccaccatcggactggacctggaggttccctctttgtggtggcgagcaggcctacgaggtgtccagtcccagttcccaatggtacaatcctgggtctgaggttgaaggaggcctagggtcctcgggttcgagggttcctccgtagcgtacggtgtccgtaccgtggggacgccggtaccgttcgaggtacctaaccttagtcgtacctacgtaccgtaccggtcgggtacgaccgaccggacccggaccccggaacggaacggtaccgttaggtacggtagggtagggttagggggttactaccgtaccgttcccgtacgtttccgttaccggaccgtaaccgtaacgtacggtaacgttacccgtaccctaacttaaacgttacgaaacgtactaacgtagtacgtacgttaacgttacgaacgtaaccgtaactacccgaaccgaaccctacgtacgtacccaacgtacggtaggtagtacggacggacgtacgtacgtaacgtacgttacgtagaacgtacgtacgtacgtaattacgtacgtcgtacgtacgtaagtacgtaacgtaagtacgtggtacgacgtacgtagggttacgggttacggttacgaccggttccggtacggtaccggtaccgggtaccgtacggtaccgtacgttcccgtaccgtccg

SEQ ID NO: 162774 - DNA, 843 bp, Homo sapiens
  misc_feature: GYAE6OF02ICOFM.33.78.H01.1.454.CMB.1.raw
tcagtacacacactacacgaccggtgctcgatttagtgtgagtagtttgggtttgggggaaaacctcagttcctcctctaaagaagcccctgggagcacagcgcatcaccatggactggacctggacggttcctctttgtggtggcagcagctacaggtgtccagtcccagttccaatggtacatctgggtactgaggtgaagaggcctgggtccttgggtgagggttctcctggctaggtgtcctgtgggagcgtaccttcaggccacctagtcgccatcctaaccgtgggttcgacgaccgacgggacccccggacgaaacggggtccttaggtagtaggggtacggtggggggggttactaccgaacgttcccctttaccgtccggttttaccgggtaccgaaccgtaaactttaaccgaacggtttaaccccgggaaccccgtaaaccgttaaaaaccctttttacggaaaccggtaaaccgaagggtaaacgttaccggtaacgtttaaaccgggtttttaccggaaccggtaaaacgtaaccggtttaaccgaaaccgggtaaacccctacgtaaaccgggtttacccaaactacggttacggggtaccggttttagggaaacggggtacctaaccgttacgggaaccttagttaccggtttaacgaaaggtaaacccgtacgggtacccgtaatttaacgttaggtacggtacggtaaccgagtaacgtacgtaaacgaaacgtggttacgacgtacggtaaggttacgggtttaggtaccgtcgtcggtacggaccggtacggtaccgtcggtacgtcgttaccggtacttcccg

SEQ ID NO: 162775 - DNA, 734 bp, Homo sapiens
  misc_feature: GYAE6OF02JXDO4.33.78.H01.1.454.CMB.1.raw
tcagtacacacactcacgaccggtgctcgatttagtgtgagtagtttgggtttgggggctgtgggtccaggaggcagaactctgggtgtctcaccatggcctggatccctctacttctccccctcctcactctctgcacaggctctgcggcctcctacgagctgacacagcccaccggttcggtttctgtgctacgtggggacagacggccaggatcacctgctctggagacgtgacagttcgacccaaagctaaacgtcgtactttacgttcgggtaacccaggacaaggaacgcccgaacgggccccgtaacgggtcccccgtaggttacctaggtaactaagttaaactaacgtaaaagaacggaaacgtggaacggaacgggtccctacggtaacggggtaccttcccgtaggaacgtccggtaagtttcccgtaccgggtactaacgtaacgtcggacgtaagggaaccaacgtgtaccgtaaacggtcgaacctatacgacggtaggacgtaccgagggaactaagaacggtaacgacggtacgtcggtaacttactccgaactccgtacgaccgtaccgacggtaccgggtacctacggtaggtcgggttagggttcgggtcggtacggggaccgggtaacgtaacgtcggttaacggccggttacgtacggtcggaaccggtacggaccggtccgtacccggtccgtccggtaccttcgtacccgg

SEQ ID NO: 162776 - DNA, 768 bp, Homo sapiens
  misc_feature: GYAE6OF02IO7HK.33.78.H01.1.454.CMB.1.raw
  modified_base (248)..(248): a, c, t, g, unknown or other
  misc_feature (248)..(248): n is a, c, g, or t
  modified_base (364)..(364): a, c, t, g, unknown or other
  misc_feature (364)..(364): n is a, c, g, or t
  modified_base (589)..(589): a, c, t, g, unknown or other
  misc_feature (589)..(589): n is a, c, g, or t
tcagtacacacactcacgaccggtgctcgattttagtgtgagtagtttgggtttgggggggggtccaggaggcagaactctgggtgtctcaccatggcctggatccctctacttcctcccctcctcactctctgcacaggctctgcggcctccgtacgagctgacacacgcctaccggttcggtttctgttcgtacacggtgggacacggaccggaccaggtactcccaacttcgtctcgtggaagtntcgcttaattcgaaccaaagcaaattaccgtactttagttcggaaccagacaaggtaacgaccgtacggaccgtaccggtccccgttagaactaggaaattaaaacgtaactaaanaaaacggaagaaacgttgggaaacgccggtcccgtaaggacgggtacctccgtagacggtacgttacgttccgtccgtactaaccgtaagtcggaccggtaaggaaaccaaccgtaggttacccgtaacggttacgaaacccttatacggtaaggtaccggttacgaccgtaggaaacgtaacggaacgggtaacgaggtaccgttaacggaccttaaccgttanaccgtaccgtacccaacgttcgacgggacccgtacgtacggtgggttacggtacggggttcggagggttccggcgggtaccggaaacgtaacggttccggtacgtccggtaacggtcgaccgtaccggtccgccgtccgttacccggtctaccgttcctccgtcccggttccctacccc

SEQ ID NO: 162777 - DNA, 839 bp, Homo sapiens
  misc_feature: GYAE6OF02GS8CJ.33.78.H01.1.454.CMB.1.raw
  modified_base (187)..(187): a, c, t, g, unknown or other
  misc_feature (187)..(187): n is a, c, g, or t
  modified_base (244)..(244): a, c, t, g, unknown or other
  misc_feature (244)..(244): n is a, c, g, or t
tcagtacacacactcacgaccggtgctcgatttagtgtgagtagtttgggtttggggctgtgggtccaggaggcagaactctgggtgtctcaccatggcctggatccctctacttcctccccctctcactctctgcacaggctctgccgcctcctacgagctgacacgagccctacggtcggtttcngtcgtcacgtgggacaggaccggccaaggtctccgacctgccttacgtgggaagtangactaagttcgaaccaaaacgctaaacgtacgtcgttttaagttcggtaaccagaccgaaacgtaacggacccgaacggtaccccgtaccgggtcccccctaggttaaccgttagtaaacttaaacgttaacgtaaacgaaaaacggaagttaaagtagggaacgaccgggtaccccttacggaacgggtaccgttaccccgtaggtaaccggtacgtaccttttaccggacccggtaacgtaacgtaaacgtttacgggaaccgtaaacgggggaaacccaaacgtaacggtttacccgaaacgggtttaccaaaccgtacgtaccggtaggtacggtaccgtacccgaagggaccgaaagggaaacgaccggtggtacgtcgtaacttacgtcctaacgtccgtaccaccgtcgaaccggtacgtaccctacgggtaggttccgggttaagggggtttcggtacgggttaccgggtaacgggaccgggtaaccgttaagggttacccgttaccgggttaacccggtaggtaaccgccggaaccggttaccgacccggtttccggacccccttcggtaccgtaccttccccggg

SEQ ID NO: 162778 - DNA, 781 bp, Homo sapiens
  misc_feature: GYAE6OF02JHKTU.33.78.H01.1.454.CMB.1.raw
  modified_base (331)..(331): a, c, t, g, unknown or other
  misc_feature (331)..(331): n is a, c, g, or t
tcagtacacacactcacgaccggtgctcgatttagtgtgagtagtttgggtttgggggtgggtccaggaggcagaactctgggtgtctcaccatggcctggatcctctacttctcccctctcactctctgcacaggctctgcgcctcctacgagctgacacacgccaccggttcggtttctgtacgtcacgtgggacagaccggtccaaggatccaacctgcctcgtaggacattcgactattcgaccaaaagcaaactacgcttaagttcggtaaccagacaagaacgccaacggccgtacggccccttacggtactacgaataaactanaaacgaaagaagaaatagaggaacgcccgttacgaagggtactcccggtagtaacgcgtaacgtttcctcccggtactaaccgtaaacgttacggacgtaaacggggaacctaaacgtaaacgttacctaaccggtttcgaaacccgtaagtcgtaaacggtacgggaaaccgttaccgaacggtaccgaaaacggtaaacggaaaccggtaacgggtcctacggtaaccttaacgttaaccaaccgttccgaccctaaccgtaccgtacgggtaaccggtaacccgttaccgttagggttaacgggtagggttacggggttaggtttccgggaacggttaaccgggtaacgtaacggtttacggaccgttaccgttaacggtacgtaccggacccgtaaaggtccgtacccgacccgttccgcctaaccgttccgtaccgttacccccg

SEQ ID NO: 162779 - DNA, 746 bp, Homo sapiens
  misc_feature: GYAE6OF02GZDGR.33.78.H01.1.454.CMB.1.raw
  modified_base (228)..(228): a, c, t, g, unknown or other
  misc_feature (228)..(228): n is a, c, g, or t
tcagtacacacactcacgaccggtgctcgatttagtgtgagtagtttgggtttgggggtgggtccaggaggcagaactctgggtgtctcaccatggcctggatccctctacttctcccctctcactctctgcacaggctctgcggcctcctagagctgacacagccacgttcggttctgtgtcactgggacagacggccaggatcacctgctcgtgagatgccagttnaccaaagtccaaagtacgcttagttcggtaccagtcgagtaagccgtagccgacgcccctgtaacctggactaagtactacgaaagagtaaacttgaaggacggtccctcgaagggtacttccctaggacgtacgtacgtttccgaccggtacttaaccggaacttcggaccgaacgggtactaaaccgtagggtacctaacggttacgaacctaagtccaaggtttaggaccgttacgaacgggtacaacgggaaacgtaacggacgggtactacggtaaccgttaagaccgtaacgtcgcccgtaaacccgttacgacggtacccggggtaacctaggaaccgtttacgggggttaaggttaaccggggttcggtttaaccgggacggggaaacccggtttaacgaaacggttttccggaaaacccggttcggttaaacgggttaccgaacgggtacccgtaaacggtccggtaccgccccggtttacgaccgtcgttaccgtcgtttaacccccg

SEQ ID NO: 162780 - DNA, 784 bp, Homo sapiens
  misc_feature: GYAE6OF02H9RTI.33.78.H01.1.454.CMB.1.raw
  modified_base (227)..(227): a, c, t, g, unknown or other
  misc_feature (227)..(227): n is a, c, g, or t
  modified_base (758)..(758): a, c, t, g, unknown or other
  misc_feature (758)..(758): n is a, c, g, or t
tcagtacacacactcacgaccggtgctcgatttagtgtgagtagtttgggtttgggggtgggtccaggaggcagaactctgggtgtctcaccatggcctggatccctctacttctcccctcctcactctctgcacaggctctgcggcctcctacgagcctgacacagccaccgtcggtttctgtgtcacgtggacagacggccaggactcaccgtgccttcgtgganattgcctagttcgaaccgaaacgcaaactacgtctttaacgtttcggtaacctacgacgaacggaaagcccgaacggccaaccgggtcccctgtacctgtaaataataacgtaaacaaaacgtagtaaacgtggaacggaccggtccccgttaggaacgggaacctcccgttagaacggtaccttaacgtttccgtacccggacctttaaaccgaagttccgaaccggaaacgggtaaccaaacggtcgttaccgaacggtttccgaacctagtaccgtacggtacggtacggtaccgaggaccgaaacggaaacgaaccgggagaacgtacgaaacgttaccgtaacctaccgttacaccctcgtaaccgaccggtcccggaacttacggacggttaggggttcggggttacgggttcggttccgggggacggaaacgggtaccgttagggttacccggtaaccggttacgtaccgggttaccgaccggtaacccgaccggcccgtacccgtcccccggttaggtacccnccgttttcccgcccgtttaccccccg

SEQ ID NO: 162781 - DNA, 759 bp, Homo sapiens
  misc_feature: GYAE6OF02G0ZNF.33.78.H01.1.454.CMB.1.raw
  modified_base (185)..(185): a, c, t, g, unknown or other
  misc_feature (185)..(185): n is a, c, g, or t
tcagtacacacactcacgaccggtgctcgatttagtgtgagtagtttgggtttgggggctgtgggtccaggagtcagaactctgggtgtctcaccatggcctggatccctctacttctcccccctctcactctctgcacaggctctgcgcctcctacgagctgacacagccaccgttcggtttcngtcgtacacgtgggacagacggccaggactcacctgctcgtggacatgctagttcgaccgaaaagctaaagtaccgtactttattacggtaacccaggaccaaggaacgcctaggcccctaacggccccctagtactgtaactaatactaaacgaaagtagaagtgacggacgccctacgacgggtactcccgtagacgcgttacttccgtaccggctaacagtcgacgaacgggtacaacgtagtacgtaacgttacgaacctagtacgagggtacggaccggttaccgaaggtacaagggaaacgaacggacggtccgttaacgtactacgtacctacgtccgaccctacttaacggaccggtaacccggtaccgtacggtacgggttacggggttacggggttacggggttcggttaccggggagggttaaccggggtaacccgttagggtttacccgggtaacccggttacccggttaacgggtacccggtaacccggtaccggtaaaccgggtcccggttaccccggtaccccccggttacgggttaccctaccccggttttaccccgg

SEQ ID NO: 162782 - DNA, 823 bp, Homo sapiens
  misc_feature: GYAE6OF02HF5R8.33.78.H01.1.454.CMB.1.raw
tcagtacacacactcacgaccggtgctcgatttagtgtgagtagtttgggtttgggggggtccaggaggcagaactctgggtgtctcaccatggcctggatccctctacttcctcccctcctcactctctgcacaggctctgcggtcctcctacgagctgacacacgccgtaccgttcggtttctgtgtaccagtgggaccaggaccggtccaggactccacctggctacgtggagatcgctattccgaaccaaagctaactacggttcttagttacgggaaccacgtacgaagaaccgccgaacggccgaaccggtccccctaggtacctaagtaactaaacttaactaaaacgaaaaggaagtaagtaggaacggaccggtacccgtacggacggtaccgttccgtacggaccggtacgttaccgttccggtaccggtaaccttaaacgacgttacgaccggtaaacggggtaaacctaaacggtacgttaaccgtaacgtttaaccgtaacccgtacgttaacggacggttaacgggtaacgacccggaacggtaacgaaacgggaagggtaaccggaacggtacgtttaaccgacttacgttaaccgacctacgtacccgtcgacgtaccggtcccgtacgttacggtaacgggtttcgggtcgggggtttaacgggttcggggtaccgggacggggtaaacggtaaccgggtacggttaccggtaccgttacggtaccggtcgaccgggtaaccgcggttaccccggtccgtacccggttaacggcccttaccggttccgtacccttaccctacccgg

SEQ ID NO: 162783 - DNA, 738 bp, Homo sapiens
  misc_feature: GYAE6OF02HH2NN.33.78.H01.1.454.CMB.1.raw
  modified_base (154)..(154): a, c, t, g, unknown or other
  misc_feature (154)..(154): n is a, c, g, or t
  modified_base (185)..(185): a, c, t, g, unknown or other
  misc_feature (185)..(185): n is a, c, g, or t
  modified_base (552)..(552): a, c, t, g, unknown or other
  misc_feature (552)..(552): n is a, c, g, or t
  modified_base (558)..(558): a, c, t, g, unknown or other
  misc_feature (558)..(558): n is a, c, g, or t
  modified_base (582)..(582): a, c, t, g, unknown or other
  misc_feature (582)..(582): n is a, c, g, or t
tcagtacacacactcacgaccggtgctcgatttagtgtgagtagtttgggtttggggggtccaggaggcagaactctgggtgtctcaccatggcctggactccctctacttcctccccgtctcacttctctgcagagctctgccgtcctctagntctgactacgagtccacggtttcgttctgtntacgtacgtaggacacggaccgcagggacttcgaccgtcgtctaccggtgggaattacgcggacttaggtaccgaaaccgtaacgtacttaacgtccgtattttacggtaccggtaaccaggaccgtaaacgtacgaccccgaagggtccctaaccggtcccttggtaaccacgttaaacttaaactaacgtaaacgtaaacggaagttaaacggtacggaacggttaccgaccccgtggtaaccggtaccttccgaaggcgttaaccttaccgttaccgtacggaacctacgttacgcgtaagtaacgacccgtacgtactacgggtactacgactacgacggttagcggtactacgagtacgaanacggancgtacgtactaagctactcgtccncgtacgacgtcgacgtcgcggttaggtgtacggttcggtacggtacggacggttcggtacgtacgaccgttaccggtacggttccgaacgtaccggtcgtaggttacccgccgtaaccggtccgtacgttccggtccgttacccgtccttacccgg

SEQ ID NO: 162784 - DNA, 598 bp, Homo sapiens
  misc_feature: GYAE6OF02F1ZR3.33.78.H01.1.454.CMB.1.raw
  modified_base (306)..(306): a, c, t, g, unknown or other
  misc_feature (306)..(306): n is a, c, g, or t
  modified_base (329)..(329): a, c, t, g, unknown or other
  misc_feature (329)..(329): n is a, c, g, or t
  modified_base (345)..(345): a, c, t, g, unknown or other
  misc_feature (345)..(345): n is a, c, g, or t
  modified_base (364)..(364): a, c, t, g, unknown or other
  misc_feature (364)..(364): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
tcagtacacacactcacgaccggtgctcgatttagtgtgagtagtttgggtttgggggggtccaggaggcagaactctgggtgtctcaccatggcctggatccctctacttctccccctcctcactctctgcacaggctctgcggcctcctacgacgctgacacagccaccgtcggtttctgtgcactgggacagacggcaggactcacctgctctggacgatgccattcgaccaaagcaattacgcttagttcggtacagctagaagtccaggccaggcccctgtacctgataatatacaaaganaatgagaggccctgaggtctccngtagcgattcgccggntaacatcgcagggcaacgngtacaccgttgacacgtcagtggacgtccaggacagtacgacgcggtagtanaccgtanacaccgtgacccacggtcacgcgtacccgtacaggttaggtacggttgggttggttccgggtacggaaccgggtccaaaggttcgaccgttccggttaacggtcgaacggaccccgtaaggtcccgtccgtacccccgtcggttccctaccgtccgttaccgttccccgtccccg

SEQ ID NO: 162785 - DNA, 763 bp, Homo sapiens
  misc_feature: GYAE6OF02I9OG3.33.78.H01.1.454.CMB.1.raw
  modified_base (420)..(420): a, c, t, g, unknown or other
  misc_feature (420)..(420): n is a, c, g, or t
tcagtacacacactcacgaccggtgctcgatttagtgtgagtagtttgggtttggggggggtccaggaggcagaactctgggtgtctcaccatggcctggatccctctacttctccccctcctcactctctgcacaggctctgcggcctcctacgagctgacacagccaccgtcggtttctgtcgtcacgtgggacaggaccggccgaggacttaccaccgtcgcgttccgtagggaacgagttggactacgtttcgaacccgaaaaggactaaacgtacgtacctttagttacggtaaccgaggcaacggaacgccgaccggtacccgaccggtccccgttacgttaccgtagtaataaactaagtaaacaaaaggtaacgtaagtaggaagaacggccctacggacgggacctaccgnggacgtcgtacttccgtcggacctaagtacgtcggacgtacgggaaactaacgtacgtaccgtacgttacgaccgtatacgtaggtacggtacgtaccggaacgggacgaaacggtaacgacggagtacgacgtaactagtcctaacgtcaccgtactacgaccggtacgtaccttcggtacggttaacgggtgggtcgggtaccggggttcgggtaaccgggaacgggtaaccgtaagggtccggtacccgtcggttacggacggacgacccgggtaacggtcccgtcccggtaccccggtcgttaaccgccgttaccctttccccgggtacccttaccccg

SEQ ID NO: 162786 - DNA, 867 bp, Homo sapiens
  misc_feature: GYAE6OF02H7M7K.33.78.H01.1.454.CMB.1.raw
  modified_base (79)..(79): a, c, t, g, unknown or other
  misc_feature (79)..(79): n is a, c, g, or t
  modified_base (167)..(167): a, c, t, g, unknown or other
  misc_feature (167)..(167): n is a, c, g, or t
tcagtacacacactcacgaccggtgctcgatttagtgtgagtagtttgggtttgggggtgggtccaggaggcagaactntgggtgtctcaccatggcctggatccctctacttctccccctctcactctctgcacaggctcgtgcggcctcctacgagcctgacacncgccctaccggttcgttctgtctccgacgtggacaggccggctaacggactccgaccctggccgttcgtaggatacgttcgactaactacggaaccctaaaagcctaaacgttccgtacttttaagtcggtaccgagacgaacggaaccgtccggaaccggtcccgaaccggtccccgttaagtaaccgtagttaaactaaaaccttaacgtaaaaaccgaaaggtaaacgtaaggtaacggtaccggaaccgccccggttaaaggtaaccgggtaacttccccgtaggtaccgacgttaaccgtccggtaccggtaactaaacgtcacggaccggtaacggaaccctaaacgttaccggtaaccgttaaccggttaccgaaccctagttaccggaggtttacggaccggtaccgacggacgaaacggacgggtaggtacggacgttagaccgtaactcgtaaccgacgtaccctaacgccctaacgggaccgtacccggttaggtcgggttacgggttcggggttacgggttacggggttaccgggacgggtaaacgggtaacccgttagggtacccgttacccgggttaccgtaacggtacccggtaaaccgggtcccgttaaccggtcccggttaaccccgtccccggttacccgttaaccgttaccccggtttaccccgtcccctttaccccccgg

SEQ ID NO: 162787 - DNA, 404 bp, Homo sapiens
  misc_feature: GYAE6OF01BYELH.34.86.H09.1.454.CMB.1.raw
  modified_base (400)..(404): a, c, t, g, unknown or other
  misc_feature (400)..(404): n is a, c, g, or t
tcagtacacgtgatcacgaccggtgctcgatttagtgctatagacttgggtttgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccgggctgaggatgaggctgattattactgtcagtcctttgacagcagcctgagtgcttatgtcttcggaactgggaccaaggtcaccgtcctaggtcagcccaaggccaacccactgtcactctcgttcccaccctcctcatcacgtgtactgagcgggctggcaaggcgcatagnnnnn

SEQ ID NO: 162788 - DNA, 448 bp, Homo sapiens
  misc_feature: GYAE6OF01CUM9J.34.86.H09.1.454.CMB.1.raw
  modified_base (303)..(303): a, c, t, g, unknown or other
  misc_feature (303)..(303): n is a, c, g, or t
  modified_base (335)..(335): a, c, t, g, unknown or other
  misc_feature (335)..(335): n is a, c, g, or t
  modified_base (442)..(448): a, c, t, g, unknown or other
  misc_feature (442)..(448): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccaggctgagatgaggctgattattacngtcagtcctttgacagcagcctgagtgcttangtcttcggaactggaccaagtcacgtcagtcagccaagccaacccatgtcactctcgttcccgccctcctcatcacgtgtactgagcgggctggcaaggcgcatagnnnnnnn

SEQ ID NO: 162789 - DNA, 272 bp, Homo sapiens
  misc_feature: GYAE6OF01C8QQE.34.86.H09.1.454.CMB.1.raw
  modified_base (245)..(272): a, c, t, g, unknown or other
  misc_feature (245)..(272): n is a, c, g, or t
tcagtacacgtgatcacgaccggtgctcgatttagtgctatagacttgggtttgggggtgtggtggtctccactcccgccttgacgaggctgattattactgctgctcatgtgcaagtctcaccactgtgactttcggcggagggaccaagttgaccgtcctcagtcagcccaaggctgccccctggtcactctgttcccaccctcctcatcacgtgtactgagcgggctggcaaggcgcatagnnnnnnnnnnnnnnnnnnnnnnnnnnnn

SEQ ID NO: 162790 - DNA, 406 bp, Homo sapiens
  misc_feature: GYAE6OF01CE2N4.34.86.H09.1.454.CMB.1.raw
  modified_base (401)..(406): a, c, t, g, unknown or other
  misc_feature (401)..(406): n is a, c, g, or t
tcagtacacgtgatcacgaccggtgctcgatttagtgctatagacttgggtttgggagcagctccaacatcggggcaggttatgatgtacactggtacaagcagcttccaggaacagccccaaactcctcatctatgctaacaccaatcggccctcaggggtccctgaccgattctctggctccaagtctggcacctcagcctccctggccatcactgggctccgggctgaggatgaggctgattattactgtgcagcatgggatgacagcctgaatggctcctatgtcttcggaactgggaccaaggtcacgtcctaggtcagcccaaggccaaccccactgtcactctgttcccgccctcctcatcacgtgtactgagcgggctggcaaggcgcatagnnnnnn

SEQ ID NO: 162791 - DNA, 609 bp, Homo sapiens
  misc_feature: GYAE6OF01CTJ5P.34.86.H09.1.454.CMB.1.raw
  modified_base (257)..(257): a, c, t, g, unknown or other
  misc_feature (257)..(257): n is a, c, g, or t
  modified_base (287)..(287): a, c, t, g, unknown or other
  misc_feature (287)..(287): n is a, c, g, or t
  modified_base (351)..(351): a, c, t, g, unknown or other
  misc_feature (351)..(351): n is a, c, g, or t
tcagtacacgtgatcacgaccggtgctcgatttagtgctatagacttgggtttgggaggctctgcttcagctgtgggcacaagaggcagcactcaggacaatctccagcagtcggcctgatcctcctctcctcctcactctcctcgctcactgcacgcggtccgtcggccagtctgtcgctcgacgcacgcccgccctcgagtcgtcggtccgggccccgagggcaggacggtccaccatcctctgacacgtgggancagcctaccaacagtcgggactaaggttangatcgtaacacgtggtaacagcacgtcctacgaagaacaccgaccccaaactcctacactctancgactaacacagtccgcctacggacgggtccacggaccgtacttctcgtcgtcctacctaacgttcgtacggccctacctacacgtccctccgcggaccactccacggtcgggccgtccgggtctacggaggtacgtacggacggtcctaggttaatttacttaacgttcgtacgtacggtttccgttaggtaaccaggacctaacgtcccgttaggtacgttcgtactttagttcgttccgttaccggtaaaccggg

SEQ ID NO: 162792 - DNA, 456 bp, Homo sapiens
  misc_feature: GYAE6OF01CZQMD.34.86.H09.1.454.CMB.1.raw
  modified_base (450)..(456): a, c, t, g, unknown or other
  misc_feature (450)..(456): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccgggctgaggatgaggctgattattactgtcagtcctttgacagcagcctgagtgcttatgtcttcggaactgggaccaaggtcaccgtctaggtcagcccaaggccaacccactgtcactctcgttccccacctcctcatcacgtgtactgagcggctggcaaggcgcatagnnnnnnn

SEQ ID NO: 162793 - DNA, 466 bp, Homo sapiens
  misc_feature: GYAE6OF01DNN63.34.86.H09.1.454.CMB.1.raw
  modified_base (460)..(466): a, c, t, g, unknown or other
  misc_feature (460)..(466): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagccccccaaactcctcatctatgctaacaccaatcggccctcaggggtccctgaccgatttctctggctccaagtctggcacctcagcctccctggccatcactgggctccgggctgaggatgaggctgatttattactgtcagtcctttgacagcagcctgagtgcttatgtcttcggaactgggaccaaggtcaccgtctaggtcagcccaaggcccaaccccactgtcacttctcgttccccgccctcctcactcacgtgtactgagcgggctggcaagggcgcatagnnnnnnn

SEQ ID NO: 162794 - DNA, 464 bp, Homo sapiens
  misc_feature: GYAE6OF01CQKU3.34.86.H09.1.454.CMB.1.raw
  modified_base (454)..(464): a, c, t, g, unknown or other
  misc_feature (454)..(464): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccgggctgaggatgaggctgattattactgtcagtcctttgacagcagcctgagtgcttatgtcttcggaactgggaccaaggtcacgtcctaggtcagcccaaggccaacccactgtcactctcgttcccgccctcctcactccacgtgtactgacgcgggctggcaaggcgcatagnnnnnnnnnnn

SEQ ID NO: 162795 - DNA, 535 bp, Homo sapiens
  misc_feature: GYAE6OF01EFVBL.34.86.H09.1.454.CMB.1.raw
  modified_base (317)..(317): a, c, t, g, unknown or other
  misc_feature (317)..(317): n is a, c, g, or t
  modified_base (472)..(472): a, c, t, g, unknown or other
  misc_feature (472)..(472): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
  modified_base (523)..(528): a, c, t, g, unknown or other
  misc_feature (523)..(528): n is a, c, g, or t
  modified_base (530)..(535): a, c, t, g, unknown or other
  misc_feature (530)..(535): n is a, c, g, or t
tcagtacacgtgatcacgaccggtgctcgattttagtgctatagacttggggtttgggggctgttcctggaagctgcgttgtaccagagggtcaccatctcctgcactgggagctagctccaacatcgggggcaggttatgatgtacgactggtacaagcagcttccaggaacagcccccaaactcctcatctatgctaacaccaagtccggccctcaggggtccctgaccgattctctggctccaagttctggccacctcacgccctccctggcctatcacgttgggcctccgggctagaggatgaggctgaattntactgtctagttcctttgacaggcacggccctgagttgctttagtcgtcgttcgggaacttggggaacctaagggtccaccgttcctaaggtccaacgcccaaggcccaaccccatcgtcactccgtcgttacccaccctcctcactctacgttntactgacgcggctaggacaagggtccacgagtacgncngacngananacannnnnncnnnnnn

SEQ ID NO: 162796 - DNA, 406 bp, Homo sapiens
  misc_feature: GYAE6OF01BV2LU.34.86.H09.1.454.CMB.1.raw
  modified_base (400)..(406): a, c, t, g, unknown or other
  misc_feature (400)..(406): n is a, c, g, or t
tcagtacacgtgatcacgaccggtgctcgatttagtgctatagacttgggtttgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccgggctgaggatgaggctgattattactgtcagtcctttgacagcagcctgagtgcttatgtcttcggaactgggaccaaggtcacgtctaggtcagcccaaggccaaccccactgtcactctcgttcccgccctcctcactcacgtgtactgagcgggctggcaaggcgcatagnnnnnnn

SEQ ID NO: 162797 - DNA, 591 bp, Homo sapiens
  misc_feature: GYAE6OF01APLA2.34.86.H09.1.454.CMB.1.raw
  modified_base (570)..(571): a, c, t, g, unknown or other
  misc_feature (570)..(571): n is a, c, g, or t
  modified_base (573)..(591): a, c, t, g, unknown or other
  misc_feature (573)..(591): n is a, c, g, or t
tcagtacacgtgatcacgaccggtgctcgatttagtgctatagacttgggtttgggggctgttcctggaagatgcttgtaccagagggtcaccatctcctgcactgggagcagctccaacatcggggcaggttatgatgtacactggtacaagcagcttccaggaacacgacccccaaactcctcatctatgctaacaccaatcggccctcgaggggtccctgaccgattctctggcctaccaagtctcggccacctcacgccctcccgtggccatccacgtgggcctccgggctggaggatggaggctgtatttattactgtcagttcctttgacagcagtcctgagtgtcttagtcgtcgttacggaacgtcgggaacctaaggtcccacccggttcgttaagggtccaccggaccccgtaacggaccccaaaccccctcgtcgttacccaaccttccgttaccggtttcccccgccccttccctacctacttcccgtaaccggttcgtaaccgttgggaaccgggccggggtacttcgggaccgaaagggtccgacctaagtacggnngnnnnnnnnnnnnnnnnnnn

SEQ ID NO: 162798 - DNA, 408 bp, Homo sapiens
  misc_feature: GYAE6OF01BOICZ.34.86.H09.1.454.CMB.1.raw
  modified_base (396)..(408): a, c, t, g, unknown or other
  misc_feature (396)..(408): n is a, c, g, or t
tcagtacacgtgatcacgaccggtgctcgatttagtgctatagacttgggtttgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctcctggccatcactgggctccgggctgaggatgaggctgattattactgtcagtcctttgacagcagcctgagtgcttatgtcttcggaactggacaaggtcacgtctaggtcagcccaagccaacccactgtcactctcgtcccgccctctcatcacgtgtactgacgcgggctgggcaagggcgcatacgnnnnnnnnnnnnn

SEQ ID NO: 162799 - DNA, 252 bp, Homo sapiens
  misc_feature: GYAE6OF01CCG7Y.34.86.H09.1.454.CMB.1.raw
  modified_base (248)..(252): a, c, t, g, unknown or other
  misc_feature (248)..(252): n is a, c, g, or t
tcagtacacgtgatcacgaccggtgctcgatttagtgctatagacttgggtttgggggtgtggtggtctccactcccgccttgacgaggctgactactactgtcagtcttatgataatgacaatcatgtgatattcggcggagggaccaaactgaccgtcctgagtcagcccaaggctcgccccctcggtcactctcgttcccaccctcctcatcacgtgtactgagcgggctggcaaggcgcatagnnnnn

SEQ ID NO: 162800 - DNA, 465 bp, Homo sapiens
  misc_feature: GYAE6OF01DHN43.34.86.H09.1.454.CMB.1.raw
  modified_base (392)..(392): a, c, t, g, unknown or other
  misc_feature (392)..(392): n is a, c, g, or t
  modified_base (459)..(465): a, c, t, g, unknown or other
  misc_feature (459)..(465): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtcccctgaccgattctctggctccaagtctggcacctcagcctccctggccatcactgggctccgggctgaggatgaggctgatttattactgtcagtcctttgacagcagcctgagtgcttatgtcttcggaactgggaccaaggtcaccgtctaggtcagcccaaggcccaacccnctgtcactcctcgttccccgccctcctcatccacgtgtactgacgcgggctggcaagggcgcatagnnnnnnn

SEQ ID NO: 162801 - DNA, 549 bp, Homo sapiens
  misc_feature: GYAE6OF01CIMS4.34.86.H09.1.454.CMB.1.raw
  modified_base (340)..(340): a, c, t, g, unknown or other
  misc_feature (340)..(340): n is a, c, g, or t
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacagtcggggcaggttatgatgtacactggtacaagcagcttccaggaacacgcccccaaactcctcatctatgacctaacaccaatccggccctcgacgggtcccngacccgtattcctctggctccaagtctggcctacctcacgccctcccgtggcccatccacgtcgggccgtccgggctggaggtatggaggtctagtatttattacgtgtgacagtcagtggatgacagtcctaggaatcggtccttcgtagttcgtaccgttacgggaacgtcggggaaccctaagggtccctacccgtccgtaacggg

SEQ ID NO: 162802 - DNA, 517 bp, Homo sapiens
  misc_feature: GYAE6OF01BVADC.34.86.H09.1.454.CMB.1.raw
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtacaagcagcttccagaacacgcccccaaactcctcatctatcgactaacaccaatccggccctcgacggggtccctgacccgtattcctctcggcctccaagtctggccacctcacgccctcccgtcggccatccacgtcgggcctccgggctggacggatggaggtctaggtattattactgtcagttccttgactagcaggtcctgtacgtgtacttatgtcttcggacgtacggg

SEQ ID NO: 162803 - DNA, 495 bp, Homo sapiens
  misc_feature: GYAE6OF01DM7WU.34.86.H09.1.454.CMB.1.raw
  modified_base (417)..(417): a, c, t, g, unknown or other
  misc_feature (417)..(417): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctcctgcactgggagcagctccaacatcggggcaggttatgatgtacactggtacaagcagctcaggacacgaccccaaatcctcatctatgactaacaccaatcggccctcgacgggtccctgaccgtattctctggctccaagtctggcacctcacgtcctccctggccatcacgtggcctccgggctggacgtntgaggctgtattacttactgtcagttccttgacagcacgctgtgtgtcttatcgttacttaggaacgtggactaacgg

SEQ ID NO: 162804 - DNA, 837 bp, Homo sapiens
  misc_feature: GYAE6OF01B4Y79.34.86.H09.1.454.CMB.1.raw
tcagtacacgtgatcacgaccggtgctcgatttagtgctatagacttgggtttggggaggctctgcttcagctgtgggcacaagaggcagcactcaggacaatctccagcagtcgctgatctcctctcctcctcactctcctcgctcactgcacgtacgggtccgtcgggccctagtcgtggtcgctcggaccgcacgcccgccctcgaggttcgtcggtccggggaccccgagggaccaagggtacgggtaccaacctacttccgtccgtcgacctacggtggggacgaccgacgtccctaacccgaaacgtacgggtccgggggaacgttaagggtttacgtaggtaacgttacggtaaccgtacggttacggtaaaccgaaacggccgaacggtccttaaccgaaacgggaacccacccgaaccccctaaacttccctacacgttctaacgttacgaacctaaacccaacctaaaccgtcccggtaccctacgggtacccggggttccctacggtaacccgttactttccgttcggtcggtccctaaccgtaacgttcgtccggaccctaccgtacgaccgtcccctccgtaccggacctacgttaccgaccgggttccgggtccccgggtcccgggtacggtacgggtaacgggttacggtacggggtaacggttaccggtttagttaaaccgtttttacgttacccggttacggttacgttaaccggttttcccgtttaacggaaccgtacggtacccgtaccggtccgttaggtaaccggttcgtttaccgtttaacggtttcggttcccggttaacgggtaaacccgggg

SEQ ID NO: 162805 - DNA, 482 bp, Homo sapiens
  misc_feature: GYAE6OF01A2UBP.34.86.H09.1.454.CMB.1.raw
  modified_base (393)..(393): a, c, t, g, unknown or other
  misc_feature (393)..(393): n is a, c, g, or t
  modified_base (463)..(467): a, c, t, g, unknown or other
  misc_feature (463)..(467): n is a, c, g, or t
  modified_base (469)..(482): a, c, t, g, unknown or other
  misc_feature (469)..(482): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctagtgctaacaccaatcggccctcaggggtccctgaccgattcgtctggctccaagtctaggcacctcacgcctccctggccagtcactcgggctccgggctgaggatgaggctgacttattactgtcagtcctttgacagcagcctgagtgcttatgtctcggactggaccaaggtcacgtctaggtcacgcccaaggccaacccntcgtacactcctcgttccccgcccttctcactccacgtgtactgacgcgggctggaccaggcgcatacgnnnnnannnnnnnnnnnnnn

SEQ ID NO: 162806 - DNA, 464 bp, Homo sapiens
  misc_feature: GYAE6OF01ARGUC.34.86.H09.1.454.CMB.1.raw
  modified_base (441)..(441): a, c, t, g, unknown or other
  misc_feature (441)..(441): n is a, c, g, or t
  modified_base (452)..(452): a, c, t, g, unknown or other
  misc_feature (452)..(452): n is a, c, g, or t
  modified_base (458)..(464): a, c, t, g, unknown or other
  misc_feature (458)..(464): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccgggctgaggatgaggctgattattactgtcagtcctttgacagtagcctgagtgctttatgtcttcggaactgggaccaaggtcaccgtctaggtcagcccaaggcccaaccccactgtcactctcgttccccaccctcctcactcacgtgtactgagccgggntggcaagggcncatagnnnnnnn

SEQ ID NO: 162807 - DNA, 455 bp, Homo sapiens
  misc_feature: GYAE6OF01EVDIF.34.86.H09.1.454.CMB.1.raw
  modified_base (448)..(455): a, c, t, g, unknown or other
  misc_feature (448)..(455): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtaccagcagattcccggaacagcccccaaactcctcatctttggtaacaacaatcggccctcaggggtccctgaccgattttctgcctccaagtctggcacctcagcctccctggacattattggactccagcctgaggatgaggctgattattactgtcagtcacatgacaacaccctgggcgggtcttcggcggagggaccaagctgaccgtctcagtcagcccaaggctgcccctcggtcactctcgttcccgccctcctcactcacgtgtactgagcgggctggcaaggcgcatagnnnnnnnn

SEQ ID NO: 162808 - DNA, 466 bp, Homo sapiens
  misc_feature: GYAE6OF01D0BV0.34.86.H09.1.454.CMB.1.raw
  modified_base (456)..(466): a, c, t, g, unknown or other
  misc_feature (456)..(466): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaatcctcatctatgctaacaccaatcggccctcaggggtccctgaccgattctctggctccaagtctggcacctcagcctccctggccatcactgggctccgggctgaggatgaggctgattattactgtcagtcctttgacagcagcctgagtgcttatgtcttcggaactgggaccaaggtcaccgtctaggtcagcccaaggccaaccccactcgtcactctcgttcccgccctccctcactcacgttgttactgagcgggctggcaaggcgcatagnnnnnnnnnnn

SEQ ID NO: 162809 - DNA, 464 bp, Homo sapiens
  misc_feature: GYAE6OF01BCR8I.34.86.H09.1.454.CMB.1.raw
  modified_base (384)..(384): a, c, t, g, unknown or other
  misc_feature (384)..(384): n is a, c, g, or t
  modified_base (448)..(464): a, c, t, g, unknown or other
  misc_feature (448)..(464): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccgggctgaggatgaggctgattattactgtcagtcctttgacagcagcctgagtgcttatgtctcggaactgggacaaggtcacgtctagtcagcccaagccaacccnctgtcactctcgttcccaccctcctcactcacgtgtactgacgcgggctggcaaggcgcatagnnnnnnnnnnnnnnnnn

SEQ ID NO: 162810 - DNA, 479 bp, Homo sapiens
  misc_feature: GYAE6OF01CD6VI.34.86.H09.1.454.CMB.1.raw
  modified_base (462)..(479): a, c, t, g, unknown or other
  misc_feature (462)..(479): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccgggctgaggatgaggctgattattactgtcagttcctttgacagcagcctgagtgcttatgtcttcggaactgggaccaaggtcaccgtcaggtcagcccaagcccaacccactgtcactcctcgttccccaccctcctctactcccgtgtacctgacggcgggctgggacaacggcgcagtagnnnnnnnnnnnnnnnnnn

SEQ ID NO: 162811 - DNA, 248 bp, Homo sapiens
  misc_feature: GYAE6OF01A7T42.34.86.H09.1.454.CMB.1.raw
  modified_base (246)..(248): a, c, t, g, unknown or other
  misc_feature (246)..(248): n is a, c, g, or t
tcagtacacgtgatcacgaccggtgctcgatttagtgctatagacttgggtttgggggtgtggtggtctccactcccgccttgacgaggctgactactactgtcagtcttatgataatgacaatcatgtgatattcggcggagggaccaaactgaccgtcctgagtcagcccaaggctgccccctcggtcactctgttcccgccctcctcatcacgtgtactgagcgggctggcaaggcgcatagnnn

SEQ ID NO: 162812 - DNA, 480 bp, Homo sapiens
  misc_feature: GYAE6OF01EEFCH.34.86.H09.1.454.CMB.1.raw
  modified_base (399)..(399): a, c, t, g, unknown or other
  misc_feature (399)..(399): n is a, c, g, or t
  modified_base (461)..(461): a, c, t, g, unknown or other
  misc_feature (461)..(461): n is a, c, g, or t
  modified_base (467)..(480): a, c, t, g, unknown or other
  misc_feature (467)..(480): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcacgcctccctggccatcactgggctccaggctgaggatgaggctgattattactgtcagttcctttgactgcagcctgagtgtcttatgtcgttcggaactcgggaccaaggtccaccgtcgtaggtcacgcccaacggcccaacccntcgtcactctcgttccccgcccttcctcatcacgttcgtactgagcgggctgggcaaggcgnagtagnnnnnnnnnnnnnn

SEQ ID NO: 162813 - DNA, 472 bp, Homo sapiens
  misc_feature: GYAE6OF01AE2LO.34.86.H09.1.454.CMB.1.raw
  modified_base (389)..(389): a, c, t, g, unknown or other
  misc_feature (389)..(389): n is a, c, g, or t
  modified_base (462)..(472): a, c, t, g, unknown or other
  misc_feature (462)..(472): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtcccctgaccgattctctggctccaagtctggcacctcagcctccctggccatcactgggctccgggctgaggatgaggctgattattactgtcagtcctttgacagcagcctgagtgcttatgtcttcggaactgggaccaaggtcaccgtctaggtcagcccagcccaacccnctgtcactctcgttccccgccctcctcactccacgttcgtactgacgcgggctgggcgaacgggccgcatagnnnnnnnnnnn

SEQ ID NO: 162814 - DNA, 461 bp, Homo sapiens
  misc_feature: GYAE6OF01EJLAQ.34.86.H09.1.454.CMB.1.raw
  modified_base (388)..(388): a, c, t, g, unknown or other
  misc_feature (388)..(388): n is a, c, g, or t
  modified_base (448)..(461): a, c, t, g, unknown or other
  misc_feature (448)..(461): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccgggctgaggatgaggctgattatactgtcagttcctttgacagcagcctgagtgcttatgtcttcggaactgggaccaggtcaccgtctaggtcagcccaagcccaacccntgtcactctcgtcccgccctcctcatccacgtgtactgagcgggctggcaggcgcatagnnnnnnnnnnnnnn

SEQ ID NO: 162815 - DNA, 476 bp, Homo sapiens
  misc_feature: GYAE6OF01DQZFO.34.86.H09.1.454.CMB.1.raw
  modified_base (393)..(393): a, c, t, g, unknown or other
  misc_feature (393)..(393): n is a, c, g, or t
  modified_base (458)..(458): a, c, t, g, unknown or other
  misc_feature (458)..(458): n is a, c, g, or t
  modified_base (463)..(476): a, c, t, g, unknown or other
  misc_feature (463)..(476): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagccctccctggccatcactgggctcgggctgaggatgagctgattatactgtcagtcctttgacagcagcctgagtgcttatgtcgttcggaactgggaccaaggtccaccgtcctaggtcacgcccaacggcccaacccntcgtccacttctcgttccccaccctcctactactccacgttgtactgacggcggctggcaaggcnatagnnnnnnnnnnnnnn

SEQ ID NO: 162816 - DNA, 550 bp, Homo sapiens
  misc_feature: GYAE6OF01C9AND.34.86.H09.1.454.CMB.1.raw
  modified_base (278)..(278): a, c, t, g, unknown or other
  misc_feature (278)..(278): n is a, c, g, or t
  modified_base (304)..(304): a, c, t, g, unknown or other
  misc_feature (304)..(304): n is a, c, g, or t
tcagtacacgtgatcacgaccggtgctcgatttagtgctatagacttgggtttggggggggtctcaggaggcagcgctctcgggacgtctccaccatggcctgggctctgctattcctcaccctctcactcagggcacagggtcctgggcccagtctgccctgactcaggctgcctcgtgtctgggtctcctggacagtcgatcaccatctcctgcactgtaaccggcagtgacgttgatgattataagtctgtctcctggtaccaacaacacccggnaaacgctacccaaactcatgatttangatgtacaataactcggccctcgaggttgtttctcatcgtcttctctcgcctcatcgtctcggacaaccgacgccctcccgtgacctactctcgtcggacctccgaggcgtaggacggacggtagggttgtagttacttacgtcgccgtctctatatactattccactacgccactctcgtatcgtagtacgtttcggaggtacgggaccaaacgtctacccgtcttacgtacacgccgaggtccg

SEQ ID NO: 162817 - DNA, 461 bp, Homo sapiens
  misc_feature: GYAE6OF01BGQKI.34.86.H09.1.454.CMB.1.raw
  modified_base (337)..(337): a, c, t, g, unknown or other
  misc_feature (337)..(337): n is a, c, g, or t
  modified_base (396)..(396): a, c, t, g, unknown or other
  misc_feature (396)..(396): n is a, c, g, or t
  modified_base (431)..(431): a, c, t, g, unknown or other
  misc_feature (431)..(431): n is a, c, g, or t
  modified_base (452)..(452): a, c, t, g, unknown or other
  misc_feature (452)..(452): n is a, c, g, or t
  modified_base (456)..(461): a, c, t, g, unknown or other
  misc_feature (456)..(461): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagccctccctggccatcactgggcctccggggctggaggatgaggctgatttattactgtcagttcctttgacagcagcctgagtncttatgttcttcggaactgggaccaaggtcaccgtctaggtcagcccaagcccaacccntgtcactctcgtccccaccctcctcactcacgttntactgagcggctggacaggcnatgnnnnnn

SEQ ID NO: 162818 - DNA, 509 bp, Homo sapiens
  misc_feature: GYAE6OF01B7FN9.34.86.H09.1.454.CMB.1.raw
  modified_base (416)..(416): a, c, t, g, unknown or other
  misc_feature (416)..(416): n is a, c, g, or t
  modified_base (489)..(509): a, c, t, g, unknown or other
  misc_feature (489)..(509): n is a, c, g, or t
tcagtacacgtgatcacgaccggtgctcgatttagtgctatagacttggggtttgggggctgttcctggaagctgcttgtaccagagggtcaccatctcctgcactgggagcagctccaacagtcggggcaggttatgatgtacactggtacaagcagcttccaggaacagcccccaaatcctcatctatgctaacaccaagtcggccctcgaggggtccctgaccgattctctggctaccaagtctggcacctcacgccctccctggaccatccacgtcggggccttccgggctggaggatggaggctgtatttacgttacgtgtctagtcctttgacagcagcctgagtgcttatcgtcttacggaactgggaaccaggtccaccgtcgtaggtcacgcccaacgcccaacccntcgtctactccttcgtccccaccctcctcactcctacgtgtactggacgcggctggacgaaggcgacagtagnnnnnnnnnnnnnnnnnnnnn

SEQ ID NO: 162819 - DNA, 483 bp, Homo sapiens
  misc_feature: GYAE6OF01DMUVB.34.86.H09.1.454.CMB.1.raw
  modified_base (288)..(288): a, c, t, g, unknown or other
  misc_feature (288)..(288): n is a, c, g, or t
  modified_base (394)..(394): a, c, t, g, unknown or other
  misc_feature (394)..(394): n is a, c, g, or t
  modified_base (470)..(483): a, c, t, g, unknown or other
  misc_feature (470)..(483): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcacgcctccctggccatcactgggctccgggctgaggntgaggctgatttattactgtctagtcctttgacagcagcctgagtgctttatgtcttggaactgggacaaggtcaccgtctaggtcacgcccaacggcccaacccnctgtcctacttcctcgttccccgcccttcctctactccacgtcgtactggaggcgggtctggacaaggcgcatagnnnnnnnnnnnnnn

SEQ ID NO: 162820 - DNA, 648 bp, Homo sapiens
  misc_feature: GYAE6OF01D7P2W.34.86.H09.1.454.CMB.1.raw
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggacgggtcaccatcctcctgcacgtgggacgcagctaccaacgacgtcgggggactagggtttatgatcgtacacgtggtaacaagcagtccttaccgaaggaaccaccgacccccaaactcctacactctactcgactaaccaccaacgtccggcctacgacgggtccctagacctattctcgtcgcctaccgtaagtcctacggcctaccctcgaccgtcccgtcccgtacggccctacgtccgtaccggtcgggtcccgtccggggtacgttacgggaacggtacgttcgggaacggtccttagtaactttacgttacgttcggtaccgttacgtttccgttagaccgtacggtcgacgtcccgttagtacgttcgttacctttacggttccggtttaccggttaaccgggaaccggttaacccgggg

SEQ ID NO: 162821 - DNA, 459 bp, Homo sapiens
  misc_feature: GYAE6OF01C1JNO.34.86.H09.1.454.CMB.1.raw
  modified_base (427)..(427): a, c, t, g, unknown or other
  misc_feature (427)..(427): n is a, c, g, or t
  modified_base (447)..(447): a, c, t, g, unknown or other
  misc_feature (447)..(447): n is a, c, g, or t
  modified_base (451)..(459): a, c, t, g, unknown or other
  misc_feature (451)..(459): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcgggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccggctgaggatgaggctgattattactgtcagtcctttgacagcagcctgagtgcttatgtcttcggaatgggaccaaggtcaccgtctaggtcagcccaaggcccaaccccactcgtcacttctcgttccccgccctcctcatcacgtntactgagcggctggcaggcnatgnnnnnnnnn

SEQ ID NO: 162822 - DNA, 488 bp, Homo sapiens
  misc_feature: GYAE6OF01EF27E.34.86.H09.1.454.CMB.1.raw
  modified_base (467)..(469): a, c, t, g, unknown or other
  misc_feature (467)..(469): n is a, c, g, or t
  modified_base (471)..(488): a, c, t, g, unknown or other
  misc_feature (471)..(488): n is a, c, g, or t
tcagtacacgtgatcacgaccggtgctcgatttagtgctatagacttgggtttggggggctggttcctggaagctgcttgtaccagagggtcaccatctccctgcactgggagcagctccaacatcggggcaggttatgatgtacactggtacaagctagcttccaggaactaagcccccaaactcctcatctatgctaacaccaatcggcccgtcaggggtccctgaccgagttctctggctccaagtctggcacctcagcctccctgccatcactgggctccgggctgaggatggaggctgattagtacgtgtcagtcctttgacagcagcctgagtgcttatgtcttcggaactgggaccaaggtccaccgttccgtaggtcagcccaaggcccaacccatcgtcactctcgttcccaccctcctcactcacgtgtactgagcggctggacagggccacatagnnngnnnnnnnnnnnnnnnnnn

SEQ ID NO: 162823 - DNA, 482 bp, Homo sapiens
  misc_feature: GYAE6OF01D1LZ1.34.86.H09.1.454.CMB.1.raw
  modified_base (388)..(388): a, c, t, g, unknown or other
  misc_feature (388)..(388): n is a, c, g, or t
  modified_base (467)..(482): a, c, t, g, unknown or other
  misc_feature (467)..(482): n is a, c, g, or t
tcagtacacgtgatcacgaccggtgctcgatttagtgctatagacttgggtttgggggctgttcctggaagctgcttgtaccagagggtcaccatctcctgcactggggagcagctccaacatcgggggcaggttatgatgtacactggtacaagcagcttccaggaacagcccccaaactcctcatctatgctaacaccaatcggccctcaggggtccctgaccgattctctggctccaagtctggcacctcagcctccctgccatcactggctcgggctgaggatgaggctgattattactgtcagtcctttgacagcagcctgagtgcttatgtcttcggaactgggaccaaggtcaccgtctaggtcagcccaagcccaacccnctcgtcactctcgttccccgccctcctctactccacgtcgtaactggacggcggcgtgggaccaagggcgacagtacgnnnnnnnnnnnnnnnn

SEQ ID NO: 162824 - DNA, 524 bp, Homo sapiens
  misc_feature: GYAE6OF01A25H3.34.86.H09.1.454.CMB.1.raw
tcagtacacgtgatcacgaccggtgctcgatttagtgctatagacttgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacacccggcaaagctcccaaactcatgatttatgatgtcaataatcggccctcaggtgtttctcatcgcttctctgcctcatgtctggcaacacggcctccctcgaccatctctcggacctccgaggctgaggacgaggtgattattactgcgcctcaattatacattcacttcgcctactctcgatgtgtagtttcggaggacgggtaccaaactccaacccgttccttcgtaccacgccccgtaaggtccc

SEQ ID NO: 162825 - DNA, 473 bp, Homo sapiens
  misc_feature: GYAE6OF01BPZQA.34.86.H09.1.454.CMB.1.raw
  modified_base (458)..(473): a, c, t, g, unknown or other
  misc_feature (458)..(473): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctcctggccatcactgggctccgggctgaggatgaggctgattatactgtcagtcctttgacagcagcctgagtgcttatgtcttcggaactgggaccaaggtccaccgtcctaggtcacgacccaacggcccaaccccactcgtcactctcgttcccaccctcctcatccacgtgtactgacgcggctggcaaggcgcatcgnnnnnnnnnnnnnnnn

SEQ ID NO: 162826 - DNA, 518 bp, Homo sapiens
  misc_feature: GYAE6OF01BQRBQ.34.86.H09.1.454.CMB.1.raw
  modified_base (477)..(477): a, c, t, g, unknown or other
  misc_feature (477)..(477): n is a, c, g, or t
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacagtcggggcaggttatgatgtacactggtacagcagctccaggaacacgcccccaaactcctcactctatcgactaaacaccaatccggccctcgacggggtccctgacccgtattcctctggcctaccaagtctggaccaccctcacgccctcccgtggcccatccacgtcgggctccgggctgaggatggacggtctagtatttatactgtcagttccttgacngcaggcctgagtcgtacttagtgttccttgggacgtacggg

SEQ ID NO: 162827 - DNA, 514 bp, Homo sapiens
  misc_feature: GYAE6OF01CVGUQ.34.86.H09.1.454.CMB.1.raw
  modified_base (347)..(347): a, c, t, g, unknown or other
  misc_feature (347)..(347): n is a, c, g, or t
  modified_base (423)..(423): a, c, t, g, unknown or other
  misc_feature (423)..(423): n is a, c, g, or t
  modified_base (445)..(445): a, c, t, g, unknown or other
  misc_feature (445)..(445): n is a, c, g, or t
  modified_base (498)..(514): a, c, t, g, unknown or other
  misc_feature (498)..(514): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcgggggcaggttatgatgtacactggtacaagcagcttccaggaacacgccccccaaactcctcatctatgactaacaccaatccggccctcgacggggtccctgacccgtattcctctggcctccaagtcctggccacctcagccctccctggcccatcgaggtcgggcctccggtctggaggatggaggcctgacttattactggtgcagcagtgggatgacngcctgaatggcttctatcgtctacggaacgtcgggaaccaggtcaccgtctaggtcacgcccaacgcccaaccctntcgtcaccttctccgttccccnccctccactccacgttcaccgtggacgcgggcgtcggcaacggcacagtacgnnnnnnnnnnnnnnnnn

SEQ ID NO: 162828 - DNA, 542 bp, Homo sapiens
  misc_feature: GYAE6OF01BTKQQ.34.86.H09.1.454.CMB.1.raw
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacagtcggggcaggttatgatgtacactggtacaagcagcttccaggaacacgccccaaactcctcatctatgctaacaccaatccggccctcgacgggtccctgaccgattctctggctccaagtctggccacctcacgtccctcccgtcggccactccacgtcgggcctccggggctggaggatcggacgtctgtattattactgtcagttccttagactagctacgcctgtagtcgtacttagtcgtcgttaccggtacgtacgggacctaacggtcaccccggtctacggtctacggtaaccccg

SEQ ID NO: 162829 - DNA, 603 bp, Homo sapiens
  misc_feature: GYAE6OF01EH3MX.34.86.H09.1.454.CMB.1.raw
  modified_base (227)..(227): a, c, t, g, unknown or other
  misc_feature (227)..(227): n is a, c, g, or t
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctgggcccagtctgtgctgacgcagccgccctcagtgtctcggggccccagggcaggagggtcaccatctcctgcactgggancagctaccaacagtcggggcaggttatgatgtgctagttcggtaaccaacagccttaccgaagggaaccacggaccccaaactcctacatctacaggtcgaacaacaacgtccggccctacggacgggtccctgggaccctattccgtcgtcggacctaccgaagtctcggccttcctcgacgtccctcccgtcggacctatcctacgtcggcctcgaggtctggagagtggacgtctagtatttacgtacgtcgtccgtgtacctagtcgaacaacgtcgtccgttagtacgttagtttagtcgttaccgttacggtacgtacgggtaaccgtaacggtcccgtaccgttccgttacggtccgacgtaaccccgg

SEQ ID NO: 162830 - DNA, 488 bp, Homo sapiens
  misc_feature: GYAE6OF01A36TJ.34.86.H09.1.454.CMB.1.raw
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (473)..(488): a, c, t, g, unknown or other
  misc_feature (473)..(488): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcgggggcaggttatgatgtacactggtacaagcagcttccaggaacagcccccaaatcctcatctatgctaacaccaatcggccctcaggggtcccctgaccgattctctggctccaagtctggcacctcagccctccgtggccatcacgtgggctccgggctggaggatggaggctgtatttattactgtcagttcctttgactgcagctgtagtgtacttatcgtcttacggaactcgggaccaaggtccaccgtctaggtccagcccgaacgcccaacccntcgtcacttcctcgttcccnccctcctcactcacgtntacngacggcggcgtggacaggcacatagnnnnnnnnnnnnnnnn

SEQ ID NO: 162831 - DNA, 588 bp, Homo sapiens
  misc_feature: GYAE6OF01DH4ZA.34.86.H09.1.454.CMB.1.raw
  modified_base (295)..(295): a, c, t, g, unknown or other
  misc_feature (295)..(295): n is a, c, g, or t
  modified_base (570)..(588): a, c, t, g, unknown or other
  misc_feature (570)..(588): n is a, c, g, or t
tcagtacacgtgatcacgaccggtgctcgatttagtgctatagacttgggtttgggggctgttcctggaagctgcttgtaccagagggtcaccatctcctgcactggggagcagctccaacatcgggggcaggttatgatgtacactggtacaagcagcttccaggaacagccccccaaactcctcatctatgctaacaaccaatcggccctcaggggtccctgaccgattctctggctccaagtctggcacctcagccctccctggccatccacgtgggctccgggctggaggngtggaggctagatttattactgtctagttcctttagacgagcacgcctggagtgtctttagtcgttccgttacgggaaaccgtcgggaacccgtaacggtcccgtacccgttaccgttagggtacccaacggtacccccgaacgggacccccaacccccgtacgttccgtacctacccgtttccgttacccggttcccccgcccccttacctctaccttccgacggtttcgtacgcgggacggcgggtccgtggaccgtaagggccacgatacgnnnnnnnnnnnnnnnnnnn

SEQ ID NO: 162832 - DNA, 480 bp, Homo sapiens
  misc_feature: GYAE6OF01BJYZ1.34.86.H09.1.454.CMB.1.raw
  modified_base (472)..(480): a, c, t, g, unknown or other
  misc_feature (472)..(480): n is a, c, g, or t
tcagtacacgtgatcacgaccggtgctcgatttagtgctatagacttggggtttgggggctgttcctggaagctgcttgtaccagagggtcaccatctcctgcactggggagcagctccaacatcgggggcaggttatgatgtacactggtacaagcagcttccaggaacacgcccccaaactcctcatctatgctaacaccaatccggccctcaggggtccctgaccgattctctggctccaagtctggcacctcagcctccctggccatcactgggctccgggctggaggatgaggctgattattactgtctagtcctttgacagcagcctgagtgcttatcgtcttcggaacgtgggaccaaggtcctaccgtcctaggtccacgcccaagaccccaacccgctcgtcactcctccgttccccgccctcctcactcgacgtgtactggagcggctggcaggcacatgcnnnnnnnnn

SEQ ID NO: 162833 - DNA, 514 bp, Homo sapiens
  misc_feature: GYAE6OF01DYBBV.34.86.H09.1.454.CMB.1.raw
  modified_base (496)..(514): a, c, t, g, unknown or other
  misc_feature (496)..(514): n is a, c, g, or t
tcagtacacgtgatcacgaccggtgctcgatttagtgctatagacttgggtttgggggctgttcctggaagctgcttgtaccagagggtcaccatctcctgcactgggagcagcctccaacatcggggcaggttatgatgtacactggtacaagcagcttccaggaacagcccccaaactcctcatctatgctaacaccaatcggccctcaggggtccctgaccgattctctggctccaagtctggcacctcagcctccctgccatcacgtgggctcggctgaggatgagctgattatactgtcagttccttgactagcagcctgagtgtcttatcgtcgttacggaacgttagggaccaaggtccaaccggttcctaagggtccaacggcccaaacggccccaaccccgtatcgtccaccttccgtccgttaccccacccttcctcactccacgttctactgacggcggctcgggactaacgggcgactagtagnnnnnnnnnnnnnnnnnnn

SEQ ID NO: 162834 - DNA, 641 bp, Homo sapiens
  misc_feature: GYAE6OF01D550V.34.86.H09.1.454.CMB.1.raw
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacagggtcctgggcccagtctgtgctgacgcacgcccgccctcagtgtcgtcggggccccagggcagagggtccaccatcctcctgcacgtgggagcagcctaccaacgagtccggggactaggttactgattcgtaacacgtggtaacaagcagtccttaccgaacggaaccaccgacccccaaactcctacatctatcgactaacaccaagtccgacctcgacgggtccctacggaccgtacttctcgtacggtacctaccgtaacgtccgtacgacctacccgtaccgaccgtcccctcccgtcggaccctacgtccgtacgggtccgggtccgttccggtacgtagggacggtacgtacggacggtcgttacgtaacttacgttaccggtggtccgacgacgtacgtacggtagggacgttacggaccgtacggtaccgtacggtaacgttccggtacctttaccgttagttcggttaacccggg

SEQ ID NO: 162835 - DNA, 507 bp, Homo sapiens
  misc_feature: GYAE6OF01A4Y0Y.34.86.H09.1.454.CMB.1.raw
  modified_base (443)..(443): a, c, t, g, unknown or other
  misc_feature (443)..(443): n is a, c, g, or t
  modified_base (466)..(466): a, c, t, g, unknown or other
  misc_feature (466)..(466): n is a, c, g, or t
  modified_base (487)..(487): a, c, t, g, unknown or other
  misc_feature (487)..(487): n is a, c, g, or t
  modified_base (492)..(507): a, c, t, g, unknown or other
  misc_feature (492)..(507): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcgggggcaggttatgatgtacactggtacaagcagcttccaggaacagcccccaaactcctcatctatgctaacaccaatcggccctcacggggtccctgaccgattctctggctccaagtctggcacctcacgcctccctggcccatccacgtggggcctccggggctggaggatggaggtctgtattattactgtcagttcctttgacagcagcctgagtgcttatgttcgttcggaacgtcgggaacctaaggtccaccgttcctaggtccaggcccaacggccccaaccccactcgtaccacgtcctccgttccccnccctcctctactcgacgtgtacngacggcggctggacgaggcanatagnnnnnnnnnnnnnnnn

SEQ ID NO: 162836 - DNA, 518 bp, Homo sapiens
  misc_feature: GYAE6OF01EMORC.34.86.H09.1.454.CMB.1.raw
  modified_base (290)..(290): a, c, t, g, unknown or other
  misc_feature (290)..(290): n is a, c, g, or t
  modified_base (500)..(518): a, c, t, g, unknown or other
  misc_feature (500)..(518): n is a, c, g, or t
tcagtacacgtgatcacgaccggtgctcgatttagtgctatagacttgggtttgggggtctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcacgccctccctggccatcacgtggctccgggctgaggntggaggctgatttattactgtctagtcctttgacagcagcctgagtgtcttatcgttcgttacgggaacgtggggaaccaagggtcctacccggttctaggtccacggaccccaacggcccaacccccatcgtactaccttccttccgttccccgccccttcctcactcctacgtcgtactgcggcgggctgggacagggcgcagtagcnnnnnnnnnnnnnnnnnnn

SEQ ID NO: 162837 - DNA, 661 bp, Homo sapiens
  misc_feature: GYAE6OF01CHOC4.34.86.H09.1.454.CMB.1.raw
  modified_base (230)..(230): a, c, t, g, unknown or other
  misc_feature (230)..(230): n is a, c, g, or t
tcagtacacgtgatcacgaccggtgctcgatttagtgctatagacttggggtttgggggtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggagggtcaccatctcctgcacgtgggancagctaccaacacgtcggggcaggttatgatagtacacgtggtaacagcagcttaccaggaacacgaccccaaactcctcactctatcgactaacaccaactccggcctcgacgggtccctcgtaccgtatttcgctcctaccaacgtctaggcctacctacacgtccctcgtaacgtcggaactatttacgtcggtaacctccgtaacgtcccgtggtaacggtagtacggacggtaccgtagttaactttaagttacgttacgttaccgtaacgtaccgtacaacttacggaacctacccggtaaccggtcgggggtacccggggtttccgttacgggggaccgggtaacgggaacggtaacggtccgtacggtacccgttaccgtacgtaacggtacccgtaaccgacccggtaaccgggtaccccgg

SEQ ID NO: 162838 - DNA, 525 bp, Homo sapiens
  misc_feature: GYAE6OF01EU040.34.86.H09.1.454.CMB.1.raw
  modified_base (410)..(410): a, c, t, g, unknown or other
  misc_feature (410)..(410): n is a, c, g, or t
  modified_base (441)..(441): a, c, t, g, unknown or other
  misc_feature (441)..(441): n is a, c, g, or t
  modified_base (507)..(525): a, c, t, g, unknown or other
  misc_feature (507)..(525): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcgggggcaggttatgatgtacactggtacaagcagcttccaggaacagcccccaaactcctcatctatgctaacaccaatccggccctcaggggtccctgaccgattctctggctccaagtctggcacctcacgccctccctggccatccactgggctccgggctgaggatggaggctgatttattactgtcagttcctttgactagccagcctgagttgctttatgtcttcggaacgtgggaccaaggtccaccgttcgtaggtccacgcccaacggcccaaccccntcgtcacttcctcgttccccgccccttcccnctactcctacgtcgtacgtggaccgggcgggcgtacgggaccgaacgggtccgcgtaacgtaacgnnnnnnnnnnnnnnnnnnn

SEQ ID NO: 162839 - DNA, 544 bp, Homo sapiens
  misc_feature: GYAE6OF01BHP5I.34.86.H09.1.454.CMB.1.raw
  modified_base (242)..(242): a, c, t, g, unknown or other
  misc_feature (242)..(242): n is a, c, g, or t
  modified_base (316)..(316): a, c, t, g, unknown or other
  misc_feature (316)..(316): n is a, c, g, or t
  modified_base (416)..(416): a, c, t, g, unknown or other
  misc_feature (416)..(416): n is a, c, g, or t
  modified_base (440)..(440): a, c, t, g, unknown or other
  misc_feature (440)..(440): n is a, c, g, or t
  modified_base (454)..(454): a, c, t, g, unknown or other
  misc_feature (454)..(454): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggagggtccaccatcctcctgcacgtgggancagcctccaacagtcggggcaggttatgatgtacacgtggtacagcagctcaggaccacgacccccaaactccncactctatcgacctaacaccaacgtccgaccctcgacgggtccctcgaccgtacttctctggtacctccgaagtctcggaccacctcacgtccctcccgngcccatccacgtgggcctccgggntggagtgtggacgngtgtatttattacgtgtctagttccttgacgagtcacgtcgtagtcgtgttcttagttcggttcgttacggaccgttgggaccgtaacgg

SEQ ID NO: 162840 - DNA, 471 bp, Homo sapiens
  misc_feature: GYAE6OF01DT536.34.86.H09.1.454.CMB.1.raw
  modified_base (461)..(471): a, c, t, g, unknown or other
  misc_feature (461)..(471): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccgggctgaggatgaggctgattattactgtcagtcctttgacagcagcctgagtgcttatgtcttcggaactgggaccaaggtcaccgtcctaggtcacgcccaaggcccaaccccactgtcactctcgttccccaccctcctcactcacgtgtactgacggcgggctggacgaaggcgcatagnnnnnnnnnnn

SEQ ID NO: 162841 - DNA, 543 bp, Homo sapiens
  misc_feature: GYAE6OF01CMBKQ.34.86.H09.1.454.CMB.1.raw
  modified_base (488)..(488): a, c, t, g, unknown or other
  misc_feature (488)..(488): n is a, c, g, or t
  modified_base (523)..(543): a, c, t, g, unknown or other
  misc_feature (523)..(543): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcgggggcaggttatgatgtacactggtacaagcagcttccaggaacacgcccccaaatcctcatctatgctaacaccaatcggccctcgaggggtccctgaccgattctctggcctaccaagtcctggccacctcacgccctccctggccatcactgggcctcggctgaggatgaggctgattattactgtctagtcctttagacagtcagcctgagtgcttagttcgtcgttacgggaactcggggaacctaagggtcccacccggttctagggtccaacgtaccccgaacgggaccccaaacccctacgtcgtacccaaccgttccttcgttaccccccacctcccttcactcacgtcgtacgngacggcgggctcgggacgaacgggcacgatacggnnnnnnnnnnnnnnnnnnnnn

SEQ ID NO: 162842 - DNA, 679 bp, Homo sapiens
  misc_feature: GYAE6OF01A0VO1.34.86.H09.1.454.CMB.1.raw
  modified_base (190)..(190): a, c, t, g, unknown or other
  misc_feature (190)..(190): n is a, c, g, or t
  modified_base (244)..(244): a, c, t, g, unknown or other
  misc_feature (244)..(244): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcacgcccgccctnagtgtcgtcggggccccagggcaggagggtccaccatcctcctgcacgtgggancagcctccaacagtcggggcaggttatgatgtacacgtggtacaagcagtcttaccgaggaaccacgacccccaaactcctacacttctatcgacctaaccaaccctaacgtccggaccctcggaccggggttcccctaggacccgtatttccgtcgtcgggtccctaccgtaacgttccgtacggaccctacctcgaccggtccccttcccggtcggaccctagtccgtacgggtccgggtcctcccgggttacgtgggaacgggtagtcgggacgggttccttacggtaacctttacgtttaacgttgggttacgacccgtaggtccgtaaagggtcgggtaacgttcggaaccgtacggtccgttacggtaacgttccgggtaccctttacgttaaggttccgggtttaccgttaaccggggtaaacccggg

SEQ ID NO: 162843 - DNA, 589 bp, Homo sapiens
  misc_feature: GYAE6OF01BRG3W.34.86.H09.1.454.CMB.1.raw
  modified_base (577)..(578): a, c, t, g, unknown or other
  misc_feature (577)..(578): n is a, c, g, or t
  modified_base (581)..(582): a, c, t, g, unknown or other
  misc_feature (581)..(582): n is a, c, g, or t
  modified_base (584)..(587): a, c, t, g, unknown or other
  misc_feature (584)..(587): n is a, c, g, or t
  modified_base (589)..(589): a, c, t, g, unknown or other
  misc_feature (589)..(589): n is a, c, g, or t
tcagtacacgtgatcacgaccggtgctcgatttagtgctatagacttgggtttgggggccgttcctgggcccagtctgtgctgactcagccaccctcagcgtctgggacccccgggcagagggtcaccatctcctgcactgggagcagctccaacatcggggcaggttatgatgtacactggtacaagcagcttccaggaacagcccccaaactcctcatctatgctaacaccaatccggccctcgaggggtccctgaccgattctctgcctccaagtctggcacctcacgccctcccgtggactatttacttggacctccagcctgaggatgaggctagtattattactgtcagtcacatgaacaacgacccgtggggcgggttctcggcggagggaccaggcctggaccgtcctacgacgtcgacgcccgaaggccctaccggcccccgttcggtccctaccgttccttccgtttacccccacccgtttccctacctacgtcccgtaaccggttcgttaccgttggaccgggtcggggccttacggggaccaaacggggccgacgtagtacggcnnganngnnnngn

SEQ ID NO: 162844 - DNA, 737 bp, Homo sapiens
  misc_feature: GYAE6OF01CD5P6.34.86.H09.1.454.CMB.1.raw
  modified_base (248)..(248): a, c, t, g, unknown or other
  misc_feature (248)..(248): n is a, c, g, or t
  modified_base (261)..(261): a, c, t, g, unknown or other
  misc_feature (261)..(261): n is a, c, g, or t
  modified_base (278)..(278): a, c, t, g, unknown or other
  misc_feature (278)..(278): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcacgcccgccctcagtcgtccgtcggggcccccagggccaggacgggtcaccatcctcctgcacgtgggancagcctaccaacngtcggggctaaggttangtatgtaacacgtaggtaacaagccagtccttacgaacggaaccaccgacccccaaactcctacattacctagtacgaactaaaccacctaacgtcccggaccctacggaaccgggttcccctacggtaccccgttatttccctcggttacggtccttacccgaacgttccgtacggtacccctaacccgtcccgtaaccgtcccccgttcccggtacggaccctacgtacccgtaccggtccggggtaccccgtccggggtactagggacggtacgtacgggtaacggttccttaaggttaactttacgttaccgttacggttccttaacgtttcccgtttacggaaccgtacggtacccgtacggtaccgtttacgggcgtttacgttacgtttaccggttcgttaacccgggttaacccggaaaccgttcccgggggtaaccgttaaaccccgggg

SEQ ID NO: 162845 - DNA, 635 bp, Homo sapiens
  misc_feature: GYAE6OF01B4EAY.34.86.H09.1.454.CMB.1.raw
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacagtcggggcaggttatgatgtacactggtacaagcagctccaggaacacgacccccaaatcctcatctatcgactaaacaccaaatccggccctacgacggggtccctggaacccgtatttccgtcgtcggcctaccgtaacgtccttacgggcctaccgtccacgtccctccccgtcggaccctactccgacgttcgggcccgtacccgggcgttgggaacggacgttggaacggtcgttaggtaacttttaacgttaccgttcggttaccgtaacgtttcccgtttagaccgtacggccgtaacggtcccgtaggtacgttcgttaccgtttaagttcggttaccgtttaaccggggaaccgttcggggtaacccgttaaaccgggg

SEQ ID NO: 162846 - DNA, 650 bp, Homo sapiens
  misc_feature: GYAE6OF01CYLR3.34.86.H09.1.454.CMB.1.raw
  modified_base (626)..(626): a, c, t, g, unknown or other
  misc_feature (626)..(626): n is a, c, g, or t
  modified_base (628)..(630): a, c, t, g, unknown or other
  misc_feature (628)..(630): n is a, c, g, or t
  modified_base (632)..(636): a, c, t, g, unknown or other
  misc_feature (632)..(636): n is a, c, g, or t
  modified_base (638)..(650): a, c, t, g, unknown or other
  misc_feature (638)..(650): n is a, c, g, or t
tcagtacacgtgatcacgaccggtgctcgatttagtgctatagacttgggtttgggggctgttcctggaagctgcttgtaccagagggtcaccatctcctgcacgtggggggcagctccaacagtcggggctaggtttttgttgtacactggtaccagcagacttcccggaacacgacccccaaactcctcatctatgactaacaccaatccggccctcgacggggtccctgaccgtattcctctcggtcctaccgaagtcgtggccacctcacgcccctccgtggccatccgacgtcgggccgttccgggctaggacggagtggacggtctagttaatttacgttacgttgtacctacgtttcctttgactacgactacgccgttggtatcgtctttagtcgttacgtttacgggaacgtacggggtaaccacggtccctaccggttcgtacggtccaacccgaccccgaaccggtaccccaacccctacgttccgtacctacccttacccgttcccgttccccccgtccccttcccgtacctaccgttaccgtaccggttaccgttacggtcggacgggtccgggtacgtcgggaaccgaacgggtccgaactaggtacgcgtncnnncnnnnncnnnnnnnnnnnnn

SEQ ID NO: 162847 - DNA, 511 bp, Homo sapiens
  misc_feature: GYAE6OF01EM7GF.34.86.H09.1.454.CMB.1.raw
  modified_base (492)..(511): a, c, t, g, unknown or other
  misc_feature (492)..(511): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggcctccaagtctggcacctcacgccctccctggccatcactgggctccgggctggaggatggaggctgatttatactgtcagttcctttgacagcagcctggagtgtcttatgtcttcggaacgtcgggaacctaagggtccaccggtcgtaggtccacgcccgaacggccccaaccccactgtccacttcctcgttccccacccttcctctactccacgtgtactggacgcgggcgtcggacgacgggcgacagtacgnnnnnnnnnnnnnnnnnnnn

SEQ ID NO: 162848 - DNA, 475 bp, Homo sapiens
  misc_feature: GYAE6OF01AIRL9.34.86.H09.1.454.CMB.1.raw
  modified_base (388)..(388): a, c, t, g, unknown or other
  misc_feature (388)..(388): n is a, c, g, or t
  modified_base (458)..(475): a, c, t, g, unknown or other
  misc_feature (458)..(475): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccgggctgaggatgaggctgattattactgtcagtcctttgacagcagcctgagtgcttatgtcttcggaactgggaccaaggtcaccgtctaggtcacgcccagccaacccntgtcactctcgtccccaccctcctcactccacgtcgtactgacgcgggtctgggcaagggcgacagtagnnnnnnnnnnnnnnnnnn

SEQ ID NO: 162849 - DNA, 257 bp, Homo sapiens
  misc_feature: GYAE6OF01D5OLW.34.86.H09.1.454.CMB.1.raw
  modified_base (245)..(257): a, c, t, g, unknown or other
  misc_feature (245)..(257): n is a, c, g, or t
tcagtacacgtgatcacgaccggtgctcgatttagtgctatagacttgggtttgggggtgtggtggtctccactcccgccttgacgaggctgattattactgctgctcatgtgcaagtctcaccacgtgtgactttcggcggaggaccaagttgaccgtctcagtcagcccaaggctcgccccctggtcactctcgttcccgccctctcatcacgtgtactgacgcggctggcaaggcgcatagnnnnnnnnnnnnn

SEQ ID NO: 162850 - DNA, 487 bp, Homo sapiens
  misc_feature: GYAE6OF01CL7BE.34.86.H09.1.454.CMB.1.raw
  modified_base (286)..(286): a, c, t, g, unknown or other
  misc_feature (286)..(286): n is a, c, g, or t
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
  modified_base (479)..(487): a, c, t, g, unknown or other
  misc_feature (479)..(487): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcgggggcaggttatgatgtacactggtacaagcagcttccaggaacagccccccaaatcctcatctatgctaacaccaatccggccctcaggggtccctgaccgattctctggctccaagtctggccacctcagccctccctggccatcacgtgggctccgggntgaggatggaggctgtatttatactgtctagttcctttgacagcagcctgagtgtacttatgtcttacggaacgtcgggaacctaagggtcctaccggtctaggtcaacgcccaacggccccaaccccgatcgtccacttctccgttccccaccctcctcactcacgtgtactgagcggctggcagcncangnnnnnnnnn

SEQ ID NO: 162851 - DNA, 658 bp, Homo sapiens
  misc_feature: GYAE6OF01BW1G1.34.86.H09.1.454.CMB.1.raw
  modified_base (345)..(345): a, c, t, g, unknown or other
  misc_feature (345)..(345): n is a, c, g, or t
tcagtacacgtgatcacgaccggtgctcgatttagtgctatagacttgggtttggggaggctctgcttcatctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggacgggtcaccatcctccgtgctacgtgggacgcagctaccgaacgagtcggggctaggttatgatgtacacgtaggtacacgcagtcttacgaaggacaccgacccctaaactcctactactactancgacctaaaccaccgaacgtcccggacccttcggaccggggtccctacggtaccgtacttccgtcgtcgccttaaccgtaacgttccgtacggacctaccctcctaccgtaccccttcccgtcggaccctacgtccgtaccggtccgggtacccgtccgggtaccgtggtaacgggtacgtcggtacggtcgttaagttacgtttacgttacgttgtaccgtagtttaccgttcgaaccgtgaccgtagcccggttagtacggttacgttacgttacgttcggtttaccggttacggaaccggttacccgggg

SEQ ID NO: 162852 - DNA, 583 bp, Homo sapiens
  misc_feature: GYAE6OF01CT242.34.86.H09.1.454.CMB.1.raw
  modified_base (227)..(227): a, c, t, g, unknown or other
  misc_feature (227)..(227): n is a, c, g, or t
  modified_base (312)..(312): a, c, t, g, unknown or other
  misc_feature (312)..(312): n is a, c, g, or t
  modified_base (560)..(560): a, c, t, g, unknown or other
  misc_feature (560)..(560): n is a, c, g, or t
  modified_base (565)..(583): a, c, t, g, unknown or other
  misc_feature (565)..(583): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcgggggcaggttatgatgtacactggtacaagcagcttccaggaacagccccccaaactcctcatctatgctaacaccaatcggccctcaggggtccctgaccgnttctctggctccaagtctggcacctcagccctccctggccatcacgtcgggctccgggctggaggatggaggctgatttattacngtcagttcctttgactagcagtcctggagtgactttagtgttcgttacgggaacgttcgggaaccctaagggtccaaccggttccgtagggtccaacggccccgaaacgggaccccaacccccgtacgttcgtacccgtacttcccgttaccggtttccccccgccccttccctaccacttccgaccggttcgtaccgtggacgggtccggggtcgtcggggacctaacggggccgtacaaagttcgntacgnnnnnnnnnnnnnnnnnnn

SEQ ID NO: 162853 - DNA, 606 bp, Homo sapiens
  misc_feature: GYAE6OF01C1L9I.34.86.H09.1.454.CMB.1.raw
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcagccgcctcagtgtctcgggcccagggcagaggtcaccatctctgcacgtgggancagcctaccaacngtcggggcaggttatagatagtacacgtggtacaagcagtcttaccgaacggaacacgaccccctaaatccacactctatcgactaacaccaagtccgcctcgacgggtccacgacctattctctcggcctacaacgtctcggaccacctcgacgtccctaccgtcggtccactaccgacgtccgggccgtcccgggcgtacggaggtacggtcgacggtcgttaggtactttaacgttacgttcgttaccgtacgtttccgtttagaccgtagtaccgacggtccgttaggtcggttcgttacgtttacgttacggtttacggttaccggtaaacggttggggtaaaccctaaccgggg

SEQ ID NO: 162854 - DNA, 484 bp, Homo sapiens
  misc_feature: GYAE6OF01BBS9J.34.86.H09.1.454.CMB.1.raw
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (395)..(395): a, c, t, g, unknown or other
  misc_feature (395)..(395): n is a, c, g, or t
  modified_base (468)..(484): a, c, t, g, unknown or other
  misc_feature (468)..(484): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcgggggcaggttatgatgtacactggtacaagcagcttccaggaacagcccccaaatcctcatctatgctaacaccaatcggccctcaggggtccctgaccgattctctggctccaagtctggcacctcagccctccctggccatcactgggctccgggntgaggntgaggctgattatactgtcagttccttgacagcagcctgagtgcttatgtcttcggaactgggacctaaggtccaccgttcaggtcacgacccgaacgcccaacccntcgtcctacttcctccgtcccctaccctcctacactcacgtgtactggacgcgggctggcacggcacagtagnnnnnnnnnnnnnnnnn

SEQ ID NO: 162855 - DNA, 442 bp, Homo sapiens
  misc_feature: GYAE6OF01C9U46.34.86.H09.1.454.CMB.1.raw
  modified_base (357)..(357): a, c, t, g, unknown or other
  misc_feature (357)..(357): n is a, c, g, or t
  modified_base (433)..(442): a, c, t, g, unknown or other
  misc_feature (433)..(442): n is a, c, g, or t
tcagtacacgtgatcacgaccggtgctcgatttagtgctatagacttgggtttgggagcagctccaacatcggggcaggttatgatgtacactggtacaagcagcttccaggaacagccccccaaactcctcatctatgctaacaccaatcggccctcaggggtcccctgaccgattctctggctccaagtctggcacctcagcctccctggccatcactgggctccgggctgaggatgaggctgattattactgtcagttcctttgacagcagcctgagtgctttagtcgtccttacggaacgtgggaaccctaaggtccaccgtccgtaggtccaacgcccaaggccccaacccnctcgtccacttctccgttccccgccctcctcactccacgtgtacctggacggcgggctggacaagggcacagtagnnnnnnnnnn

SEQ ID NO: 162856 - DNA, 565 bp, Homo sapiens
  misc_feature: GYAE6OF01BZEUS.34.86.H09.1.454.CMB.1.raw
  modified_base (219)..(219): a, c, t, g, unknown or other
  misc_feature (219)..(219): n is a, c, g, or t
  modified_base (312)..(312): a, c, t, g, unknown or other
  misc_feature (312)..(312): n is a, c, g, or t
  modified_base (481)..(481): a, c, t, g, unknown or other
  misc_feature (481)..(481): n is a, c, g, or t
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacagggtcctgggcccagtctgtcctgacgcacgcccgccctcactgtccgtcgggggccccccganagagacgtccaccatcctcctgcacgtggggcaccctccaacagtcggggctaggttttgtgtacacgtggtaccagcagacttcccggaacncgacccccaaactcctcattcttaggtaacaacaatcgcctcgacgggtccctgaccgtatttctcgcctactaacgtctggccacctcacgtccctcctggactattacgttgacctccgacgtcctggaggacgtgtaggctaggtatttaattctgtcacgtcacntacgaacacgacccgtgggccggttcgtcgggcggacggaccaggcctacggaccgtcctcgacgtccaacgtccggagtcccg

SEQ ID NO: 162857 - DNA, 682 bp, Homo sapiens
  misc_feature: GYAE6OF01DNJ0K.34.86.H09.1.454.CMB.1.raw
  modified_base (177)..(177): a, c, t, g, unknown or other
  misc_feature (177)..(177): n is a, c, g, or t
  modified_base (229)..(229): a, c, t, g, unknown or other
  misc_feature (229)..(229): n is a, c, g, or t
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctgggcccagtctgtgctgacgcagccgccctnagtgtcgtcggggccccagggcaggaggtcaccatcctcctgcacgtgggancagctaccaacagtcgggcaggttatgatgtacactggtacaagcagcttccgaaggaacacgacccccaaactcctcatctatgactaacaccaactccggcctcgacgggtccctgacccgattctcgtcggctcgaagtctggccacctcacgtccctccgtcgacctatccacggtcgggccgtccggggcttacgggaggtaacgtcgggtaacgggtccgttacggttaagttttaaccgtttaacgttcggttaaccttacggtttacccgtttttacggaaaccgttcggaccgtacgggtaccccgtttagggtacgttcggttaccttttaaggttccggtttaccggtttaccgggtaaacggttacggggtaaacccgtaacgggttaccccgtaacccggtttacccgtacgggttacccgaaccgggtaaaccccccgg

SEQ ID NO: 162858 - DNA, 610 bp, Homo sapiens
  misc_feature: GYAE6OF01AUAG4.34.86.H09.1.454.CMB.1.raw
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacagtcggggcaggttatgatgtacacgtggtacaagcagcttaccgaggaaccacgacccccaaatcctacatcctatcgacctaacaccaatccggccctgacggggtccctggacccgtattctcgtcgcctaccgagtcctggccaccctcacgtccctcccgtcggaccctatccgaccgtcggggcctccgggctggacggtagtcggacggtcgttagtacttttacttacgtcgttacgtacgtttcccgtttaggaaacctggtaccctaacgggttcccttaggggtaactttcggtaccgttttaagttccgggttcccgtttaacccggggtaaccgttacccgggggg

SEQ ID NO: 162859 - DNA, 643 bp, Homo sapiens
  misc_feature: GYAE6OF01D0BHU.34.86.H09.1.454.CMB.1.raw
  modified_base (401)..(401): a, c, t, g, unknown or other
  misc_feature (401)..(401): n is a, c, g, or t
  modified_base (625)..(625): a, c, t, g, unknown or other
  misc_feature (625)..(625): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcacgcccgccctcactcgtccgtcggggcccccggacagagacgtcaccatctcctgcacgtcgggggccacctccaacgacgtcggggctaggttttgtcgtacacgtaggtaccagtacacgtacgttacccggaaccaccgaccccctaaactcctactactttacgttacggtaaacaacaacgtccggaccctacggtacgggtccctacgtaccgttntttcctcgtcctaccgagtcgtcggtcctacctcgacgtccctaccgtaggtactattacgtcggtacctcgacgtccgtggacgtgtagtacgtctagtaactttacttacgtgtacgtatacgtactagttacgaaccctaccggtaccggtgggggtccggttcggttacggacgggacggacgtacgccgtacggtaccctcgacgtacgtacccggacncccgaggtcctaccccgg

SEQ ID NO: 162860 - DNA, 643 bp, Homo sapiens
  misc_feature: GYAE6OF01DB923.34.86.H09.1.454.CMB.1.raw
  modified_base (493)..(493): a, c, t, g, unknown or other
  misc_feature (493)..(493): n is a, c, g, or t
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggccccagggcaggagggtccaccatctcctgcacgtgggagcagctaccaacgacgtcgggggctaggttatggattgtacacgtagggtaacaagcagtccttaccgaacggaaccaccgacccccaaatccctacatctatcgactaacaccaacgtccggaccctacggaccggggtccctagaccgtacttccgtcgtcggcctaccgtaggttcctcggacctacccgtcgaccgtccctcccgtcggaccctacgtccgacgttcgggtccgtcccgggtntacgggaggtacgtacggacggtcgttagttaactttacttacgtgttaccgttacgttccgtttaggaaccgtcggtaccgtacggtcccgtaggtacggttacgttactttacgttcggtttaccggttacggtaacggttaccgggg

SEQ ID NO: 162861 - DNA, 680 bp, Homo sapiens
  misc_feature: GYAE6OF01AYNR2.34.86.H09.1.454.CMB.1.raw
  modified_base (243)..(243): a, c, t, g, unknown or other
  misc_feature (243)..(243): n is a, c, g, or t
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcacgcccgcctcagtgtcgtcggggccccaggggcaggacgggtcaccatctcctgcacgtgggancacgcctaccaacagtcggggcaggttacngatgtaacncgtggtaacaagcacgcttaccgaaggaaccaccgacccccaaactcctacactctatcgactaaccaccaacgtccggaccctacgacggggttccctacgtacccgtatttccgtacgtcgggtaccctaaccgtaacgtccgtacggacctaccctcccgtaacgtcccgtcccgtaccggtacccaccgtccgtaccggtaccggggtcccgttacccggggcgttacgggaacgggtacgtcgggtaacgggtccttaaggtaacgttttaacgtttaacgttcgttaccgttacggtttccgtttacgtaacgtaccggacgtacggtcccgtggtaacgttcgttactttacgtcggttacgttaacgggaccgttcgggaacgtaccggg

SEQ ID NO: 162862 - DNA, 675 bp, Homo sapiens
  misc_feature: GYAE6OF01EELZP.34.86.H09.1.454.CMB.1.raw
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctgggcccagtctgtgctgacgcagccgccctcagtgtctcggggccccagggcagagggtcaccatctcctgcacgtgggacgcagcctccaacagtcggggctaggttatgatgtacacgtggtaacaagcagtcttaccgaggaaccacgacccccaaactcctcatctatgacctaacaccaacgtccggccctacgacggggtcccctagtacccgacttcctcgtcggcctaccgtaagtcctcggaccctaccctcgtaccgtccccttcccgtcggccctacgtcccgtaacggtcggggccgttacccggggctacgggaacggtacgttcgggacggtccttaggtaacttttacggttaacttgtaccgttacgtttccgtttagaacccgtggtaccaggtcccgttaggtacgttcgttacgtttaggttccggtttaccggttacgggtaaccgtaccggggttaaccaaccgggttccaacccggttaccgtacggttacccgccgtaaaccccgg

SEQ ID NO: 162863 - DNA, 561 bp, Homo sapiens
  misc_feature: GYAE6OF01AUSNE.34.86.H09.1.454.CMB.1.raw
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactggggagcagctccaacagtcggggcaggttatgatgtacactggtacaagcagcttccaggacacgcccccaaactcctcatctatcgactaacaccaatccggaccctcgacggggtccctgacccgattctctggctaccaagtcctggcctacctcacgccctcccgtggcccatccacgtcgggcctccgggctggaggtagtcggaggccgtaggtaactttacgttacgttgcccttcgtcctagtacgaaccaaggcgtaccgtagtacttagtttacttcggttacgttacggtaacgtacgggaaccgtaccggttacccg

SEQ ID NO: 162864 - DNA, 784 bp, Homo sapiens
  misc_feature: GYAE6OF01CTUWH.34.86.H09.1.454.CMB.1.raw
  modified_base (331)..(331): a, c, t, g, unknown or other
  misc_feature (331)..(331): n is a, c, g, or t
  modified_base (371)..(371): a, c, t, g, unknown or other
  misc_feature (371)..(371): n is a, c, g, or t
tcagtacacgtgatcacgaccggtgctcgatttagtgctatagacttgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctccgtggacagtcgatcaccatcctcctgctacgtcggtaaaccggctaaggtcggtacgtttagaagttaggtaatttaagtaaggttccttcggttcctccgttacggtaaaccccaaacgaaacccgaccccgggaanaaaacgtcccctaaccccaaaacgtccaattgtaatttanaggtaactagtaactaaagttaaccgtccggtacccttagtagggtttctttccgtactacggttccttctttccttcgtcgttccctttacgtacgttcggttaccgtacggaccaaacccgtccggtcccctacccgtagaccctacttcctaccgtacgtacctacgtaggtacgtagggaacggtaacgggttacggggtattaacgtttaacgttaccgtcgtcccgtacctaacttaactaacttaacctaactttccgaaccgttaccgtaccctacgttccgtagtacgtttcgggtttagttaccgggtttaccggggaacgggtaaccggtaacccctaaaccggttcccgttacccgtttcccgttaccgtaaccgacccggtacccggtaacgtcccccgg

SEQ ID NO: 162865 - DNA, 685 bp, Homo sapiens
  misc_feature: GYAE6OF01B6WXA.34.86.H09.1.454.CMB.1.raw
  modified_base (188)..(188): a, c, t, g, unknown or other
  misc_feature (188)..(188): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcagccgccctnagtgtcgtcggggccccagggcaggagggtcaccatcctcctgccacgtgggagcagcctaccaacgagtccggggctaaggttatgatggtaaccacgtaggtaacaagcacgtccttaccgaaggaaccaccgaccccctaaactcctacatctatcgactaaccaccaacgtcccggaccctacggacgggtccctaggacccgtactttccgtcgtcggtcctaccgtaacgttccgtcggcctacccgtcacccgtcccttcccgtcggaccctactccgtaccgtccgggtccgtcccgggcgtacggaagggtactcgggacggtcctaggttaactttacgttaacgtcgttacgtacgtttccgtttacggaccctaagtaccgtaccggttaccgttacgggtacgttcggtttaccgtttacgttccgggttacccgtttaaccggggtaaacccggtacggggtaaaccccggttaaacccgggg

SEQ ID NO: 162866 - DNA, 512 bp, Homo sapiens
  misc_feature: GYAE6OF01CKFZC.34.86.H09.1.454.CMB.1.raw
  modified_base (417)..(417): a, c, t, g, unknown or other
  misc_feature (417)..(417): n is a, c, g, or t
  modified_base (455)..(455): a, c, t, g, unknown or other
  misc_feature (455)..(455): n is a, c, g, or t
  modified_base (493)..(512): a, c, t, g, unknown or other
  misc_feature (493)..(512): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacacgcccccaaactcctcatctatgctaacaccaatccggccctcgaggggtcccctgaccgattctctggcctcaagtctgccacctcagcctccctggccatcacgtcgggctccgggctggaggatggaggctgtattattactgtctagttcctttgacagcacgcctgagtgctttatgtcgttacggaactcgggaacctaaggtccaccgttcgtagtcacgacccaacggcccaacccctacngtccactcctccgttccccaccctcctacactcacgtntactgacgcgggctacggactaacgggcacactaggcnnnnnnnnnnnnnnnnnnnn

SEQ ID NO: 162867 - DNA, 795 bp, Homo sapiens
  misc_feature: GYAE6OF01A15JX.34.86.H09.1.454.CMB.1.raw
tcagtacacgtgatcacgaccggtgctcgatttagtgctatagacttgggtttgggggctgttcctggaagctgcttgtaccagtgtacatcataacctgccccgatgttggagctgctcccagtgcaggagatggtgaccctctgccctggggccccagacactggagggcggctgcgtcagcacgagacgtcgggcccgacggaccctggtcgcgaggtggagacggagggagaggtggaagggaggaggaggacgaccgagggccagtcggacgtggaagtagttcggtccgtggacgtggccgttggtcccttcgttggtccgccctaagcggctaggaacgccgtaagaccgtaccctaaccccaaaccttcccttacgtacttaccgttaacgtccggtaaaccctaaaaccccgtaacccgtaaccggtccccgggaccccgttacgggtacccgggggttcccctaccggtaaccgttaccttccgtcggtaccggtccttaaccggtaacgtccgttaccggaccctaacccctccgtacccgtccccgtaccgtccgacctacgtccgtacgggtccgggtccgtccgggacgtacgggtacggtacgtacgggacgttaccgttagttaacttttacgttacgttccggttaccggttaccgtttacccggtaaggtaccgtacggtaccgtacggtccgttaacggtacggtttacggttaccttttaccgggttacggtttaacccgggtttaacccggggtaaacgggttaacccccgggg

SEQ ID NO: 162868 - DNA, 602 bp, Homo sapiens
  misc_feature: GYAE6OF01DPO5W.34.86.H09.1.454.CMB.1.raw
  modified_base (276)..(276): a, c, t, g, unknown or other
  misc_feature (276)..(276): n is a, c, g, or t
  modified_base (287)..(287): a, c, t, g, unknown or other
  misc_feature (287)..(287): n is a, c, g, or t
  modified_base (313)..(313): a, c, t, g, unknown or other
  misc_feature (313)..(313): n is a, c, g, or t
  modified_base (482)..(482): a, c, t, g, unknown or other
  misc_feature (482)..(482): n is a, c, g, or t
tcagtacacgtgatcacgaccggtgctcgatttagtgctatagacttgggtttgggggctgttcctggaagctgcttgtaccagtgtacatcataacctgccccgatgttggagctgctcccagtgcaggagatggtgaccctctgccctggggccccagacactgagggcgctgcgtcagcacagactgggcccaggaccctgtgcagtgagcgaggagagtgaggaggagaggagaccaggccatgctaggatattcgtctgagtgctgccttnttgtcgcccanagctagagcagacgcctacaactccncatctatgactaaacacctaacgtccggaccctcggtaccggggtccctaggacccgtattcctacgtcggccttaccgaggttcctcggcctaccctcgacgtcccctcccgtcggccactccgacgtcgggccgtccggggtctgggaacggtagtacgggacggtntaggttaactttacgtttaccgtgttaccctacggtttcccttagaaccgtacgccgaggtcccgtaggtagttcgttactttacggtcgtttaccgttcgggtaaaccggttaccgggg

SEQ ID NO: 162869 - DNA, 510 bp, Homo sapiens
  misc_feature: GYAE6OF01EE2KW.34.86.H09.1.454.CMB.1.raw
  modified_base (292)..(292): a, c, t, g, unknown or other
  misc_feature (292)..(292): n is a, c, g, or t
  modified_base (322)..(322): a, c, t, g, unknown or other
  misc_feature (322)..(322): n is a, c, g, or t
  modified_base (493)..(510): a, c, t, g, unknown or other
  misc_feature (493)..(510): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacacgcccccaaactcctcatctatgctaacaccaatcggccctcgaggggtccctgacccgattctctggctccaagtctggcacctcacgccctccctgccatcacgtgggctccgggctgaggntgagctgattatactgtcagttccttgacngcagcctgagtgtcttatgtcttcggaactgggacctaaggtccaccgttcgtaggtcaacgccccaaggaccccaaccccatcgtaccacttcctccgttccccgccctctccactccgactcgtactggacggtccgggctcgggaccgtaacgggccgtagaatcggnnnnnnnnnnnnnnnnnn

SEQ ID NO: 162870 - DNA, 424 bp, Homo sapiens
  misc_feature: GYAE6OF01ANFO6.34.86.H09.1.454.CMB.1.raw
  modified_base (230)..(230): a, c, t, g, unknown or other
  misc_feature (230)..(230): n is a, c, g, or t
  modified_base (285)..(285): a, c, t, g, unknown or other
  misc_feature (285)..(285): n is a, c, g, or t
  modified_base (336)..(336): a, c, t, g, unknown or other
  misc_feature (336)..(336): n is a, c, g, or t
  modified_base (354)..(354): a, c, t, g, unknown or other
  misc_feature (354)..(354): n is a, c, g, or t
  modified_base (395)..(395): a, c, t, g, unknown or other
  misc_feature (395)..(395): n is a, c, g, or t
  modified_base (402)..(424): a, c, t, g, unknown or other
  misc_feature (402)..(424): n is a, c, g, or t
tcagtacacgtgatcacgaccggtgctcgatttagtgctatagacttggttttgggagcagctccaacatcggggcaggttatgatgtacactggtacaagcagcttccaggaacagcccccaaactcctcatctatgctaacaccaaatcggccctcaggggtccctgaccgattctctggctccaagtctggcacctcagcctccctggccatcactgggctccgggntgaggatgaggctgattattactgtcagtcctttgacagcagcctgagtgcttangtctcgaactggaccaaggtcaccgtcctagtcagcccaaggccaaccccntcgtcactctcgttcccnccctcctcactcacgtcgtactgacgcgggctggcaaggcncgatagnnnnnnnnnnnnnnnnnnnnnnn

SEQ ID NO: 162871 - DNA, 461 bp, Homo sapiens
  misc_feature: GYAE6OF01AYIAS.34.86.H09.1.454.CMB.1.raw
  modified_base (337)..(337): a, c, t, g, unknown or other
  misc_feature (337)..(337): n is a, c, g, or t
  modified_base (387)..(387): a, c, t, g, unknown or other
  misc_feature (387)..(387): n is a, c, g, or t
  modified_base (444)..(444): a, c, t, g, unknown or other
  misc_feature (444)..(444): n is a, c, g, or t
  modified_base (450)..(461): a, c, t, g, unknown or other
  misc_feature (450)..(461): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtcccctgaccgattctctggctccaagtctggcacctcagcctccctggccatcactgggctccgggctgaggatgaggctgattattactgtcagtcctttgacagcagcctgagtgcttangtcttcggaactgggaccaaggtcacgtctaggtcagcccagccaacccnctgtcactctcgttcccaccctcctcactcacgtgtactgagcgggctggcaaggcncatagnnnnnnnnnnnn

SEQ ID NO: 162872 - DNA, 681 bp, Homo sapiens
  misc_feature: GYAE6OF01ECKVN.34.86.H09.1.454.CMB.1.raw
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcacgcccgccctcagtcgtcgtcggggccccaggggcaggacgggtccaccatcctcctgcacgtgggatcagcctaccgaacaggtcggggctaggttatcgatcgtaacactggtaacaagacacgtctaccgaaggaaccacgaccccctaaattccctactacttactaactacgtaacctaaaccaacctaacgtcccgggtaccctaccggtaaccggggttccctacggtaacccgtactttaccgtcgtacggtacctaccgtaacgttcctccggacctaccgtccgaaccgtccccttcccgtcggaccctagtaccgtaccggtccgggacccggttccggcgtacggacggtagtcggacggtcgttagtactttacgttacgtcgttacgtacgtttaccgttgaacgtacgcgtaccgtccgttagtacgggtcgttacgttacgttcgttaccgtaacgggttaccgtacgggtaaccgtaacccgggg

SEQ ID NO: 162873 - DNA, 417 bp, Homo sapiens
  misc_feature: GYAE6OF01BHJ5A.34.86.H09.1.454.CMB.1.raw
  modified_base (157)..(157): a, c, t, g, unknown or other
  misc_feature (157)..(157): n is a, c, g, or t
  modified_base (232)..(232): a, c, t, g, unknown or other
  misc_feature (232)..(232): n is a, c, g, or t
  modified_base (394)..(417): a, c, t, g, unknown or other
  misc_feature (394)..(417): n is a, c, g, or t
tcagtacacgtgatcacgaccggtgctcgatttagtgctatagacttgggtttgggagcagctccaacatcggggcaggttatgatgtacactggtacaagcagcttccaggaacagcccccaaactcctcatctatgctaacaccaatcggccctnaggggtccctgaccgattctctggctccaagtctggcacctcagcctccctgccatcactggctcgggctgaggntgagctgattatactgtcagtcctttgacagcagcctgagtgcttatgtcttcggactggaccaaggtcacgtctagtcagcccaaggccaacccactgcactctcgttcccaccctcctcactcacgtgtactgagcggggctggacaagggctacatagnnnnnnnnnnnnnnnnnnnnnnnn

SEQ ID NO: 162874 - DNA, 772 bp, Homo sapiens
  misc_feature: GYAE6OF01AKCA6.34.86.H09.1.454.CMB.1.raw
  modified_base (225)..(225): a, c, t, g, unknown or other
  misc_feature (225)..(225): n is a, c, g, or t
  modified_base (753)..(753): a, c, t, g, unknown or other
  misc_feature (753)..(753): n is a, c, g, or t
  modified_base (755)..(764): a, c, t, g, unknown or other
  misc_feature (755)..(764): n is a, c, g, or t
  modified_base (767)..(772): a, c, t, g, unknown or other
  misc_feature (767)..(772): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacacgcccccaaactcctcatctatgactaacaccaagtccggccctcgacggggtcccngaccgattctctggcctccgaagtctggccaccctcaccgtccctcccgtcggaccctataccgaccgttcggggcccgttcccgggggcttacgggaagggtacttgggaacgggtccttagtaattttactttaaccgttcgttacgtacggtttaccttttaggacctaaggccctaagggcccgtaggttcggttcgttaccgtttaagttcggttaccgtttaaccgggaaacggtttacggggaacccgttaaacgggttacccgtaacccgggtttacccggttaagggttacccgaacccggaaccccccggtaaaaccggtacccccccgtaaaacccccgtacgtttaccgtacccccgttaaccccgtttcccgtttaccccccgggtttcccccctccccccgttacccgtacctaaccgttacccgttaacggtttaccggttaacggtacgggacccgggtcggtacccggttaacggggaccgtaacgggtacccgacgtagttacgctaggncnnnnnnnnnntcnnnnnn

SEQ ID NO: 162875 - DNA, 600 bp, Homo sapiens
  misc_feature: GYAE6OF01CCN77.34.86.H09.1.454.CMB.1.raw
  modified_base (244)..(244): a, c, t, g, unknown or other
  misc_feature (244)..(244): n is a, c, g, or t
  modified_base (312)..(312): a, c, t, g, unknown or other
  misc_feature (312)..(312): n is a, c, g, or t
tcagtacacgtgatcacgaccggtgctcgatttagtgctatagacttgggtttgggggtgggcacgaagaggcagcactcaggacaatctccagcatggcctggtctcctctcctcctcactctcctcgctcactgcacagggtcctgggcccagtcgtgtgctgacgcagccgccctcagtgtcgtgggccccagggcaggagggtcacctatcctcctgcacgtgggagcagtcaccaacgngtcggggcaggttatggatgtactacgtggtacaagcagtcttccaaggacaccgaccccaaactccncacttcatcactaacaccaagtccgcctacgacgggtcctaggaacctcttctcgtcggtctacgaacgtcgtcggacctaccgtacgcgtcccgtccgtcggcctactcgacgttcggccgtccgggtatcggaggtattcggaagtcgtagtaactttacgttacgtcgtaccgtacgttccgttgaacgtcgactcgccgtagtgtcgttacttcgtcgttacgttacggacgttacgggaccctaaggtcccctaacggttactacggtccgtggaaacccccg

SEQ ID NO: 162876 - DNA, 663 bp, Homo sapiens
  misc_feature: GYAE6OF01DT74H.34.86.H09.1.454.CMB.1.raw
  modified_base (646)..(647): a, c, t, g, unknown or other
  misc_feature (646)..(647): n is a, c, g, or t
  modified_base (649)..(660): a, c, t, g, unknown or other
  misc_feature (649)..(660): n is a, c, g, or t
  modified_base (662)..(663): a, c, t, g, unknown or other
  misc_feature (662)..(663): n is a, c, g, or t
tcagtacacgtgatcacgaccggtgctcgatttagtgctatagacttgggtttgggggctgttcctggaagctgcttgtaccagagggtcaccatctcctgcactgggagcagctccaacagtcgggggcaggttatgatgtacactggacaagcagcttacaggaacacgacccccaaactcctcatctatgactaaacaccaatccggccctcgacggggtccctacgaccgtattcgtcgtggcctcctaagtccgtggccacctcgacgtccccgtacccgtcggcctataccgaccggttcggggcccgtccgggggactgggaaggtacgttggaacgggtcttaggttaattttacgttaccgttgtaccgtagtttccccgtttagacacgtccgtacgccgtaggtacgtcgttacctttagtcgttaccggttacggaacgtacggggaacctaacggtcccacggttacccgtaggttcccacggtacccgaaccggacccctaaaccctcgtaccgttacctacctttccgtaccccttccccgaccccttcctaccgtactaccgtacgttcggtaccgttgggaccggtcgggtccgtacggacggtacgggcctaaccggatcagcagcanngnnnnnnnnnnnngnn

SEQ ID NO: 162877 - DNA, 653 bp, Homo sapiens
  misc_feature: GYAE6OF01CHSQF.34.86.H09.1.454.CMB.1.raw
  modified_base (479)..(479): a, c, t, g, unknown or other
  misc_feature (479)..(479): n is a, c, g, or t
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacagggtcctgggcccagtctgtgctgacgcagcccgtccctcagtgtcgtcggggccccagggcaggagggtcaccatcctctcgcacgtgggacgcagcctccaacgtagtcggggctaggttatggatcgtacacgtaggtacaacgcagtccttaccgaaggtaaccaccgacccccaaactcctacatactatcgacctaaacaacctaatccggtccctaggaccggggtccctacgaccgttacttccgtcgtcggtcctaccgtaacggttccgtacggtaccctacccgtacgtaccgtcccctccccgtggaccctntcccgtacggtcgggtcccgtaccgggcgtacggacggtagtacgggacgtcgttagttactttacttacgtcgttaccttagttcccgttagtaacgcgtaacgtacgtcccgttaggagtttacgttacgtttacgttacggttccgttaaccgggtacggttaaacccggg

SEQ ID NO: 162878 - DNA, 618 bp, Homo sapiens
  misc_feature: GYAE6OF01BPEDI.34.86.H09.1.454.CMB.1.raw
  modified_base (238)..(238): a, c, t, g, unknown or other
  misc_feature (238)..(238): n is a, c, g, or t
  modified_base (599)..(618): a, c, t, g, unknown or other
  misc_feature (599)..(618): n is a, c, g, or t
tcagtacacgtgatcacgaccggtgctcgatttagtgctatagacttgggtttgggggctgttcctggaagctgcttgtaccagagggtcaccatctcctgcactggggagcagctccaacagtcgggggcaggttatgatgtacactggtacaagcagcttccaggaacacgcccccaaactcctcatctatgactaacaccaatccggccctcgacgggtcccctgaccgatttcnctggctaccaagtctggccacctcacgtcccctcccgtggaccctatccacggttcggggcccgtccggggattggaggtagtggacggtcttagtaattttacttacgtggttcctaggtttcctttagactattcaagtcctgtagtgtacgtttgtggttaccgttacggacgtacggggaacctaacgggtccctacccggttacttaacggcaccgacccgaacgaccccaaccctacgtcgtctaccgttccgtccgtttcccccgacccttcccttacgtacttaccgtaccggttcgttaccggtaggccgggtccgggtcgtacgggaccgaacgggccgactacgttacgnnnnnnnnnnnnnnnnnnnn

SEQ ID NO: 162879 - DNA, 782 bp, Homo sapiens
  misc_feature: GYAE6OF01A83J6.34.86.H09.1.454.CMB.1.raw
  modified_base (232)..(232): a, c, t, g, unknown or other
  misc_feature (232)..(232): n is a, c, g, or t
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggacgggtcaccatcctcctgcacgtgggacncagctaccaacgacgtcgggggactacgggttatggtaattcgtaacctacgttagggtaacaacgcgacggtaccttaccgaacgggaaccaccgacccccaaactccctacactctatcgacctaaaccaccgtaacgtccggaccctcggtaccgggtacccctacgaacccggtacttccgtcgtcgggtaccctaccgtaacgttccgtacggccctaccctcgtaccgtccccgttccgtccggaccctaacgtcccgaacggttccggggcccggttcccgggtacgtacgggtaacgggtactacgggacggtcgtttacgttaacgtttaacgtttaccgttgttaccgttaacggttttcctttaacggacctacggtaccgacggttccgtaggttaccggttggttacccgttttaggtccgggtttaaccggtttaccgggaaaccgggttaccggggtaacccgttaaaccggggttacccgtaaccccggggtttacccgttaacgggtccccggtaaacccggtaaccccccgg

SEQ ID NO: 162880 - DNA, 696 bp, Homo sapiens
  misc_feature: GYAE6OF01CFK4V.34.86.H09.1.454.CMB.1.raw
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcacgccgccctcagtcgtccgtcggggccccaggggcaggacgggtccaccatcctcctgcacgtggggagcagcctaccaacacgtcggggctaggttactgatgtacacgtggtaacaagcacgcttaccgaaggaaccaccgacccccaaactccctacactctaatcgacctaaaccaacctaacgtcccggaccctcggacggggtcccctaggacccgtacttccgtcgtcggtccctaccgtaacgttccgtacggcctacctcgaccgtccctcccgtcggaccctacgtccgtaccggtccgggtcccgtcccggggtcgtacgggacgggtacgtcgggaacggtccgttaggtaacttttacgtttacgttacgttaccgtaaccggttttcccgttagaccgtacggtaccgtacggttacccgttagggtacgttcggttacctttacggttcgtttaaccggttaccgggtaaaccggttccggggtaacccgttaaacccgggg

SEQ ID NO: 162881 - DNA, 457 bp, Homo sapiens
  misc_feature: GYAE6OF01ENZ3N.34.86.H09.1.454.CMB.1.raw
  modified_base (383)..(383): a, c, t, g, unknown or other
  misc_feature (383)..(383): n is a, c, g, or t
  modified_base (438)..(438): a, c, t, g, unknown or other
  misc_feature (438)..(438): n is a, c, g, or t
  modified_base (444)..(457): a, c, t, g, unknown or other
  misc_feature (444)..(457): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactggctcggctgaggatgagctgattatactgtcagtcctttgactagcagcctgagtgcttatgtcttcggaactggacaaggtcacgtctaggtcagcccaaggccaaccccnctgtcactctcgttcccaccctcctcatcacgtgtactgagcggctggcaaggcncatagnnnnnnnnnnnnnn

SEQ ID NO: 162882 - DNA, 609 bp, Homo sapiens
  misc_feature: GYAE6OF01C3XYX.34.86.H09.1.454.CMB.1.raw
  modified_base (234)..(234): a, c, t, g, unknown or other
  misc_feature (234)..(234): n is a, c, g, or t
  modified_base (579)..(579): a, c, t, g, unknown or other
  misc_feature (579)..(579): n is a, c, g, or t
  modified_base (589)..(609): a, c, t, g, unknown or other
  misc_feature (589)..(609): n is a, c, g, or t
tcagtacacgtgatcacgaccggtgctcgatttagtgctatagacttgggtttgggggctgttcctggaagctgcttgtaccagacggtcaccatctcctgcactggggagcagctccaacagtcgggggcaggttatgatgtacactggtacaagcagcttccaggaacacgcccccaaactcctcatctatgacctaacaccaatccggccctcgacggggtccctgaccgnttctctggcctccagtctggccacctcacgccctcccgtggccatccgacgtcgggccgtccgggctaggaggatggacggtctgtatttagttaccgtgtccgtagttcctttaggactaacggctaggtcctggtagtcgtactttagttcgttcgttacgggaacgtcgggaacctaacggtcctaccgttccgtaggtccaccggtacccaacggtacccccaaccccgtacgtcgtacctacccgtttccgtacccgttccccgccccctttccacgtacttcccgtacgttacggttacgtcgggaccgggtccgggacgttcgggacgaacgggtccncgtaagtcgnnnnnnnnnnnnnnnnnnnnn

SEQ ID NO: 162883 - DNA, 602 bp, Homo sapiens
  misc_feature: GYAE6OF01CCC7W.34.86.H09.1.454.CMB.1.raw
  modified_base (582)..(582): a, c, t, g, unknown or other
  misc_feature (582)..(582): n is a, c, g, or t
  modified_base (585)..(602): a, c, t, g, unknown or other
  misc_feature (585)..(602): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacacgccccccaaactcctcatctatgactaacaccatccggccctcgacggggtcccctgaccgtactttctctggcctccgtaagtctggccaccctcgacgccctcccgtggccatcaccgtcggggcctcccgggctggaggatggaggctagtatttagttactggtgcagcagtgggatcgacgagccttggaggttggggttgggtcggttcggggcgggaacgggaccaagggtccgtacgggtacccgtcgtacgggtccacggtcccgaagggtccctcccggtccccccgttaccgggtcctaccgtttccgttccccgtttccccccaccccgttcctaccgtactccgtacggttcgtaacgtgggaccggtccgggtctcgggacgtaacggccgatacggangcnnnnnnnnnnnnnnnnnn

SEQ ID NO: 162884 - DNA, 680 bp, Homo sapiens
  misc_feature: GYAE6OF01C5HCY.34.86.H09.1.454.CMB.1.raw
  modified_base (658)..(658): a, c, t, g, unknown or other
  misc_feature (658)..(658): n is a, c, g, or t
  modified_base (660)..(661): a, c, t, g, unknown or other
  misc_feature (660)..(661): n is a, c, g, or t
  modified_base (663)..(663): a, c, t, g, unknown or other
  misc_feature (663)..(663): n is a, c, g, or t
  modified_base (665)..(680): a, c, t, g, unknown or other
  misc_feature (665)..(680): n is a, c, g, or t
tcagtacacgtgatcacgaccggtgctcgatttagtgctatagacttggggtttgggggctgttcctggaagctgcttgtaccagagggtcaccatctcctgcactggggagcagcctccaacatcgggggcaggttatgatgtacacgtggtacaagcagcttccaaggaacacgaccccccaaactcctcatctatgctaacaaccaatccggccctcgacggggtcccctgacccgtatttcctcgtcggcctaccaagtcgtggccacctcacgtccctcccgtcggcccaattccgaacgttcggggccttccggggctaggaaggagtgagggccttaggtattttaacttaccgtagttccgtaacgtttcccgtttagaacccgtaaggcctaacggtccctggtaacgttcggtaccttttagttcggttccgttacgggaaaccgtacggggaaacctaacgggtcctaacccggttccgtaaggtccaaccggaccccgaaacggacccccaaacccctacgttcgtaccctacccttccgttacccttacccccaccccttccctgtaacttcccgtaacggtcgtttaacgcgggaacggtccggggtacgtacgggacgtaacggggtcccaagtagtaacggngnnangnnnnnnnnnnnnnnnn

SEQ ID NO: 162885 - DNA, 702 bp, Homo sapiens
  misc_feature: GYAE6OF01EPLUU.34.86.H09.1.454.CMB.1.raw
  modified_base (132)..(132): a, c, t, g, unknown or other
  misc_feature (132)..(132): n is a, c, g, or t
  modified_base (185)..(185): a, c, t, g, unknown or other
  misc_feature (185)..(185): n is a, c, g, or t
  modified_base (277)..(277): a, c, t, g, unknown or other
  misc_feature (277)..(277): n is a, c, g, or t
tcagtacacgtgatcacgaccggtgctcgatttagtgctatagacttgggttggggaggctctgcttcagctgtgggcacaagaggcagcactcaggacaatctccagcatggcctgtctcctctcctctcnctctcctcgctcactgctacgagggtcctcgggccctagtctgtgctgacgcncgtccgcctcagtcgcgtcgggcccagggcagcggtacacatctctgctacgtgggatcacgcctaccaaagcggtcggggactaaggtttntgtaagttcgtaaccgtacggtacggtaacgaaacgtcgtacgtacccgtacggaaacggaccgaacccaacccccgtaaacctctacctacttctaagtcgaacctaaactaccgaacggtcccggtacccgttcggaacgggtttcccacggtaaccgttacctttcgacgttcgtaccgtacctacggtcctcgaccttacccgtacgtaaccgtcccgttaccccgttacggaccttacgtaccgtacgggtcccgggtccgttaccgggtcgttacggaaggtacgtacggtaacgggtctacgtttaacttacgtaccgttcgtaaccgttaccgttccgtttaaagaccgtagtaacggacgttccgtagttccggtagttcttaacgttccgtaaccggttggaaccggttaaccgg

SEQ ID NO: 162886 - DNA, 665 bp, Homo sapiens
  misc_feature: GYAE6OF01DIHQS.34.86.H09.1.454.CMB.1.raw
  modified_base (241)..(241): a, c, t, g, unknown or other
  misc_feature (241)..(241): n is a, c, g, or t
  modified_base (314)..(314): a, c, t, g, unknown or other
  misc_feature (314)..(314): n is a, c, g, or t
  modified_base (340)..(340): a, c, t, g, unknown or other
  misc_feature (340)..(340): n is a, c, g, or t
  modified_base (643)..(646): a, c, t, g, unknown or other
  misc_feature (643)..(646): n is a, c, g, or t
  modified_base (648)..(665): a, c, t, g, unknown or other
  misc_feature (648)..(665): n is a, c, g, or t
tcagtacacgtgatcacgaccggtgctcgatttagtgctatagacttgggtttgggggctgttcctggaagctgcttgtaccagagggtcaccatctcctgcactgggagcagcctcccaacagtcgggggctaggtttttgttgtacactggtaccagcagattcccggaacacgccccccaaactcctcatctatagtaataatctgccggccctcgacggggtccctgaccgattccnctggcctaccaagtcctggccacctcacgtccctccctggaccatcgaggtcgggcctcccgggtccggaggntggaggctggtatttattacgtgtgnagcaggtgggatgacgagccgtaggtagggtttgggttaggggttggttcgggggacggggtaacgggaaccgtaacggccgttaccgggacccggtttaccggtacgggtaccgaccggacccgaaacgggtccccgtaccggtccccccgttccggtaccgtaccgtttcccgttcccgttccccccgtccccttacccttacctacccgttccgtaccggttacggttacccggtcgggtaccgggtcccggggtaccggttccgggacggaaaccgggccggtaacgacggtagcgcgnnnngnnnnnnnnnnnnnnnnnn

SEQ ID NO: 162887 - DNA, 696 bp, Homo sapiens
  misc_feature: GYAE6OF01AMWWW.34.86.H09.1.454.CMB.1.raw
  modified_base (234)..(234): a, c, t, g, unknown or other
  misc_feature (234)..(234): n is a, c, g, or t
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctgggcccagtctgtgctgacgcagcccgcctcagtgtcgtcggggcccccagggcaggaggtccaccatcctcctgccacgtggggacncacgcctaccgaagacgtccgggggctaagggttataggatacgtacacttaggaacaagcagtccttaccgaacgggaaccaccgacccccaaactcctactactctactcgaacctaaccaacccgacgtccggaccctcggacgggtccccaggacctattccgtcgtcggctaccgagtccgtacggcctacctcgacgtcccttcccgcggtaccactccgacggtcgggtaccgtccgggtacgtaggacggtagtacggtacggtaccgttacgttacgtttaaccgttacgttcgttaccgttacggtttcccgttaacggacgaccgtcgtaccgcgttacggtcggttacgttcgtttacgttccggttacggtttaaccgggaccgtacggggttaacccgtacggtaccccgtaccggttaccggtacgtcccgtaacccgtaaccccgg

SEQ ID NO: 162888 - DNA, 479 bp, Homo sapiens
  misc_feature: GYAE6OF01C4ZIZ.34.86.H09.1.454.CMB.1.raw
  modified_base (285)..(285): a, c, t, g, unknown or other
  misc_feature (285)..(285): n is a, c, g, or t
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
  modified_base (454)..(454): a, c, t, g, unknown or other
  misc_feature (454)..(454): n is a, c, g, or t
  modified_base (461)..(479): a, c, t, g, unknown or other
  misc_feature (461)..(479): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactggctccgggctgagntgaggctgattatactgtctagtcctttgacagcagcctgagtgcttatgtcttacggaactgggacaaggtcaccgtctaggtcagcccaaggcccaacccatcgtcaccttctcgttccccgccctcctcactccacgttgtacngacgcgggtcngggacagggcncatacgnnnnnnnnnnnnnnnnnnn

SEQ ID NO: 162889 - DNA, 645 bp, Homo sapiens
  misc_feature: GYAE6OF01BJ7FK.34.86.H09.1.454.CMB.1.raw
  modified_base (191)..(191): a, c, t, g, unknown or other
  misc_feature (191)..(191): n is a, c, g, or t
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacgagggtcctgggcccagtctgtgctgacgcacgcccgccctnagtcgtcgtcggggccccagggcaggaggtcaaccntcctccngcacgtgggancagcctaccaagagtcggggactaggttatgacgtgtacacgttaggaacaagcagccttaccgaaggaaccacccgaccccaaactcctacatcgtatcgaacctaaacacctaacgtccggaccctacggacggtccctacgacccgttacgtcctacgtcgtacccgtacgtaacgtccgtacgtccctacctccgtacgtcccctccgtcggaccctaacgtccgaccggtcgggtcccgtccgggacgttaggaaccgggtagtacgggacgttaccgtagtaactttacgttacgttcgtaccgttacgttccgtttacgactacgccgtaacgtccggtagtacgttcgtcttagttccggttaccgtagggtacgtcggtaaccgtaaccgg

SEQ ID NO: 162890 - DNA, 675 bp, Homo sapiens
  misc_feature: GYAE6OF01DJY7S.34.86.H09.1.454.CMB.1.raw
  modified_base (248)..(248): a, c, t, g, unknown or other
  misc_feature (248)..(248): n is a, c, g, or t
  modified_base (280)..(280): a, c, t, g, unknown or other
  misc_feature (280)..(280): n is a, c, g, or t
  modified_base (469)..(469): a, c, t, g, unknown or other
  misc_feature (469)..(469): n is a, c, g, or t
  modified_base (620)..(620): a, c, t, g, unknown or other
  misc_feature (620)..(620): n is a, c, g, or t
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacagggtcctgggcccagtctgtgctgacgcacgcccgccctcagtgtccgtcggggccccagggcaggacggtcacatctcctgcacgtggggancgacgcctaccaactgcggggctaaggttacnggatgtacacgtacggtacaagcacgtcttaccgacgaaccgaccgaaccccctaacgtcctactatctacgtacaacctaaaccgacctaaccgtccggtccctacggtaccggggtccctacggacccgttattccgtacgtcggacctccgtaacgtcgtcggacctaccctccgaaccgttcccncccgtacgaccctacgtcccgtacggtccgggtcccgtcccgggacgttagggaacggtcgtacgggtacgtaccgtagttacttttaaccggttcttacgttaccgttacttccgttgaaaccgtgtcccgaacgttccggtaacggttnttaccggttctttaacggttccggttaccggttaacgggaacccgggttaccggg

SEQ ID NO: 162891 - DNA, 598 bp, Homo sapiens
  misc_feature: GYAE6OF01C8F0C.34.86.H09.1.454.CMB.1.raw
  modified_base (343)..(343): a, c, t, g, unknown or other
  misc_feature (343)..(343): n is a, c, g, or t
  modified_base (536)..(536): a, c, t, g, unknown or other
  misc_feature (536)..(536): n is a, c, g, or t
  modified_base (546)..(546): a, c, t, g, unknown or other
  misc_feature (546)..(546): n is a, c, g, or t
  modified_base (577)..(578): a, c, t, g, unknown or other
  misc_feature (577)..(578): n is a, c, g, or t
  modified_base (580)..(598): a, c, t, g, unknown or other
  misc_feature (580)..(598): n is a, c, g, or t
tcagtacacgtgatcacgaccggtgctcgatttagtgctatagacttgggtttgggggctgttcctggaagctgcttgtaccagagggtcaccatctcctgcacgtgggagcagcctccaacagtcgggggctaggttatgatgtacactggtacaagcagcttccgaggaaccacgacccccaaactcctcatctatcgacctaaccaccaacgtccggccctcgaccggggtccctggacccgtatttccgtctcgggtacctacctaacgttccgtcggcctaaccttccgaaccgtccccttcccgcgccctagtccgcggtcgggtaccgtcccgggntaggaggattggaggtcttaggtactttactagtcgtactcgttcttagactgcctagccgtgtacgtcgtacttagtcgtcgtacgacggtcggacgtacgtacctccgtacgttacggcaaccgcccgaaccggaacccctaccgtcgtacctcacccgtttctcccgtacccctcgtccacctctccgtntaccgttcgnggtcgcgggtcaggtcaacggcctagtcganntnnnnnnnnnnnnnnnnnnn

SEQ ID NO: 162892 - DNA, 823 bp, Homo sapiens
  misc_feature: GYAE6OF01AG7NP.34.86.H09.1.454.CMB.1.raw
tcagtacacgtgatcacgaccggtgctcgatttagtgctatagacttgggttttggggaggctctgcttcagctgtgggcacaagaggcagcactcaggacaatctccagcatggcctggtctcctctcctcctcactctcctcgctcactgcacagggtcctgggcccagtctgtgctgacgcacgcccgccctcagtcgtccgtcggggcccccaggggcaggtacggggtccacctacttccttccgtgaccgtaccggttggggaacgccaacggccttacccgaaacgtacggttccgggggacctaaggggtttactaggtattacgtaaccgtaccgttaggttaaccaagccgtaacgtccctttaacccgaacgggtaaacccctacccggaaccccccctaaaacttccccttaccgaactttacctaacgttaccgtaacccttaaaccctaacccgtaaacgttccccggtacccccgttacgggtaacccggggtcccccgttacggtaccccgttacgttttacccgtaccggttacggtaccccgttaaccgtaacggttccgtcggtaccctaacccgtccgaaccgttccccgtacccgtcgggtacctacgtccgtaccggtccgggtccggtccggacgtacggtacggtacgtacgggacgtacgttacgttaacgtttaacgtttaccgttcgtttacccgaggttttaccccgttagaaccggtacgacgtaccgtcgttaggtaacggttcgtttacgtttacggttacgtttcggttacccggaacggttaacccgggg

SEQ ID NO: 162893 - DNA, 742 bp, Homo sapiens
  misc_feature: GYAE6OF01DMCZS.34.86.H09.1.454.CMB.1.raw
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctgggcccagtctgtgctgacgcacgcccgccctcagtgtccgtcgggggccccagggcaggacgggtcaccatcctctgcacgtgggacncacgcctaccaacncggtcgggctaggttatggatgtacacgtaggtaacaagcacgccttaccgaaggaaccacgacccccaaactcctacatctactcgactaaaccaccgtaacgtcccggccctacggaccgggttccctacggaccgtacgttctccgtcggacctccgtaacggttctcggacctacccgtcaccgtccccttcccgtcggaccctcgtaccgtaccggttcgggccgttacccggggtcgtacggtaacggacgtcgggacggtcgtacgttaacttttacgtttacgtcggtttaccgtacggttttcccgttaggtaccgtacggtacctacgggtaccgttcgggtaacggttccttacgtttacggttccggtttaaccggttacccggggtaaaccggtacccgggttaaacccggtaaccgggtttccccggtaacccgtttacccggtaacccggggtacctaacccgggtaaaccccccggg

SEQ ID NO: 162894 - DNA, 729 bp, Homo sapiens
  misc_feature: GYAE6OF01CTO8O.34.86.H09.1.454.CMB.1.raw
  modified_base (189)..(189): a, c, t, g, unknown or other
  misc_feature (189)..(189): n is a, c, g, or t
  modified_base (711)..(711): a, c, t, g, unknown or other
  misc_feature (711)..(711): n is a, c, g, or t
  modified_base (713)..(729): a, c, t, g, unknown or other
  misc_feature (713)..(729): n is a, c, g, or t
tcagtacacgtgatcacgaccggtgctcgatttagtgctatagacttggggtttgggggctgttcctggaagctgcttgtaccagagggtcaccatctcctgcactgggagcagctaccaacagtcggggcaggttatgatgtacacgtggtacaagcagccttcgaaggaacacgacccccaactccnatcgtatcgactaacaccacgtccgaccctccggacggggtccctagaccgtatttcctcgtcggtcctaccgaagtcgtcgggacctaacctccgaccgtccccgtacccgtggcccataccgaccggttcggggcccgttcccggggacgtagggaggagttgaggggacttaggttactttacgtttaccgtacggttaccgttacggtttcccgttttaacggactaacgcgtacgtaccgttagggtacgttacgttaccgtttatttaccgggtcgttaaccggggtaaccgtccgggaaacccgttaacggggtaccaaccccgggtttccgttaaggtcccgaaccggtaaccccgaaccggaacccccctaacccgtaccgtcgttaacccgtcctttacccggttccccgttcccggtcccccttaccttccggttactacccgtaccgtcggttaccgttacggggcgtacgggtacgaccgggtaagaccggggtactacgtaggtaccncnnnnnnnnnnnnnnnnn

SEQ ID NO: 162895 - DNA, 707 bp, Homo sapiens
  misc_feature: GYAE6OF01CFTZR.34.86.H09.1.454.CMB.1.raw
  modified_base (312)..(312): a, c, t, g, unknown or other
  misc_feature (312)..(312): n is a, c, g, or t
  modified_base (343)..(343): a, c, t, g, unknown or other
  misc_feature (343)..(343): n is a, c, g, or t
tcagtacacgtgatcacgaccggtgctcgatttagtgctatagacttggggtttggggggggtctcaggaggcagcgctctcgggacgtctccaccatggcctgggctctgctattcctcaccctcctcactcagggcacagggtcctgggcccagtctgccctgactcaggctgcctcgtgtctgggtctccgtggacagtcgatcaccattcctcctgctacgtcggtaaccggctagtagtacgtttagatagtaatttaagtaagttcttagttcctccgtacggtaaccaaaccaaccgacccgganaaacgtcctaacccaaactcatgtaatttanagtatcgtactaagtacgtccggtccctgtacggttcttactctacgttccgttctttacctcgtccgtacccttactacgttcggtaccgtacgggtaaccctaaacccggtacccggttcccccttcccgtacccgtaacctaccttaccgtaccggtacgtacccgtaccggtaacgggtcgtaacgggaacgggtaaccgggtagggttattaacgtttactaccgttgcccgttactcgtaacttaacttactacctcctacgttccaccctattcgtacgtgtcgttagtcggttcggaacgggtaaccggacctaaaccgtccgttaccgtcgttacacgtaccgccgtacgtcccg

SEQ ID NO: 162896 - DNA, 622 bp, Homo sapiens
  misc_feature: GYAE6OF01DANVG.34.86.H09.1.454.CMB.1.raw
  modified_base (606)..(622): a, c, t, g, unknown or other
  misc_feature (606)..(622): n is a, c, g, or t
tcagtacacgtgatcacgaccggtgctcgatttagtgctatagacttgggtttggggggctgttcctggaagctgcttgtaccagagggtcaccatctcctgcactggggagcagctccaacagtcgggggcaggttatgatgtacactggtacaagcagcttccaggaacacgaccccccaaactcctcatctatcgactaacaaccaatccggcccttcgacggggtccctggacccgtattcctctcggcctccaagtctggcacctcacgccctccctggccatccgacgttcggggcctcccggggatcggaagggacgttggacgggcttacggtaattttacttaacgttcggttcgtacgtttccgttttagaacgacgtcaacggtcccttggacgttggtactttagtcggttcgttacgggaacgtcgggaacctagggtcctacccgttcgtaggtccacgacccgaacggtaccccacccctagtcgtaccctacttccttcccgttcccctacccctcctactacttccacggtttctaccggttggaccgggtccgggtccgtcggggaaccaaggggtcaacctagtcgnnnnnnnnnnnnnnnnn

SEQ ID NO: 162897 - DNA, 755 bp, Homo sapiens
  misc_feature: GYAE6OF01B5NHX.34.86.H09.1.454.CMB.1.raw
  modified_base (180)..(180): a, c, t, g, unknown or other
  misc_feature (180)..(180): n is a, c, g, or t
  modified_base (190)..(190): a, c, t, g, unknown or other
  misc_feature (190)..(190): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacgagggtcctgggcccagtctgtgctgacgcncgcccgcctnagtcgtcgtcggggccccagggcaggacgggtccacctacttcctccgtgaccgtacgtggggacgccaacggtcctaacccgaaacgacggtccgggggtactaaggggtttatcggtaagttacgtaccgtaacgttacggtaacgaaacgccgtaacggtccttaccggaacggaaccaaccgacccccctaaaatccctacattaccgtagtcgtaacctaaccaaccgtaagtcccggtacctccgggtaacggttcccacggtaccgtactttcgccgtcgacctaccgtaacgtcgtccgtactacccgtcacccgtccctccggtacgaccctagtcccgtacgggtccgggtcccgtaccgggtacgtacggggaacgtagtaccgggaggtcccttaaggttaacgtttaaccgtttacggtaccgtttcggtaaccgtttccgttaaccgggactacggtaccgttacggtaccggttaggtaacggttcgtaacgttttcgtaccgggtttacggttaaccgggtacggtaaccgggtacccggttaaaccgg

SEQ ID NO: 162898 - DNA, 699 bp, Homo sapiens
  misc_feature: GYAE6OF01EH6GL.34.86.H09.1.454.CMB.1.raw
  modified_base (272)..(272): a, c, t, g, unknown or other
  misc_feature (272)..(272): n is a, c, g, or t
  modified_base (366)..(366): a, c, t, g, unknown or other
  misc_feature (366)..(366): n is a, c, g, or t
  modified_base (388)..(388): a, c, t, g, unknown or other
  misc_feature (388)..(388): n is a, c, g, or t
  modified_base (671)..(671): a, c, t, g, unknown or other
  misc_feature (671)..(671): n is a, c, g, or t
  modified_base (674)..(674): a, c, t, g, unknown or other
  misc_feature (674)..(674): n is a, c, g, or t
  modified_base (678)..(678): a, c, t, g, unknown or other
  misc_feature (678)..(678): n is a, c, g, or t
  modified_base (681)..(681): a, c, t, g, unknown or other
  misc_feature (681)..(681): n is a, c, g, or t
  modified_base (683)..(684): a, c, t, g, unknown or other
  misc_feature (683)..(684): n is a, c, g, or t
  modified_base (686)..(699): a, c, t, g, unknown or other
  misc_feature (686)..(699): n is a, c, g, or t
tcagtacacgtgatcacgaccggtgctcgatttagtgctatagacttgggtttgggggctgttcctggaagctgcttgtaccaggaggtcaccatcctcctgcacgtggggagcacgcctaccaacgaggtcggggctaggttatgatgtacacgtggaacaagcacgtcttaccgacggaaccaccgacccccaaactcctcacttctacgtacacctaaccaaccgtaacgtccggcccgttacggaccggggttccctaggtaaccttntttccgtccgtcggtacctaccggtacgtccgtcgacctacctcgaccgtcccgtaccgtcggacctagtccgtacggtccgggccgtacgggngtgggaagcgttacgggaggtnttacggttaatttacttacggtggtacacgtgtacggtggaagtcgaacgctacggtccggttaggtcgggttcggggtttgggttacgggtcggggaacggtaacgggtaaccgcgggtacgtacccgggttaccgtacggtaaccggccgtaacccggtaccggtacccggtccttcccggtccccgttacggttacccttaccgttcccttaccgtcccctacctccgtacgtacgtcgtaccggtcgacggcgacggtcgacgacgtcgacgacgtcgnacngacncgngnngnnnnnnnnnnnnnn

SEQ ID NO: 162899 - DNA, 812 bp, Homo sapiens
  misc_feature: GYAE6OF01EI7ZF.34.86.H09.1.454.CMB.1.raw
  modified_base (794)..(794): a, c, t, g, unknown or other
  misc_feature (794)..(794): n is a, c, g, or t
  modified_base (799)..(799): a, c, t, g, unknown or other
  misc_feature (799)..(799): n is a, c, g, or t
  modified_base (805)..(806): a, c, t, g, unknown or other
  misc_feature (805)..(806): n is a, c, g, or t
  modified_base (809)..(809): a, c, t, g, unknown or other
  misc_feature (809)..(809): n is a, c, g, or t
  modified_base (811)..(811): a, c, t, g, unknown or other
  misc_feature (811)..(811): n is a, c, g, or t
tcagtacacgtgatcacgaccggtgctcgatttagtgctatagacttgggtttgggggctgttcctggaagctgcttgtaccagagggtcaccatctcctgcacgtggggagcagcctaccaacagtcgggggactaagggttatgtatcgtacactagggtaacaaggctacgaccttaccgaaggaaccaccgaccccctaaactcctactatctatacgactaaccaccaacgtccggacccgtacggtaccggggttccctacggaccgttacttcctcgtacggtcctaccgtaacgtcgtccggacctacctcgaccgtcccctccgtcggaccctacgtaccgtacggtccgggtaccctccggtaaggtccggtaggaggtacggttagggaccgttagtttaacgtttactttaaccgtttacggtcgttcggttaaccgtttcgttaagaacgtacgaccgtacgtaccgtaggtacgttactttacgttaggttaccgttacccgggttaacggaacgggtcgtaaacccggttacgtaccccggttacggttaccgtaacggaccgtaacccgaacccgtaacccgaaccccgtaacccgtacgttacccgtacccttacccgtttcccggttccccgttaccccgtaccccttacccttaacgttaccgtacccgttaacgggccgttttacgggaccgggtccggggttacccgggtccggtaaccgggacgttaacccgggactacggtaaccgtggctacgcgttaacgctacgcgtngcagngcgtcnntgngnc

SEQ ID NO: 162900 - DNA, 629 bp, Homo sapiens
  misc_feature: GYAE6OF01D56FD.34.86.H09.1.454.CMB.1.raw
  modified_base (392)..(392): a, c, t, g, unknown or other
  misc_feature (392)..(392): n is a, c, g, or t
  modified_base (606)..(606): a, c, t, g, unknown or other
  misc_feature (606)..(606): n is a, c, g, or t
  modified_base (608)..(612): a, c, t, g, unknown or other
  misc_feature (608)..(612): n is a, c, g, or t
  modified_base (614)..(614): a, c, t, g, unknown or other
  misc_feature (614)..(614): n is a, c, g, or t
  modified_base (616)..(629): a, c, t, g, unknown or other
  misc_feature (616)..(629): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtaacaagcagccttcaaggaaccacgacccccaaactcctcaatctatagacctaacaccgaactccggccctcgacgggtccctcgaccgtactttctcgtcggctaccaagtcctcggcctacctacaccgccctcccgtcggcctctacgtacggtcggtccgtccgggttaccgaggactcggaacggtcgttagttaacttttactttcgtcggttcgacgtacggtctaaggtggtacncgtaacggcgtaccgtaggtggttcgggtttagggtccggttaccggggacgggtacggaaccgtacggtcgtaccgtacccggttcgttacgacggaccgtaccgacgcgtcccgtcccccgtcgtcctacctccgttccgtccctaccccgttctacgtcgtacgtctggtacgacggtccgcgggtcgaacggtcgacggcgtactagcgngnnnnngngnnnnnnnnnnnnnn

SEQ ID NO: 162901 - DNA, 676 bp, Homo sapiens
  misc_feature: GYAE6OF01DEJYK.34.86.H09.1.454.CMB.1.raw
  modified_base (122)..(122): a, c, t, g, unknown or other
  misc_feature (122)..(122): n is a, c, g, or t
  modified_base (653)..(654): a, c, t, g, unknown or other
  misc_feature (653)..(654): n is a, c, g, or t
  modified_base (656)..(658): a, c, t, g, unknown or other
  misc_feature (656)..(658): n is a, c, g, or t
  modified_base (661)..(661): a, c, t, g, unknown or other
  misc_feature (661)..(661): n is a, c, g, or t
  modified_base (663)..(667): a, c, t, g, unknown or other
  misc_feature (663)..(667): n is a, c, g, or t
  modified_base (669)..(669): a, c, t, g, unknown or other
  misc_feature (669)..(669): n is a, c, g, or t
  modified_base (671)..(676): a, c, t, g, unknown or other
  misc_feature (671)..(676): n is a, c, g, or t
tcagtacacgtgatcacgaccggtgctcgatttagtgctatagacttgggtttgggggctgttcctggaagctgctttgtaccagagggtcaccatctcctgcactgggagcagcctccaanagtcggggcaggttatggatgtacacgtggtaacaagcacgcttccgaaggaaccacgaccccccaaactcctcatctatgacctaacacacgtccggccctcgacgggtcctagaccgtattcctgtcggacctaccgaagttccgtacggccacccttcgacgtcccctcccgtcggacccatccgtacgtcggggcctccggggctaggaggtatcggagtcgtagttactttaacgttcgtcgtacgttaaccgttccgttaaggacgacgtcgaacgtccgtggtacgtcgtttacgtttacgttcggttacgtttacccgggaagtccggggtaaaccgtaccggtccgtaaccgttccggtagccccgaaccgggacccgaaccggaccccctaacccgtccgttacgtaccctaccgtttcccgtcccgttccccgtcccctaaccgttctaaccgtccgtaacggttccgtacggtggccgggtcggtacgcggaacccgggacgtacggacacttgaccgnncnnncgngnnnnncncnnnnnn

SEQ ID NO: 162902 - DNA, 770 bp, Homo sapiens
  misc_feature: GYAE6OF01CZU8H.34.86.H09.1.454.CMB.1.raw
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctgggcccagtctgtgctgacgcacgccgccctcagtcgtcgtcggggccccgagggcaggacgggtcaccactcctcctgacacgtgggacgcacgcctaccaacgacggtcggggactagggttatgtatacgtacacgtaggtaacaagcacgtccttaccgaaggaaccacgacccccaaactcctactatactatcgactaaacaccaacgtcccggcctaccggacgggtccctacggaccgtacttcgtacgtcggcctaccgtacgttccgcggtacctaccgtcgaccgtaccccttcccgtacggaccctacgtaccgtacggtccggggtcccgtacccggggcgtacgggaacggtacgtcggacggtcgtttaagttacgttttaacgttacggttagtaccgttaccggtttccgtttaggaccgttacgtccgtacggtcccgtttagggtaacgtttccggttaacgtttaccggtttaccgggttaccggtttaacccgggtaaacgggttaccccggggttaaaacccgttacggggtttaccccccgttaacccgggtttaaccccggtttaccgggacccccgttaaacccgggaacccccccggg

SEQ ID NO: 162903 - DNA, 687 bp, Homo sapiens
  misc_feature: GYAE6OF01EQWVP.34.86.H09.1.454.CMB.1.raw
  modified_base (277)..(277): a, c, t, g, unknown or other
  misc_feature (277)..(277): n is a, c, g, or t
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtcgtcgtcggggccccagggcaggagggtcaccgatctcctgcacgtgggagcgagcctaccaacagtcggggctaggttangtatgtacacgtggtacaagcagctaccgaggacacgaccccaactcctacatcatcgactaacgacaatccggcctacgtacggggtccctaggaccgtacgttctcgtcggtacctaccgtaacgttccgtagggaccctacccgtacgaccgtacccgttccccggtaggacccctaacgtcccggtaaccgtaccgggggtccgttacccggggcttaggggtacgggtaacttcgggaacgggttccctttaaggtaacttttacgtaccgtttacggtaccgttaacggtttcccgtttaacggaccgtacggtacccgtacgggttcccgtagggttacgttcggtaaccgttttacggttcccggtttaaccgggtttacgggaaacccgtttaccgggggg

SEQ ID NO: 162904 - DNA, 830 bp, Homo sapiens
  misc_feature: GYAE6OF01ALMXO.34.86.H09.1.454.CMB.1.raw
tcagtacacgtgatcacgaccggtgctcgatttagtgctatagacttgggtttgggggctgttcctggaagctgcttgtaccagtgtacatcataacctgccccgatgttggagctgctcccagtgcaggagatggtcgaccctctgcccgtcggggccccagacacgtggagggcggctgcgtcagccacagacgtcgggcccaggccctgtgcagtgagcggaggagaggtggagggaggagaggacgaccgaggccagtcggacgtagggaagttagtttcggtccgtaaggtcggttgtccttcggtcccttacggtttcggaccgaccccgtagacggtcgtaaggaacggacgtacggaacccgttcccttaaacccaaaaccccgttctaaccgtacgttaccgttagtaccggtaaaccttaaacccaaaccgtaaccggttcccccgggtacccgtaaccgggggtaccccgggggtttacccctaacggtaaccccggttacttttaccccggtacggttccgggtaaccccgttaacccggtaaaccggttccggttacccgggacccctttacccgtaccgaacccgttccccgtcccggttaccgacccttccgtaaccggtccgggtccggtccggtccggtacggtacgggtacgggtactacggggtacggtaccttaggttaacttttaacgttccgttaggttcccgtttacggttaccgttacggaaccgtcgtaccggtaccggttcgtacggtacggttcgttacgtttacggttccgtttacgggttacccggtaacggtaacccggg

SEQ ID NO: 162905 - DNA, 681 bp, Homo sapiens
  misc_feature: GYAE6OF01DNN6T.34.86.H09.1.454.CMB.1.raw
  modified_base (254)..(254): a, c, t, g, unknown or other
  misc_feature (254)..(254): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacgagggtcctgggcccagtctgtgctgacgcacgcccgccctcgaggtcgtccgtcggggccccagggcaggacggtccaccgatcctcctgccgacgtggggacncgtacgcctaccaaacgtacggtccgggggactaaggttataggtacgttacggtacctacgttaggtaacaagcacgtcctacgacggaaccaccgacccctaaactccctacactactacgtactactaaaccaccgtaacgtcccggacccttacggaccgggtcctacgaccgttacttccgtcgtcgacctaccgtaacgttccgcggtacccacctacgtaccccgtccgttacccgtcggacccttaacgtccgtaacccggtcgggtacccgtccgggactaggaaccgtgtacgaggtctagtttactacgtttacgtcgtaccgtcgttaccgttacgaacgcgtacgtacgtcgtaggttacgtcgttacttacggtcgttacggtaccggtaacggtccggtaacgttaacccgg

SEQ ID NO: 162906 - DNA, 736 bp, Homo sapiens
  misc_feature: GYAE6OF01CXOE8.34.86.H09.1.454.CMB.1.raw
  modified_base (219)..(219): a, c, t, g, unknown or other
  misc_feature (219)..(219): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (265)..(265): a, c, t, g, unknown or other
  misc_feature (265)..(265): n is a, c, g, or t
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctcgggcccagtctgtgctgacgcacgccgccctacaggtcgtccgtcggggccccagggccaggacggtcaccntcctcctgcacgngggancagctacaacgagtcgggactaagttangattgtaactacgtagacacgacacgtccttacgaacggaaccaccgacccctaactccctactacttactacgtacgacctaaaaccaccgtaacgtcccggtccctaccggtaccgggtacccgtacgtacccgtacctttcgtacccgtggtacccttaccgtaacggtccgttaccggaccctaacccggttcaacccggttccccgtcccgttaccggacccgttacgtacccggtaaccgggttccggggtaaccgtcccggggtacgtcgggaacgggtacggtacggtaacggtcgtttaacgtacgtttaacgttcgttaacgtcgttacgtttacgttacgactacgacgtagtcccgttagtcgtacctctttaacgtccggttaggttaccggtacggacccggtaaacgtcggttaaccccttacggtacccgttaaggacccgccggtaaaccccgg

SEQ ID NO: 162907 - DNA, 828 bp, Homo sapiens
  misc_feature: GYAE6OF01EZZ8Q.34.86.H09.1.454.CMB.1.raw
tcagtacacgtgatcacgaccggtgctcgatttagtgctatagacttgggtttgggggctgttcctggaagctgcttgtaccagtgtacatcataacctgccccgatgttggagctgctcccagtgcaggagatggtcgaccctcgtcgcccgtcggggccccagacacgtggagggcgctgcgtcagcacgagaccgtcgggacccgacggtacccgtggtcgcgtaggtggacggacggaagggaggtaggtagggaaggggagggaaggaacgggacgaccggacggaccgtagtcggacggtagggaagttacgttcggtacgtggtaggtcgtccgtcgtccctttcgtcggccgcccaaggtcgtcgtaaggaaccgaccgaaccggaccccctaacccccttaacgtccctactacgttactacgtaccgaaacctaaccaccgtaaccgtcccgggtacccgtaccgggtacccgggtcctaacgtaccgttactttccgtacgtaccggtaccctacggtacgttccgtaccgacccttaccgtcgtacccgtccctaccggtccgacctacgtccggtacggtccgggtcccggtacgggtcgtagggtacgtaggtacggtaccgttacgttaacggtttaactttcccggttacgtccgttaacggtttaacccgtttaccgggtacgaaaccggtccgtacggtacccgggttcggttacgggtactttccccgggttttaagttaccgggtttacccgggtttaaccccgggtaacggggttaaacccggggtcccggtttaaaacccccgggg

SEQ ID NO: 162908 - DNA, 649 bp, Homo sapiens
  misc_feature: GYAE6OF01B9E0C.34.86.H09.1.454.CMB.1.raw
  modified_base (184)..(184): a, c, t, g, unknown or other
  misc_feature (184)..(184): n is a, c, g, or t
  modified_base (588)..(588): a, c, t, g, unknown or other
  misc_feature (588)..(588): n is a, c, g, or t
  modified_base (621)..(621): a, c, t, g, unknown or other
  misc_feature (621)..(621): n is a, c, g, or t
  modified_base (629)..(629): a, c, t, g, unknown or other
  misc_feature (629)..(629): n is a, c, g, or t
  modified_base (632)..(635): a, c, t, g, unknown or other
  misc_feature (632)..(635): n is a, c, g, or t
  modified_base (637)..(649): a, c, t, g, unknown or other
  misc_feature (637)..(649): n is a, c, g, or t
tcagtacacgtgatcacgaccggtgctcgatttagtgctatagacttggggtttgggggctgttcctggaagctgcttgtaccagagggtcaccatctcctgcactgggagcagctccaacagtcggggcaggttatgatgtacactggtacaagcagcttccaggaacacgccccaaatcctnatctatgactaaacaccaagtccggccctacgacggggtccctaggaccctattccgtgtcggtacctaccgtaaaggttcctacgggacccaccttacacgtcccgttcccgttacgggaccctactaccgaccgttcggggcgtccgggtaccgtggaacggagtaggaacggtccttagggtaatttaacgtttaacgtcggttacgttacgtaccctttttaggacgtacgtacgacgtccgtagtacgtgtacttacgtcgttacgttacgtacggtacggtaccgtaacggtcctaccgtcgtacgtacgacgaccgaccgtacccaacccgtactcgtacctacgttcttaacccgttcccaccctacctcctaacgttccgtacgtcgttaacggngtaaccgggcggtccgtaggaccgaacgcgtanacgtagcngannnngnnnnnnnnnnnnn

SEQ ID NO: 162909 - DNA, 822 bp, Homo sapiens
  misc_feature: GYAE6OF01EYTDB.34.86.H09.1.454.CMB.1.raw
tcagtacacgtgatcacgaccggtgctcgatttagtgctatagacttgggtttgggggctgttcctggaagctgcttgtaccagagggtcaccatctcctgcacgtgggagcagcctccaacagtcggggcaggttatggatgtgcagttcggaaccaacagtccttaccgaaggaacacgacccccaaactcctacatctagtgacctaaacaccgaacgtcccgggccctacggaccggggttaccctacgtaccgtacttccgtccttcgggccctacccgaaggttcctcgggacctacccgtcgacccgtcccctcccgtggaccctactccgtaaccggtcggggtcccgtcccggggtacgtagggaacgggtacgttacggaacgggtcttaacggttaacttttaaccgtttaccgttcgttaccgtaccggttttcccgtttaggaacccgtggaccgtacggtcccttaggtacggttcttacgttagtttcggttacccggttaggaaccggttacgggaaccctaaggtcccgtaacccgttcggtaccgtcgaaccggtaccccgaacgtaccccctaacccgtcgtccggttactacccgtttcccgtacccgtttccccgtacccttacccgttcgtacccgtaccgggttacccgttacgtaacccggtttcgggacccggggcccgggtttacgaccggggtaaccgaacggggtcccgtaagttaacccgagtcgtacgacggtcctaacgtacgcgcgtagtacgtcgtacgtacgacgtacgtacgtagacgtcgtagacg

SEQ ID NO: 162910 - DNA, 873 bp, Homo sapiens
  misc_feature: GYAE6OF01BRFCF.34.86.H09.1.454.CMB.1.raw
  modified_base (144)..(144): a, c, t, g, unknown or other
  misc_feature (144)..(144): n is a, c, g, or t
  modified_base (201)..(201): a, c, t, g, unknown or other
  misc_feature (201)..(201): n is a, c, g, or t
tcagtacacgtgatcacgaccggtgctcgatttagtgctatagacttgggtttggggaggctctgcttcagctgtgggcacaagaggcagcactcaggacaatctccagcatcggctggtcctcctctcctcctcacctctccncgctcactgccgacgtacgggtcccgtcggaccctagtcgtcgtcgacgtacggacnccgacgccccgtcccgtacgacgttcggtaccgggtcccggggaccccggaggggaccgtaacgggtaccgggttacccaccgtaaccgttccgtaccgtcgaccgtacggtcgggaacgtaccgaaccggtcccttaaccgaacgtaccgggtacggggtaccgttaaggttacgtaggtactacggttaacgtaccgttacggtaacgaacgtaccggtactaccgttacggaaccggtaacccctacccgtaaccccctaaccttacctacctacttaaccgtacgtaccgtaaacctaaaccccgtacgtaacccggtccccgtaccggttaccggtaccgggttacccgtacggttaccgttaaccgttacgtcgtaccgtctaacccgtacgttccgaccgtaccctacccgtacccgacccgttccccgccgtacccggaccgttacccgtccgggtaccggtacccgggttccggtcccgggtacggtacgggaacggttaccgggtacgggtaccgttacggttaccggtttaacttaccgtttaccggtcgttaccgttaaccgttcggttaacgtacggaccttacgtacggttccgtacggttcgtacgtttacgttacggttaaccgttcggttaaacccgggttggtaaaccccgggg

SEQ ID NO: 162911 - DNA, 920 bp, Homo sapiens
  misc_feature: GYAE6OF01AN1NK.34.86.H09.1.454.CMB.1.raw
  modified_base (246)..(246): a, c, t, g, unknown or other
  misc_feature (246)..(246): n is a, c, g, or t
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctgggcccagtctgtgctgacgcacgcccgccctcagtcgtccgtcggggccccagggccaggacgggtcaccgatccgtccgtgacctacgtgggggaacnccgtaagccttaccgaaacgacggtttccggggggacctaaggggtttactacggtagttccggtaaccgaccgtttacggggtaacctaaacggccggtaaacggttcccgttaaccccgggaaaggggtaaaacccctacccgggaacccccccttaaaaaccgttcccgtttaaaccaaacggtttccttaaacgtaccggtaaccctttaaaaaccccgaaccccgttaaacgtttccccgggaccccgttttaaccgggacccgggggttttacccccaacgggtaccccgttaacgtttcccgtaccggttaccggtaacccgtttacccggtaaacgtttccgttacgggaaccctacccgtaccggtaaccggtaccccgtttcccggaaccgggtccctaacgtccgtaccggttcccggggtaccgtacccggggtctaacgggacgttaggtaccggacggttaacgtacgttaactttaacggttccttacggttacgtacgtttacccggttagaaccgttacggtaccggttaccgcggttaacgtacggttacgttaccctttaaggtccgggttaacccgtttacgggaaccgttcgggtaaacccgttagggttaccccaccgggtttaccgaacggtcccggaaaccgtaccccgg

SEQ ID NO: 162912 - DNA, 535 bp, Homo sapiens
  misc_feature: GYAE6OF01CS2GV.34.86.H09.1.454.CMB.1.raw
  modified_base (111)..(111): a, c, t, g, unknown or other
  misc_feature (111)..(111): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (307)..(307): a, c, t, g, unknown or other
  misc_feature (307)..(307): n is a, c, g, or t
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
  modified_base (345)..(345): a, c, t, g, unknown or other
  misc_feature (345)..(345): n is a, c, g, or t
  modified_base (474)..(474): a, c, t, g, unknown or other
  misc_feature (474)..(474): n is a, c, g, or t
  modified_base (479)..(479): a, c, t, g, unknown or other
  misc_feature (479)..(479): n is a, c, g, or t
  modified_base (511)..(511): a, c, t, g, unknown or other
  misc_feature (511)..(511): n is a, c, g, or t
  modified_base (519)..(535): a, c, t, g, unknown or other
  misc_feature (519)..(535): n is a, c, g, or t
tcagtacacgtgatcacgaccggtgctcgatttagtgctatagactttgggtttgggggctgttcctagaagctgcttgtaccagagggtcaccatctcctgcactgggancagtcctccaacgagtcggggcaaggttatggactgtacacgtaggtacaagctgtccttccaaggaaccacgccccctaaatccacgatcgatgacaacaccatccggcctgacgggcctagacnttctntgccncagttcgccacttcgactccnccnggacactcgagtcgggctaccggtggaagtagcgtntagatacgttctgacnttactnaccgatcagtctaggntcgtatttaacgcgtaccgtggaaacgtgaaccgaagtttcccgaaccttgtacgacaccgtaccaggtacccacctgagtaccactttccggcttaaccccgccttccaagttcccgagtacgtaccnggtanaccgggttcggacttaggcacgtccgatgtancagtttcnnnnnnnnnnnnnnnnn

SEQ ID NO: 162913 - DNA, 606 bp, Homo sapiens
  misc_feature: GYAE6OF01APC80.34.86.H09.1.454.CMB.1.raw
  modified_base (587)..(589): a, c, t, g, unknown or other
  misc_feature (587)..(589): n is a, c, g, or t
  modified_base (592)..(594): a, c, t, g, unknown or other
  misc_feature (592)..(594): n is a, c, g, or t
  modified_base (596)..(600): a, c, t, g, unknown or other
  misc_feature (596)..(600): n is a, c, g, or t
  modified_base (602)..(606): a, c, t, g, unknown or other
  misc_feature (602)..(606): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggaagaaattatgtatattggcaccagcagttcccaggaacgcccccaaactcctcatctatagtaataatcagccggccctcgacggggtccctgaccgtattctctggcctccaagtctggccacctcacgccctcctggccatcagtcggctccggtctggagatgaggctgacttattacgtgtcgacagcagtgggatggacagcctaggaatcggtctaccgtatcgttccgttacggaacgtcgggaacctaacgggtcctaccggttccgttacggcctaacggcccccgtaaccggacccctaaccccgacgttacgtaccgtacccgttaccgttcccgttacccccgtcccgttaccccttaccgtaccgttcccgtaacggttccgttacgtacggtaccgggtaccgggtcgtaccggaccggaaccgggtccgtacagttaggctagcgnnncgnnncnnnnncnnnnn

SEQ ID NO: 162914 - DNA, 668 bp, Homo sapiens
  misc_feature: GYAE6OF01D2VBL.34.86.H09.1.454.CMB.1.raw
  modified_base (308)..(308): a, c, t, g, unknown or other
  misc_feature (308)..(308): n is a, c, g, or t
  modified_base (349)..(349): a, c, t, g, unknown or other
  misc_feature (349)..(349): n is a, c, g, or t
  modified_base (657)..(657): a, c, t, g, unknown or other
  misc_feature (657)..(657): n is a, c, g, or t
  modified_base (660)..(660): a, c, t, g, unknown or other
  misc_feature (660)..(660): n is a, c, g, or t
  modified_base (664)..(666): a, c, t, g, unknown or other
  misc_feature (664)..(666): n is a, c, g, or t
  modified_base (668)..(668): a, c, t, g, unknown or other
  misc_feature (668)..(668): n is a, c, g, or t
tcagtacacgtgatcacgaccggtgctcgatttagtgctatagacttgggtttgggggctgttcctgggcccagtctgtgctgactcagccaccctcagcgtctgggacccccgggcagagggtcaccatctcttgttctggaagcagctccaacatcggaagaaattatgtatattggcaccagcagttcccaggaacggcccccaaaatcctcatctatagtaataatctgccggccctcgacgggggtcccctgaccgtatttccgtctaggctccaagtctggcaccctcacgcctccctgccntcactggctcgggctggacggatgaggctgaattattactntcacgttccgtttgacagcacgtccttaggacgtgtcgtttatcggttactttaccgggaaacggtttcggggaaccctaaagggttcccgtaacccggttccgtacgggttacccgaacggtacccccgaaacgggcccccctaaaaccccgtcgttaaccggtaccctaaccgtttcccttacccggttaccccctaccccctttcccttaccacgtttacccgaaccggtttacggttaaccgttcggacgggcccgggtaaccgtcggggaacccagggtacccgccgtaaagtacggcgagcnacnacannngn

SEQ ID NO: 162915 - DNA, 646 bp, Homo sapiens
  misc_feature: GYAE6OF01BYF71.34.86.H09.1.454.CMB.1.raw
  modified_base (615)..(615): a, c, t, g, unknown or other
  misc_feature (615)..(615): n is a, c, g, or t
  modified_base (629)..(646): a, c, t, g, unknown or other
  misc_feature (629)..(646): n is a, c, g, or t
tcagtacacgtgatcacgaccggtgctcgatttagtgctatagacttgggtttgggggctgttcctggaagctgcttgtaccagagggtcaccatctcctgcactggggagcagctccaacagtcgggggcaggttatgatgtacactggtacaagcagcttccaggaacacgcccccaaatcctcatcatgctaacgaccaatcggccctcgacggggtccctgaccgtattctctcgggcctccgaagtcgtggaccacctacgaccgcccttaccccgtcggcctacttaccacggttcggggacctcccggggcttcgggagggtaattccgggaagggtccttaggtaacgttttatttaacccgttggtaccgtacgtttcccgtttagacctaggtaccacgtctgacgtgtacttagtcgtaccgttgggaacgtgggtaccaacgggttcctaccgtaccgttacggtcaaccggtacccgtaaccggaccccaaacccccgtatcgtaacctccgttcccgttaccggttccccctcccttaccctcacttcccgtacgtcgtaacgtcggaccggtcgggtacctacgggtaccaggaccgtanaacgttcgatctannnnnnnnnnnnnnnnnn

SEQ ID NO: 162916 - DNA, 573 bp, Homo sapiens
  misc_feature: GYAE6OF01AH4T4.34.86.H09.1.454.CMB.1.raw
  modified_base (139)..(139): a, c, t, g, unknown or other
  misc_feature (139)..(139): n is a, c, g, or t
  modified_base (155)..(155): a, c, t, g, unknown or other
  misc_feature (155)..(155): n is a, c, g, or t
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (255)..(255): a, c, t, g, unknown or other
  misc_feature (255)..(255): n is a, c, g, or t
  modified_base (407)..(407): a, c, t, g, unknown or other
  misc_feature (407)..(407): n is a, c, g, or t
  modified_base (523)..(524): a, c, t, g, unknown or other
  misc_feature (523)..(524): n is a, c, g, or t
  modified_base (530)..(530): a, c, t, g, unknown or other
  misc_feature (530)..(530): n is a, c, g, or t
  modified_base (535)..(535): a, c, t, g, unknown or other
  misc_feature (535)..(535): n is a, c, g, or t
  modified_base (538)..(539): a, c, t, g, unknown or other
  misc_feature (538)..(539): n is a, c, g, or t
  modified_base (542)..(542): a, c, t, g, unknown or other
  misc_feature (542)..(542): n is a, c, g, or t
  modified_base (545)..(547): a, c, t, g, unknown or other
  misc_feature (545)..(547): n is a, c, g, or t
  modified_base (550)..(558): a, c, t, g, unknown or other
  misc_feature (550)..(558): n is a, c, g, or t
  modified_base (560)..(573): a, c, t, g, unknown or other
  misc_feature (560)..(573): n is a, c, g, or t
tcagtacacgtgatcacgaccggtgctcgatttagtgctatagacttgggtttgggggccgttcctggaagcagctccaacatcggaagtaatactgtaaactggtttcagcaacctccaggaaccgccccaaactccncatccatagtaataancagccggccctcgacggggtccctgaccgtattctctggctaccaagtcgtgccacctnacgtccctccgngaccatcaggtcgggcctccggtctaggngacgtggacggtctacgtacttattcgtggtacacgtagcgtaggtcggagtcgaccacgggtcctagacttgtccttactggtcggtacctagggacgtacggaccggtatacccggtccgtacgtacgccacccgtaaccggaaaccccnccccgtaaccgtatccggtcttacccgtccgtttacccgccccctctcctactaagttcccccgaggtttaccacggtcggaccggggcggacgtcggaccggacgtcaacagtcnncgatcngactnctnncgnatnnnctnnnnnnnnngnnnnnnnnnnnnnn

SEQ ID NO: 162917 - DNA, 822 bp, Homo sapiens
  misc_feature: GYAE6OF01E308D.34.86.H09.1.454.CMB.1.raw
  modified_base (166)..(166): a, c, t, g, unknown or other
  misc_feature (166)..(166): n is a, c, g, or t
  modified_base (288)..(288): a, c, t, g, unknown or other
  misc_feature (288)..(288): n is a, c, g, or t
  modified_base (686)..(686): a, c, t, g, unknown or other
  misc_feature (686)..(686): n is a, c, g, or t
tcagtacacgtgatcacgaccggtgctcgatttagtgctatagacttgggtttgggctgcttcagctgtgggcacaagaggcagcactcaggacaatctccagcatgcctgtctcctctcctcctcactctcctcgctcactcgcacgacgggtccgtcggacccngttctgtgcgtgaccgctacgcccgtcctcgtacggttcgttaccggccgggggaccccgaggggacgaacgggtaccggttaaccacctcgttccgtccgtcgaccggaccggtgggaccncgtacgccgttaaccaggtaccggtcggacgttaaggtatcgtactacggtactacggtacgaacgacgtcgacgtacccgtacggaaacgtaacccaacccgtaacccctaacgttcctactacgtacgttacgtccgaaacccttaaacgaccgtaacccggtcccggtaccggtacccggtaccgggttccctaacggtacccgtttccgttacgttccggtaaccgttaccgttaccgtaacggttcctaccgtaccctaccggtacctccccgttacccctcccgggttccgttaaacctccggtaccggtttacccggtcccgggtaccgggtccgttacggtacgggtaacgtaggtaccgggtaccgttacgttaacgtttaaccgtttnttacggtaccgttacggtttaccgttactaccgggacaccggttacgtaacccgttcgtaaggtttccgttacttccggtttacggtacggttttacccgtaaacgggttaccggtaaccgttcccggtaacccgg

SEQ ID NO: 162918 - DNA, 658 bp, Homo sapiens
  misc_feature: GYAE6OF01ENEHX.34.86.H09.1.454.CMB.1.raw
  modified_base (238)..(238): a, c, t, g, unknown or other
  misc_feature (238)..(238): n is a, c, g, or t
  modified_base (483)..(483): a, c, t, g, unknown or other
  misc_feature (483)..(483): n is a, c, g, or t
  modified_base (520)..(520): a, c, t, g, unknown or other
  misc_feature (520)..(520): n is a, c, g, or t
tcagtacacgtgatcacgaccggtgctcgatttagtgctatagacttgggtttgggggtgggcacaagaggcagcactcaggacaatctccagcatggcctggtctcctctcctcctcactctcctcgctcactgcacgagggtcctgggcccagtctgtgctgacgcacgcccgccctcgagtgtcgtcggggccccgagggcgaggacgggtcaccatctccgtgcacgtgggacncgacgcctaccaaacgcggtacggggctaagggttatggaatcgtaactactaggaactaagcgagtccttaccgaaggaaccgaccgaccccctaaactcctacatctatcgactaacaccctaagtcccggcccgtcgaccgggtcccacggaccctattcctcgtcggtcctactacggtctacggaccctacctacgaccgtccctcccgtgccctagtccgacgtcggccgtccgggcgnggacgtacgaggacgtcgttagtattacgttaccgtntaccgtacgttcgttacggactacgcgtaccgtcgtagtacgttcgtactttacggttcgttaaccggttccggtaaaccggttcggaaaccccgtaggtcccgtaccggttaaccggtcgtacccgacggaaccccg

SEQ ID NO: 162919 - DNA, 931 bp, Homo sapiens
  misc_feature: GYAE6OF01BRKTE.34.86.H09.1.454.CMB.1.raw
  modified_base (143)..(143): a, c, t, g, unknown or other
  misc_feature (143)..(143): n is a, c, g, or t
  modified_base (166)..(166): a, c, t, g, unknown or other
  misc_feature (166)..(166): n is a, c, g, or t
  modified_base (803)..(803): a, c, t, g, unknown or other
  misc_feature (803)..(803): n is a, c, g, or t
  modified_base (829)..(829): a, c, t, g, unknown or other
  misc_feature (829)..(829): n is a, c, g, or t
tcagtacacgtgatcacgaccggtgctcgatttagtgctatagacttgggtttgggctgcttcagctgtgggcacaagaggcagcactcgaggacaatctccagcagtcggtcctggtctcctctcctcctcactctccgtcnctcactcgacgacgacgggtccncggcctgtctgtcgctacgaccgcgaccgtcccgtacctcgacggtcggtccggtccggggacccggagggtacgaacgggtacggtccaaccgtactccgtaccgtcggaccgtacgggacggggacaccgtacgacctaaccgtaacggtcgggtaccgggacttaggttaacgtttggacgtaggtcgtacggtactttaacggtaccgttaaccgaacgtcgtaccggtaacggaaccggtaaaccgtacccccgggtaaccccttaaccgtaccttaccggtaaccgttacccggttaaaccggaaccggttaaaccgaaaaacccgttaaccggtaaccccgggttccccggggtaaccccggtaccgggggttaacccggggtccccgttaccggtaccggttttaccgttacccggtacggtaccgtaacccgttaccggtaacgttcccgggttacccaaccccgttccggttccggaccccttccccggtaccggttaccgacccgttacgggtaccccgttacggggtaccgttaacccgggcccggttaaggtacccgggtaagggtaaccggttaacgggtaaccggttacgttacggtttaaaacgttccggttttaaacccncggtacgggttcccttaaacgggttntaaccgtaaccggtacgtaccgttaaccgttgttaacgttaaccggttttagttaccggttacgggttacccggtaaacggtaccggggttcctaaaccggg

SEQ ID NO: 162920 - DNA, 668 bp, Homo sapiens
  misc_feature: GYAE6OF01EWLQ2.34.86.H09.1.454.CMB.1.raw
  modified_base (352)..(352): a, c, t, g, unknown or other
  misc_feature (352)..(352): n is a, c, g, or t
  modified_base (373)..(373): a, c, t, g, unknown or other
  misc_feature (373)..(373): n is a, c, g, or t
  modified_base (641)..(643): a, c, t, g, unknown or other
  misc_feature (641)..(643): n is a, c, g, or t
  modified_base (645)..(645): a, c, t, g, unknown or other
  misc_feature (645)..(645): n is a, c, g, or t
  modified_base (647)..(647): a, c, t, g, unknown or other
  misc_feature (647)..(647): n is a, c, g, or t
  modified_base (649)..(649): a, c, t, g, unknown or other
  misc_feature (649)..(649): n is a, c, g, or t
  modified_base (653)..(653): a, c, t, g, unknown or other
  misc_feature (653)..(653): n is a, c, g, or t
  modified_base (655)..(655): a, c, t, g, unknown or other
  misc_feature (655)..(655): n is a, c, g, or t
  modified_base (657)..(658): a, c, t, g, unknown or other
  misc_feature (657)..(658): n is a, c, g, or t
  modified_base (660)..(661): a, c, t, g, unknown or other
  misc_feature (660)..(661): n is a, c, g, or t
  modified_base (663)..(665): a, c, t, g, unknown or other
  misc_feature (663)..(665): n is a, c, g, or t
  modified_base (667)..(668): a, c, t, g, unknown or other
  misc_feature (667)..(668): n is a, c, g, or t
tcagtacacgtgatcacgaccggtgctcgattttagtgctatagacttgggtttgggggctgttcctggagctgcttgtaccagagggtcaccatctcctgcacgtgggagcagcctccaacagtcggggcaggttatgatgtacactggtacaagcagcttaccaggaacacgacccccaaactcctacatctatcgacctaaaccaccaacgtccggcccgtaccgacggggccctaggaaccgatttcgtctggacctacctaagtcgtcggccaacctccgacgtccctcccgtcggaccactccgacgttcggccgtcggcgtgaggagtgacgctgtatttacgtntacgtctcgttccgtttcganacggtctacgtccgtgtacggtacgttgtttacgttcggtttaccgttacgggtaacggtaccgggtaacccgaacggggtttaccgacccgtttaccggtaacgggaaccacccggtaacccgtaaacgggacccccaaaccccgttacctaccgtaccgtaccttacccgttaccttccccgtacccccgttactaccgtactaccgtacggtacctggtaacggcgggtacgggtcgaacgggacgtaacgacgtaacaggtacnnngngncngcancncnncnnannngnn

SEQ ID NO: 162921 - DNA, 785 bp, Homo sapiens
  misc_feature: GYAE6OF01EL0KI.34.86.H09.1.454.CMB.1.raw
  modified_base (758)..(758): a, c, t, g, unknown or other
  misc_feature (758)..(758): n is a, c, g, or t
  modified_base (762)..(762): a, c, t, g, unknown or other
  misc_feature (762)..(762): n is a, c, g, or t
  modified_base (764)..(765): a, c, t, g, unknown or other
  misc_feature (764)..(765): n is a, c, g, or t
  modified_base (767)..(767): a, c, t, g, unknown or other
  misc_feature (767)..(767): n is a, c, g, or t
  modified_base (769)..(770): a, c, t, g, unknown or other
  misc_feature (769)..(770): n is a, c, g, or t
  modified_base (772)..(785): a, c, t, g, unknown or other
  misc_feature (772)..(785): n is a, c, g, or t
tcagtacacgtgatcacgaccggtgctcgatttagtgctatagacttgggtttgggggctgttcctggaagctgcttgtaccagagggtcaccatctcctgcactgggagcagcctccaacagtcgggggctaggttatgatgtacacgtggtacaagcagcttccaaggaaccaccgacccccctaaacttcctcatctatcgacctaaccaccaacgtcccggccctccgacgggtccctacggaccgtacttctccgtcggcctaccgtagtctcggcctacctcgaccgtcccttcccgcggcctacgtccgtacggtcggggccgtcccgggtcgtggaggtacgtacggacgggtacgttaggttaaactttttaccgtttacgttacggtttacccgttacggttttaccccgtttaaggaccttaacggctaaccgttccgttaggtacggttctttaccgtttacgttcgggttaccggtttaacgggtaaccgggtaaccgggtaacccgtaacggttccccgtaacccggttaccggttaacggacccgtaacccggaaccccggtaacccggtaacccccctaaccccgtaaccgttccggttaacccttacccgtttacccgttaccccccgggtttccccccacccctttacccttacgtaaccttcccgtaaacggtttcgtaccggttacgggaccgggtccggtcggttaaccgggaccgtacggggaccctaacgttagngacncnngngnngnnnnnnnnnnnnnn

SEQ ID NO: 162922 - DNA, 632 bp, Homo sapiens
  misc_feature: GYAE6OF01ARED6.34.86.H09.1.454.CMB.1.raw
  modified_base (214)..(214): a, c, t, g, unknown or other
  misc_feature (214)..(214): n is a, c, g, or t
  modified_base (343)..(343): a, c, t, g, unknown or other
  misc_feature (343)..(343): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
  modified_base (615)..(615): a, c, t, g, unknown or other
  misc_feature (615)..(615): n is a, c, g, or t
  modified_base (624)..(625): a, c, t, g, unknown or other
  misc_feature (624)..(625): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
tcagtacacgtgatcacgaccggtgctcgatttagtgctatagacttgggtttgggggctgttcctgggcccagtctgtgctgactcagccaccctcagcgtctgggaccccccggggcagagggtcaccatctcttgttctggaagcagctccaacatcggaagaaattatgtatattggcacagcagtcccaggacggccccccaaatcctnatctatagtaaataatctgccggccctcgacggggtcccctggaccgtattcctcttgggcctcccaagtcgtcggcctacctcacgccctcccgtggccaatccaggtgggcctcccgggtccgaggntggaaggctagacttagttactgcgtagtcactatacgaaccaaaccgcccgtggggccggggttcttccggggaccggaagggaccgtaaggccgtacggtacccgtccgtcgacgtaccgacgacccgaacggccgtccggcccccccgtcggtccctacccgttaccgttcccgtcccccgtccccgtccctccacctccgtaaccgttcgtaccgtcgtacgggccgggtccgtggaccgtaacggccgacgacgtagcgntngnacncgcacgtgnngngngng

SEQ ID NO: 162923 - DNA, 814 bp, Homo sapiens
  misc_feature: GYAE6OF01C80Q8.34.86.H09.1.454.CMB.1.raw
  modified_base (191)..(191): a, c, t, g, unknown or other
  misc_feature (191)..(191): n is a, c, g, or t
tcagtacacgtgatcacgaccggtgctcgatttagtgctatagacttgggtttggggctgcttcagctgtgggcaacaagaggcagcactcaacggacaatctccagcagtcggcctggtctcctctcctcctcactctcctcgctcactgcacgaggtcctcgggccagtctgtgctcgacgcacgcccncccgtcgagtcggtcgtcggggaccccagggacaacggacggtaccaacgacttcctccgtagacctaagtcgggaacgacacggaccctaaccggaaacgtaccggtacggggacctaaggtttacgagtaatacgtacgtacgtaacggtaacaaagcgtcgtacctaccgaacgaaccgtaccaaccccgtaaactcctagaacttaccgtagtacgtactaaaccgacctaaacggtccccgttaacccgacgggttaccgggtaccccgaacgtaccgtactttacccggacttacgtaccccgttacgtaaacgttccggtaacggtaccttaccgacccttcccgggtacccttacccgtaaccggacctaacgttaccgacggttaccgggtccgggtaccggtcgtaacgggaagggttcggtaaacgacggggttacttaacgggtttaacttacgtttaccgttacgttaccgttaacggtttaaccccgtttaaggaaaccgtttcgggacccgttaaacggtccggttaaggttccggttaacgttccgtttaggttacccgttaaacggttaccgggtaaacgcccggggttaaaaccgttaaccccgg

SEQ ID NO: 162924 - DNA, 666 bp, Homo sapiens
  misc_feature: GYAE6OF01BZYH0.34.86.H09.1.454.CMB.1.raw
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (618)..(618): a, c, t, g, unknown or other
  misc_feature (618)..(618): n is a, c, g, or t
tcagtacacgtgatcacgaccggtgctcgatttagtgctatagacttggggtttggggaggctctgcttcagctgtgggcacaagaggcagcactcaggacaatctccagcatggcctggtctcctctcctcctcactctcctcgctcactcgacacgagggtcctgggcccagtctgtcgctgacgcacgcccgccctcgaggtcgtcgtcggggccccagggcaggcggtccaccntcctccngcgacgtggacgcactacctaccaactacggtccgggggtactaagggttacgtaggtattacgtaacgtacggttacggtaaaccgacgaccgtacggtaccttaccggaaacggaacccgaaccccgtaacccccaaacgttccctacgtacttactactacgactaaccacctacgtacccggcccgtacggaccgggtaccctacgaccgtacttcgtcgtcgtcctacgtacgtccgcgacctaccgcgacccgtccctcctacgacctactccgtacggtccggtaccgtacgggtctgggacgtacggtacgaccggtacgtacgttattacttacgtacgttacgtcgttaccgtacgagtaccncgcgtcgtagtgtcgttcgttagtacggttcgtacggtacggtaccgg

SEQ ID NO: 162925 - DNA, 624 bp, Homo sapiens
  misc_feature: GYAE6OF01BXN81.34.86.H09.1.454.CMB.1.raw
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
  modified_base (588)..(588): a, c, t, g, unknown or other
  misc_feature (588)..(588): n is a, c, g, or t
  modified_base (593)..(593): a, c, t, g, unknown or other
  misc_feature (593)..(593): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (611)..(611): a, c, t, g, unknown or other
  misc_feature (611)..(611): n is a, c, g, or t
  modified_base (616)..(616): a, c, t, g, unknown or other
  misc_feature (616)..(616): n is a, c, g, or t
  modified_base (620)..(622): a, c, t, g, unknown or other
  misc_feature (620)..(622): n is a, c, g, or t
  modified_base (624)..(624): a, c, t, g, unknown or other
  misc_feature (624)..(624): n is a, c, g, or t
tcagtacacgtgatcacgaccggtgctcgatttagtgctatagacttgggtttgggggctgttcctggaagctgcttgtaccagagggtcaccatctcctgcactgggagcagctccaacagtcggggcaggttatgatgtacactggtacaagcagcttccaggaacacgccccccaaaatccctcactctatcgactaaacaccaatccggccctcgacgggtcctgaccgtattctctggcctccaagtctggcactcacgcctcccnggccatccacgtgggcctcgggntgaggatggaggcttagaatttattagtgcagtaccacgaactactaaccaaacctatttaaaccgacgtttcgttacggggttttaccgggacggtaaacgggaacctaacggtttcgaaacccggttcctaacgggtccaaacggtccccgaaaggtccctaccggtcccccgtacgggtaccctaccgttccgttcccgtttcccccgccctaccgttccaacgtcccgtaacgttacgtaccgtgggaccggtcgggtaccgcggtaacgtaacgccgtacaagtcgcanccganctgcgnangcanancacnacgtnacannngn

SEQ ID NO: 162926 - DNA, 721 bp, Homo sapiens
  misc_feature: GYAE6OF01B39R3.34.86.H09.1.454.CMB.1.raw
  modified_base (158)..(158): a, c, t, g, unknown or other
  misc_feature (158)..(158): n is a, c, g, or t
  modified_base (182)..(182): a, c, t, g, unknown or other
  misc_feature (182)..(182): n is a, c, g, or t
  modified_base (199)..(199): a, c, t, g, unknown or other
  misc_feature (199)..(199): n is a, c, g, or t
  modified_base (686)..(686): a, c, t, g, unknown or other
  misc_feature (686)..(686): n is a, c, g, or t
tcagtacacgtgatcacgaccggtgctcgatttagtgctatagacttgggtttggggagctctgcttcagctgtgggcacaagaggcagcactcgaaggacaatctccagcatggcctggtctcctctcctcctcactctcctcgctcactgccacgngggtcctcgggcccagttctggtntcgtgacgcacggcccnccctgagtggtccggtccgggggcccaggggtacacggacgggtccaacctacttccgtccgtcgaccgtacggtgggaaccgcgtaaccggcccttaacccgaacgtacggttccgggggtacctaagggtttaacgtaggtacgttacggtaactacgttacggaccgaaacgaacgtccgaacgtaccgttaaccaaacggtaaaccctacccgaaaccccctaactcctactaacgtaccgtaactacgaacctaaaccgacgtaaccgccgtaccgacgggttccggaccctcggtaccttacgttccgtcgtcccgacgttaccgacgttcggtaccgtaccctaccgttacccgccgttaccccgccgtccgtaccacgtcgtacccggttaggacccgtcgggctaagggagttagtcggtacgttagttacgtagtttacgtagtccgtatacgttacgtcgacgtacgcgtacccgngtacgtacgtcgttctagttcgtacgtacggtacg

SEQ ID NO: 162927 - DNA, 798 bp, Homo sapiens
  misc_feature: GYAE6OF01AFR83.34.86.H09.1.454.CMB.1.raw
  modified_base (259)..(259): a, c, t, g, unknown or other
  misc_feature (259)..(259): n is a, c, g, or t
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctgggcccagtctgtcctgacgcagccgccctcactgtcgtcggggcccccggacagagacgtcaccatctcctgcacgtcgggggcaccgtccaacacgtcggggctaggttangatgtacactggtacagcacgtcgtcaggaacaccgaccccctaaactccctcacgtctactacgactaaccaaccaacgtccggtaccccgtacggtaccggggttaccctcggaacccgttacttaccgtcgtcggtacctacccgtacgttccgtcggaccctacccgtaccaccggtccccgtcccgtccgggtaccctacgttaccgaccgggttcgggtccccggttacccggggacgtcgggtaagggtacgtagggtaacgggtcccttaggttaacgttttaaccgtttaccgttgtttaacccgttcggttttaccccgtttaaggaaccgtacggtacccgtaacggtccgttaacggtacggtttcggtttaacgttcgtttaccgggtttacccgttacccggggtaaggggttaaccccggtaaacccgggttaccggtacccccgttacccggttacccgggtaaaccgggttaccccgaacccggtaaccccgtaaccccggtaaccccccgttaaaccccgg

SEQ ID NO: 162928 - DNA, 245 bp, Homo sapiens
  misc_feature: GYAE6OF02HANI8.34.86.H09.1.454.CMB.1.raw
  modified_base (244)..(245): a, c, t, g, unknown or other
  misc_feature (244)..(245): n is a, c, g, or t
tcagtacacgtgatcacgaccggtgctcgatttagtgctatagacttgggtttggggtgtggtggtctccactcccgccttgacgaggctgactactactgtcagtcttatgataatgacaatcatgtgatattcggcggagggaccaaactgaccgtcctgagtcagcccaaggctgcccctcggtcactctgttcccgccctcctcatcacgtgtactgagcgggctggcaaggcgcatagnn

SEQ ID NO: 162929 - DNA, 248 bp, Homo sapiens
  misc_feature: GYAE6OF02H6V1C.34.86.H09.1.454.CMB.1.raw
  modified_base (246)..(248): a, c, t, g, unknown or other
  misc_feature (246)..(248): n is a, c, g, or t
tcagtacacgtgatcacgaccggtgctcgatttagtgctatagacttgggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccgccctcctcatcacgtgtactgagcgggctggcaaggcgcatagnnn

SEQ ID NO: 162930 - DNA, 465 bp, Homo sapiens
  misc_feature: GYAE6OF02HDFP9.34.86.H09.1.454.CMB.1.raw
  modified_base (455)..(465): a, c, t, g, unknown or other
  misc_feature (455)..(465): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctcctggccatcactggctcgggctgaggatgaggctgattattactgtcagtcctttgacagcagcctgagtgcttatgtcttcggaactgggaccaaggtcaccgtcctaggtcagcccaaggcccaacccactgtccactcctcgttccccaccctcctcactcacgtgtactgagcgggctcggcaaggcgcatagnnnnnnnnnnn

SEQ ID NO: 162931 - DNA, 458 bp, Homo sapiens
  misc_feature: GYAE6OF02JJ5R1.34.86.H09.1.454.CMB.1.raw
  modified_base (381)..(381): a, c, t, g, unknown or other
  misc_feature (381)..(381): n is a, c, g, or t
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
  modified_base (434)..(434): a, c, t, g, unknown or other
  misc_feature (434)..(434): n is a, c, g, or t
  modified_base (441)..(458): a, c, t, g, unknown or other
  misc_feature (441)..(458): n is a, c, g, or t
tcagtacacgtgatcacgaccggtgctcgatttagtgctatagacttgggtttggggctgttcctggaagctgcttgtaccagagggtcaccatctcctgcactgggagcagctccaacatcggggcaggttatgatgtacactggtacaagcagcttccaggaacagccccaaactcctcatctatgctaacaccaatcggccctcaggggtccctgaccgattctctggctccaagtctggcacctcagcctcctggccatcactgggctcgggctgaggatgaggctgattattactgtcagtcctttgacagcagcctgagtgcttatgtcttcggaactgggaccaaggtcacgtcaggtcagcccaagcaacccntgcactcnttcccaccctctcntccacgtgtactgacgcggctggccaaggcncgatagnnnnnnnnnnnnnnnnnn

SEQ ID NO: 162932 - DNA, 451 bp, Homo sapiens
  misc_feature: GYAE6OF02IH2OP.34.86.H09.1.454.CMB.1.raw
  modified_base (321)..(321): a, c, t, g, unknown or other
  misc_feature (321)..(321): n is a, c, g, or t
  modified_base (442)..(451): a, c, t, g, unknown or other
  misc_feature (442)..(451): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaactctgggaacacagccactctgaccatcatcggaccaggctatggatgagctgactatactgtcaggcgtggacagcaacgngtggtattcggcggaggaccaagctgaccgtctaggtcagcccaggctcgcccctggtcactctcgttccccacctcctcatccacgttcgtactgacgcgggctggcaaggccgacatgnnnnnnnnnn

SEQ ID NO: 162933 - DNA, 461 bp, Homo sapiens
  misc_feature: GYAE6OF02G2T3W.34.86.H09.1.454.CMB.1.raw
  modified_base (414)..(414): a, c, t, g, unknown or other
  misc_feature (414)..(414): n is a, c, g, or t
  modified_base (449)..(461): a, c, t, g, unknown or other
  misc_feature (449)..(461): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcacccaaactcctcatctatgctaacaccaatcggccctcaggggtccctgaccgattctctggctccaagtctggcacctcagcctccctggccatcactgggctccgggctgaggatgaggctgattattactgtcagtcctttgacagcagcctgagtgcttatgtcttcggaactgggaccaaggtcaccgtctagtcagcccaaggccaacccactgtcactctcgttcccgccctctcntcacgtgtactgagcgggctggcaaggcgcatagnnnnnnnnnnnnn

SEQ ID NO: 162934 - DNA, 551 bp, Homo sapiens
  misc_feature: GYAE6OF02HS6P3.34.86.H09.1.454.CMB.1.raw
  modified_base (263)..(263): a, c, t, g, unknown or other
  misc_feature (263)..(263): n is a, c, g, or t
  modified_base (419)..(419): a, c, t, g, unknown or other
  misc_feature (419)..(419): n is a, c, g, or t
  modified_base (508)..(508): a, c, t, g, unknown or other
  misc_feature (508)..(508): n is a, c, g, or t
  modified_base (523)..(523): a, c, t, g, unknown or other
  misc_feature (523)..(523): n is a, c, g, or t
  modified_base (544)..(544): a, c, t, g, unknown or other
  misc_feature (544)..(544): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
tcagtacacgtgatcacgaccggtgctcgatttagtgctatagacttgggtttgggggggctgttccgtgggaagctgcttgtaccgagagggtcaccatctcctggcactgggagcagctccaacatcggggcaggttagtgatggtacactgggtacaagcagcttccaggaacagcccccaaactcctcatccgtatgctaacacaatcggccctcgagggtccctgaccgattctactggctccgaagtctggcacctnacgcctcctgcatcactggcctcgggctgaggacctagaggctgtatttagtacgtgtacagttcctttgacagcaggcctgattcgcttagtctacgttcggaacgtgggaccaggtccaccgttcctaggtcacgtcccaacggcccgaacccnctggtacctacgtcctccgttcccacctctactacttacacgttgtaccgtgacggcggtacgacgggtacgaacggcgactagtaggntagacgtgactgacncgtactgcgagacagccaccngcncntc

SEQ ID NO: 162935 - DNA, 477 bp, Homo sapiens
  misc_feature: GYAE6OF02IMW1K.34.86.H09.1.454.CMB.1.raw
  modified_base (392)..(392): a, c, t, g, unknown or other
  misc_feature (392)..(392): n is a, c, g, or t
  modified_base (468)..(477): a, c, t, g, unknown or other
  misc_feature (468)..(477): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccgggctgaggatgaggctgattatactgtcagttcctttgacagcagcctgagtgcttatgtcttggaactgggaccaaggtcaccgtcctaggtcacgcccaaggcccaaccccnctgtccacttcctcgttccccaccctcctcactccacgttcgtactggacggcgggctgggaccaaggcacatagnnnnnnnnnn

SEQ ID NO: 162936 - DNA, 248 bp, Homo sapiens; identical to SEQ ID NO: 162929
  misc_feature: GYAE6OF02F2YGO.34.86.H09.1.454.CMB.1.raw
  modified_base (246)..(248): a, c, t, g, unknown or other
  misc_feature (246)..(248): n is a, c, g, or t

SEQ ID NO: 162937 - DNA, 469 bp, Homo sapiens
  misc_feature: GYAE6OF02H93ON.34.86.H09.1.454.CMB.1.raw
  modified_base (451)..(451): a, c, t, g, unknown or other
  misc_feature (451)..(451): n is a, c, g, or t
  modified_base (457)..(469): a, c, t, g, unknown or other
  misc_feature (457)..(469): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaatcctcatctatgctaacaccaatcggccctcaggggtcccctgaccgattctctggctccaagtctggcacctcagcctccctggccatcactgggctccgggctgaggatgaggctgattattactgtcagtcctttgacagcagcctgagtgcttatgtcttcggaactgggaccaggtcaccgtctaggtcacgcccaaggcccaaccccactcgtcactctcgttccccgccctcctcactcacgtcgtactgagcgggctggcaaggcncatagnnnnnnnnnnnnn

SEQ ID NO: 162938 - DNA, 467 bp, Homo sapiens
  misc_feature: GYAE6OF02F5DTH.34.86.H09.1.454.CMB.1.raw
  modified_base (392)..(392): a, c, t, g, unknown or other
  misc_feature (392)..(392): n is a, c, g, or t
  modified_base (459)..(467): a, c, t, g, unknown or other
  misc_feature (459)..(467): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggcctccgggctgaggatgaggctgattattactgtcagtcctttgacagcagcctgagtgcttatgtcttcggaactgggaccaaggtcaccgtcctaggtcagcccaaggcccaacccntcgtcactctcgttccccgccctcctcatccacgttgtactgacgcgggctggcaagggcgcatagnnnnnnnnn

SEQ ID NO: 162939 - DNA, 455 bp, Homo sapiens
  misc_feature: GYAE6OF02HB9EF.34.86.H09.1.454.CMB.1.raw
  modified_base (427)..(427): a, c, t, g, unknown or other
  misc_feature (427)..(427): n is a, c, g, or t
  modified_base (451)..(455): a, c, t, g, unknown or other
  misc_feature (451)..(455): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggcctccggggctgaggatggaggctgattattactgtcagttcctttgacagcagcctgagtgcttatgtcttcggaactgggaccaggtcaccgtctaggtcagcccaagcccaacccactgtcactctcgttcccaccctcctcactcacgtntactgagcggctggcagcgcatgnnnnn

SEQ ID NO: 162940 - DNA, 503 bp, Homo sapiens
  misc_feature: GYAE6OF02IFYSL.34.86.H09.1.454.CMB.1.raw
  modified_base (405)..(405): a, c, t, g, unknown or other
  misc_feature (405)..(405): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcagccgcctcagtgtctggggccccagggcagagggtcaccatctcctgcactgggagcagctccaacatcggggcaggtatgatgtacactgtacaagcagctccagaacacgccccaaatcctcatctatgctaacaccaatcggccctcgacgggtccctgaccgtattctctggctccaagtctcgccacctcagtcctcctggccatcactcgggctccgggntgaggatgagctgtattacttactgtctacgttccttgacagtcaaggtcctaggacgtgtacttagtcgtcgttacggaactcgggaacctaacggg

SEQ ID NO: 162941 - DNA, 246 bp, Homo sapiens
  misc_feature: GYAE6OF02F145X.34.86.H09.1.454.CMB.1.raw
  modified_base (246)..(246): a, c, t, g, unknown or other
  misc_feature (246)..(246): n is a, c, g, or t
tcagtacacgtgatcacgaccggtgctcgatttagtgctatagacttgggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccaccctcctcatcacgtgtactgagcgggctggcaaggcgcatagn

SEQ ID NO: 162942 - DNA, 505 bp, Homo sapiens
  misc_feature: GYAE6OF02HBGDI.34.86.H09.1.454.CMB.1.raw
  modified_base (225)..(225): a, c, t, g, unknown or other
  misc_feature (225)..(225): n is a, c, g, or t
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggancagctccaacatcggggcaggttatgatgtacactggtacaagcagcttccaggacagccccaaactcctcatctatgctaacaccaatccggccctcgacgggtccctgaccgtattctctggctcaagtctggcacctcacgcctccctggccatcactgggctccgggctggaggatgagctgatttattactgtctagtcctttgactagcagcctgagtgcttagtcgtcttacggaacgtggtaccacggtcaccgtcctaggtcacgtacccg

SEQ ID NO: 162943 - DNA, 481 bp, Homo sapiens
  misc_feature: GYAE6OF02GUMS2.34.86.H09.1.454.CMB.1.raw
  modified_base (460)..(460): a, c, t, g, unknown or other
  misc_feature (460)..(460): n is a, c, g, or t
  modified_base (466)..(481): a, c, t, g, unknown or other
  misc_feature (466)..(481): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccgggctgaggatgaggctgattattactgtcagtcctttgacagcagcccgagtgcttatgtcttcggaactgggacaaggtcaccgtctaggtcacgcccaaggcccaaccccactcgtccactctcgttccccgccctcctcactccacgttcgtactgacggccgggctcgggcaagggcncatagnnnnnnnnnnnnnnnn

SEQ ID NO: 162944 - DNA, 469 bp, Homo sapiens
  misc_feature: GYAE6OF02HSZ77.34.86.H09.1.454.CMB.1.raw
  modified_base (427)..(427): a, c, t, g, unknown or other
  misc_feature (427)..(427): n is a, c, g, or t
  modified_base (457)..(469): a, c, t, g, unknown or other
  misc_feature (457)..(469): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtcccctgaccgattctctggctccaagtctggcacctcagcctcctggccatcactgggctccgggctgaggatgaggctgattattactgtcagtcctttgacagcagcctgagtgcttatgtcttcggaactgggaccaaggtcaccgtctaggtcagcccaaggcccaaaccccatcgtcactctcgttcccaccctcctcatcacgttntactgacgcgggctggcaaggcgacatagnnnnnnnnnnnnn

SEQ ID NO: 162945 - DNA, 592 bp, Homo sapiens
  misc_feature: GYAE6OF02I82YQ.34.86.H09.1.454.CMB.1.raw
  modified_base (224)..(224): a, c, t, g, unknown or other
  misc_feature (224)..(224): n is a, c, g, or t
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctgggcccagtctgtgctgacgcagccgccctcagtgtctgggccccagggcagagggtcaccatctcctgcactgggancagctccaacagtcggggcaggttatgatgtacactggtacaagcagcttccaggaacacgccccaaactcctcatctatgctaacaccaatccggccctcgacgggtccctgaccgattcctcgtcggctaccaagtctcgggccaccctcacgtccctcccgtcggccatccacgtcgggcctccggggctggacggtatggacggtctgtactttattactgttaccagttcctttgaccagtcacgtcctagtagttcgtctttacgttcggttaccgtttacgggtaaaccgttcggggtaacccctaaggggttccctaaccccggttacccgttaagggttacccgtaacggaacccccgg

SEQ ID NO: 162946 - DNA, 459 bp, Homo sapiens
  misc_feature: GYAE6OF02FMSVM.34.86.H09.1.454.CMB.1.raw
  modified_base (388)..(388): a, c, t, g, unknown or other
  misc_feature (388)..(388): n is a, c, g, or t
  modified_base (443)..(443): a, c, t, g, unknown or other
  misc_feature (443)..(443): n is a, c, g, or t
  modified_base (448)..(459): a, c, t, g, unknown or other
  misc_feature (448)..(459): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtcccctgaccgattctctggctccaagtctggcacctcagcctccctggccatcactgggctccgggctgaggatgaggctgattattactgtcagtcctttgacagcagcctgagtgcttatgtcttcggaactgggaccaaggtcacgtctaggtcagcccaagccaacccnctgtcactctcgttcccgccctctcatcacgtgtactgagcgggctggcaaggcncatgnnnnnnnnnnnn

SEQ ID NO: 162947 - DNA, 249 bp, Homo sapiens
  misc_feature: GYAE6OF02HFKDF.34.86.H09.1.454.CMB.1.raw
  modified_base (246)..(249): a, c, t, g, unknown or other
  misc_feature (246)..(249): n is a, c, g, or t
tcagtacacgtgatcacgaccggtgctcgatttagtgctatagacttgggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccaccctcctcatcacgtgtactgagcgggctggcaaggcgcatagnnnn

SEQ ID NO: 162948 - DNA, 788 bp, Homo sapiens
  misc_feature: GYAE6OF02IOAM9.34.86.H09.1.454.CMB.1.raw
  modified_base (779)..(779): a, c, t, g, unknown or other
  misc_feature (779)..(779): n is a, c, g, or t
  modified_base (786)..(786): a, c, t, g, unknown or other
  misc_feature (786)..(786): n is a, c, g, or t
tcagtacacgtgatcacgaccggtgctcgatttagtgctatagacttgggtttgggggctgttcctggaagctgcttgtaccagagggtcaccatctcctgcactggggagcagctccaacatcggggcaggttatgatgtacactggtacaagcagcttccaggaacagcccccaaactcctcatctatgctaacaccaatcggccctcgaggggtcccctgaccgattctctggcctccaagtctggcacctcacgccctccccgtggcccatcctacgtggggccttcccggggcttaggaaggtatggaggctagaattttataccgtgtaccacggtttccctttaggaacacggaccacggtccgtaggtacggtcggtccttttaagtcggttaccgtttaccggggtaaaaccggttcggggaaacccttaaaggggttccctaaccccgggtttacccgttaggggtaccaaccgggtacccccgaaaacgggtaccccccaaaacccccgtagttccggtaccctaaaccgtttccccgtttaccggggttccccccccgtacccccttttcccgttaaccgaacccttttaccccggtaacccgggtttaccgtttaaaccccggtaggggtaaccccggggtccgggggtacccggtttaccggggacccgggtaaaaaccggggtccccgaccggttaaaaacctttacggggacggtacgtacgtacgtacgacgtcgcgtcgacgcgtacgcgacgcgcgtacncgtcgancg

SEQ ID NO: 162949 - DNA, 464 bp, Homo sapiens
  misc_feature: GYAE6OF02G08RG.34.86.H09.1.454.CMB.1.raw
  modified_base (456)..(464): a, c, t, g, unknown or other
  misc_feature (456)..(464): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccgggctgaggatgaggctgattattactgtcagtcctttgacagcagcctgagtgcttatgtcttcggaactgggaccaaggtcaccgtcctaggtcacgcccaaggcccaaccccactgtcactctcgttcccaccctcctcatccacgtgtactgagcgggctggcaaggcgcatagnnnnnnnnn

SEQ ID NO: 162950 - DNA, 449 bp, Homo sapiens
  misc_feature: GYAE6OF02HGRWD.34.86.H09.1.454.CMB.1.raw
  modified_base (384)..(384): a, c, t, g, unknown or other
  misc_feature (384)..(384): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (435)..(435): a, c, t, g, unknown or other
  misc_feature (435)..(435): n is a, c, g, or t
  modified_base (440)..(449): a, c, t, g, unknown or other
  misc_feature (440)..(449): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccgggctgaggatgaggctgattattactgtcagttcctttgacagcagcctgagtgcttatgtcttcggaactgggaccaggtcacgtcaggtcagccagcccacccntgcactctcgttcccgccctctcatcacgtntacngagcggctggcaggcncatgnnnnnnnnnn

SEQ ID NO: 162951 - DNA, 473 bp, Homo sapiens
  misc_feature: GYAE6OF02JGPMA.34.86.H09.1.454.CMB.1.raw
  modified_base (394)..(394): a, c, t, g, unknown or other
  misc_feature (394)..(394): n is a, c, g, or t
  modified_base (458)..(473): a, c, t, g, unknown or other
  misc_feature (458)..(473): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcagggggtccctgaccgattctctggctccaagtctggcacctcagcctccctggccatcactgggctccgggctgaggatggaggctgattattactgtcagttcctttgacagcagcctgagtgcttatgtcttcggaactgggaccaaggtcaccgtcctaggtcagcccaaggcccaacccntcgtcactctcgttcccaccctcctcatcacgtcgtactgacgcgggctggcaaggcgcatagnnnnnnnnnnnnnnnn

SEQ ID NO: 162952 - DNA, 467 bp, Homo sapiens
  misc_feature: GYAE6OF02GIVPQ.34.86.H09.1.454.CMB.1.raw
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
  modified_base (454)..(467): a, c, t, g, unknown or other
  misc_feature (454)..(467): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagccctcctggccatcactgggctccgggctgagatgaggctgatttatactgtcagtcctttgacagcagcctgagtgcttatgtcttcggactgggaccaggtcaccgtctaggtcagccagccaacccntcgtcactctcgtcccnccctcctcactctacgtcgtactgacggcgggctgggcaagggccgacagtagnnnnnnnnnnnnnn

SEQ ID NO: 162953 - DNA, 466 bp, Homo sapiens
  misc_feature: GYAE6OF02IGU9J.34.86.H09.1.454.CMB.1.raw
  modified_base (314)..(314): a, c, t, g, unknown or other
  misc_feature (314)..(314): n is a, c, g, or t
  modified_base (387)..(387): a, c, t, g, unknown or other
  misc_feature (387)..(387): n is a, c, g, or t
  modified_base (454)..(466): a, c, t, g, unknown or other
  misc_feature (454)..(466): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtcccctgaccgattctctggctccaagtctggcacctcagcctcctggccatcactggctcggctgagatgaggctgattatactgtcagtcctttgacngcagcctgagtgtcttatgtcttcgaactgggaccaaggtcaccgtctaggtcacgcccaacggcccaacccnctcgtcacttcctcgttcccgcccttcctcactcacgttcgtactgagcggctggacaggcacatannnnnnnnnnnnn

SEQ ID NO: 162954 - DNA, 575 bp, Homo sapiens
  misc_feature: GYAE6OF02HTP8Q.34.86.H09.1.454.CMB.1.raw
  modified_base (535)..(535): a, c, t, g, unknown or other
  misc_feature (535)..(535): n is a, c, g, or t
  modified_base (549)..(549): a, c, t, g, unknown or other
  misc_feature (549)..(549): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
  modified_base (567)..(567): a, c, t, g, unknown or other
  misc_feature (567)..(567): n is a, c, g, or t
tcagtacacgtgatcacgaccggtgctcgatttagtgctatagacttgggtttggggctgttcctggaagctgcttgtaccagaggtcaccatctcctgcactgggagcagctccaacatcggggcaggttatgatgtacactggtacaagcagcttccaggaacagcccccaaagtcctcatctatgctaacaccaatcggccctcgaggggttccctgaccgattctctggctaccaagtctggcacctcagcctccctggaccatcacgtgggcctccgggctggaggtatggaggctgtagttagttacgtcgtcagttcctttgacagcagcctggagtgcttatcgttctcggaactggaaccaaggtccaccgtctaggtcacgcccgaacggcccaacccgtattcgtacctaccttcttccgttaccccacccgttcctacgtaacttccgaacgttcgttaaccgtggaccggtcgggtaccttacgggaccgaaacggggtcgacgtaagtaacgcagtacgtntagctagctactanggtcngtcncgtcgtcgngtgtgtcg

SEQ ID NO: 162955 - DNA, 623 bp, Homo sapiens
  misc_feature: GYAE6OF02FKUBN.34.86.H09.1.454.CMB.1.raw
  modified_base (235)..(235): a, c, t, g, unknown or other
  misc_feature (235)..(235): n is a, c, g, or t
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (294)..(294): a, c, t, g, unknown or other
  misc_feature (294)..(294): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcagccgcctcagtgtctggggccccagggcagagggtcaccatctcctgcactgggancagcctacaacnggcggcgtagtngatcgactacgtgtaacagcatcctacgaagaacncccgaaccccaactccctacactactagtcgtaacctaaccaacctacgtcccgtccctacggtaccgggttcctacggaaccgttacttcctcggtcggtcctaaccgtaacgttcgtcggtaccctacccgtcgacccgtccccttccggtcgacctacgtcctacgggtcggtcccgtaccggtctacgggagtgtacgggacgttcgtaagttatttacgttacgtgtaccgttacgtttccgtacgacgacgtccgaacgtccgtaggtgttcgttagtttacgtcggtttaccgtacgggacggttacggaaccgttaccggg

SEQ ID NO: 162956 - DNA, 277 bp, Homo sapiens
  misc_feature: GYAE6OF02FN9WA.34.86.H09.1.454.CMB.1.raw
  modified_base (246)..(249): a, c, t, g, unknown or other
  misc_feature (246)..(249): n is a, c, g, or t
  modified_base (251)..(277): a, c, t, g, unknown or other
  misc_feature (251)..(277): n is a, c, g, or t
tcagtacacgtgatcacgaccggtgctcgatttagtgctatagacttgggtttgggggtgtggtggtctccactcccgccttgacgaggctgactactactgtcagtcttatgataagtgacaatcatgtgatattcggcggagggaccaaactgaccgtcctgagtcagcccaaggctgccccctggtcactctgttcccgccctcctcatcacgtgtactgagcgggctggcaaggcgcatagnnnncnnnnnnnnnnnnnnnnnnnnnnnnnnn

SEQ ID NO: 162957 - DNA, 464 bp, Homo sapiens
  misc_feature: GYAE6OF02GZ0S0.34.86.H09.1.454.CMB.1.raw
  modified_base (392)..(392): a, c, t, g, unknown or other
  misc_feature (392)..(392): n is a, c, g, or t
  modified_base (410)..(410): a, c, t, g, unknown or other
  misc_feature (410)..(410): n is a, c, g, or t
  modified_base (453)..(464): a, c, t, g, unknown or other
  misc_feature (453)..(464): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggcctccaagtctggccacctcagccctccctggccatcactgggctccgggctgagatgaggctgattattactgtcagttcctttgacagcagcctgagtgcttatgtcttcggactgggaccaggtccaccgtctaggtcacgcccaagcccaacccntcgtcactctcgttcccnccctcctcatccacgtgtctgcgcgggctggcaaggcacatgnnnnnnnnnnnn

SEQ ID NO: 162958 - DNA, 468 bp, Homo sapiens
  misc_feature: GYAE6OF02GK6DB.34.86.H09.1.454.CMB.1.raw
  modified_base (451)..(451): a, c, t, g, unknown or other
  misc_feature (451)..(451): n is a, c, g, or t
  modified_base (457)..(468): a, c, t, g, unknown or other
  misc_feature (457)..(468): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggttccaagtctggcacctcgaaaaaacctccctggccatcactgggctccgggctgaggatgaggctgattattactgtcagtcctttgacagcagcctgagtgcttatgtcttcggaactgggaccaaggtcaccgtctaggtcagcccaaggccaacccactgtcactctcgttcccgccctcctcatccacgtgtactgagcgggctggcaaggcncatagnnnnnnnnnnnn

SEQ ID NO: 162959 - DNA, 554 bp, Homo sapiens
  misc_feature: GYAE6OF02HRV69.34.86.H09.1.454.CMB.1.raw
  modified_base (168)..(168): a, c, t, g, unknown or other
  misc_feature (168)..(168): n is a, c, g, or t
  modified_base (213)..(213): a, c, t, g, unknown or other
  misc_feature (213)..(213): n is a, c, g, or t
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
  modified_base (336)..(336): a, c, t, g, unknown or other
  misc_feature (336)..(336): n is a, c, g, or t
  modified_base (377)..(377): a, c, t, g, unknown or other
  misc_feature (377)..(377): n is a, c, g, or t
  modified_base (438)..(438): a, c, t, g, unknown or other
  misc_feature (438)..(438): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
tcagtacacgtgatcacgaccggtgctcgatttagtgctatagactttggggttttgggggaggctctgcgtttcatctgtgggtcacgaagaggcagcactcaggacaatctccagcatgggccgtggtctcctctcctccgtcacctctacctcgctcactgcacngggtcctgggcccagtctgtgctgacgcagccgccctcagtgtcnggggccccaaggggcaggagggtcaccgatctctgcactggagcagctcaacntcgggcaggttnagatgacgagtcggtacaagcagctccaaggacaacgtaccccaaactcacatcagtnacaacaccaaagtcggcctacgacgggtccagaccgtatcngtcgctcctaagtcttggccactcgacgccctccgtaggcctatcctattggggctcgggntcggaggtacttggacgtctacgtattagtacgcgttcgacgttcctttagacgaacncgngtcccgaagtacgggtctccgttagtttccggttcgttaccggaacggtcccggg

SEQ ID NO: 162960 - DNA, 511 bp, Homo sapiens
  misc_feature: GYAE6OF02IBS7U.34.86.H09.1.454.CMB.1.raw
  modified_base (490)..(493): a, c, t, g, unknown or other
  misc_feature (490)..(493): n is a, c, g, or t
  modified_base (495)..(496): a, c, t, g, unknown or other
  misc_feature (495)..(496): n is a, c, g, or t
  modified_base (498)..(511): a, c, t, g, unknown or other
  misc_feature (498)..(511): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagccctccctggccatcactgggcctccgggctggaggatgaggctgatttattactgtcagttcctttgacagcagcctgagtgtcttatcgtcttcgggaacttcgggacctaaggtccaccgtcgtaggtcacgcccaaggcccaacccctctcgtcacttctccgttccccgccccttcctcatccacgttcgtactggacggccgggtctacgggcgaacgggcgacagtagcnnnncnngnnnnnnnnnnnnnn

SEQ ID NO: 162961 - DNA, 462 bp, Homo sapiens
  misc_feature: GYAE6OF02HYF04.34.86.H09.1.454.CMB.1.raw
  modified_base (423)..(423): a, c, t, g, unknown or other
  misc_feature (423)..(423): n is a, c, g, or t
  modified_base (443)..(443): a, c, t, g, unknown or other
  misc_feature (443)..(443): n is a, c, g, or t
  modified_base (449)..(462): a, c, t, g, unknown or other
  misc_feature (449)..(462): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccgggctgaggatgaggctgattattactgtcagttcctttgacagcagcctgagtgcttatgtcttcggaactgggaccaggtcacgtcctagtcagcccaaggcccaacccactgtcactctcgtcccaccctcctcactcacgtntactgagcggctggcaggcncatagnnnnnnnnnnnnnn

SEQ ID NO: 162962 - DNA, 461 bp, Homo sapiens
  misc_feature: GYAE6OF02FL5D6.34.86.H09.1.454.CMB.1.raw
  modified_base (385)..(385): a, c, t, g, unknown or other
  misc_feature (385)..(385): n is a, c, g, or t
  modified_base (419)..(419): a, c, t, g, unknown or other
  misc_feature (419)..(419): n is a, c, g, or t
  modified_base (442)..(442): a, c, t, g, unknown or other
  misc_feature (442)..(442): n is a, c, g, or t
  modified_base (448)..(461): a, c, t, g, unknown or other
  misc_feature (448)..(461): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagccctccctggccatcactgggctccgggctgaggatgaggctgatttattactgtcagttcctttgacagcagcctgagtgcttatgtcttcggaactggaccaaggtcacgtctagcagccagccaacccntcgtcactctcgttcccaccctcctcatcacgtntactgacgcggctgggcaaggcncatagnnnnnnnnnnnnnn

SEQ ID NO: 162963 - DNA, 487 bp, Homo sapiens
  misc_feature: GYAE6OF02H8O81.34.86.H09.1.454.CMB.1.raw
  modified_base (475)..(487): a, c, t, g, unknown or other
  misc_feature (475)..(487): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatccggccctcgacggggtccctgaccgattctctggctccaagtctggcacctcagcctccctggccatcactgggctccaggctgagatgaggctgattattactgtcagttccttgactgcagcctgagtgtctttatgttcttacggaactgggaccaaggtcaccgtcctagggtccagacccaaggccccaaaccccgtctcgtccacgtccttcgttaccccacctccctcactcacgtgtactgagcggtctggacgaggcgcatagnnnnnnnnnnnnn

SEQ ID NO: 162964 - DNA, 621 bp, Homo sapiens
  misc_feature: GYAE6OF02GO04T.34.86.H09.1.454.CMB.1.raw
  modified_base (235)..(235): a, c, t, g, unknown or other
  misc_feature (235)..(235): n is a, c, g, or t
  modified_base (262)..(262): a, c, t, g, unknown or other
  misc_feature (262)..(262): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctcctgcactgggancagcctccaacagtcggggcaggttangatgtacactggtacaagcagcttccgaggaacacgaccccaaactcctacatctatcgacctaacaccaatccggaccctcgacggggtccctagacccgtattcctcgtcgctaccgaagtcctcggacctacccgtcacgtcccctcccgtcggaccctatccgaccgtcggggtcccgtcccggggctacggacgggtagttcgggacggtccgttagttaactttacgtttaccgttcggttaccgttacgtttccgtttagaccgacggtaccacggtcccgttaggtacggttcgttacgtttagttcggtttaccgttaccgggtaacgttacggggacccgttaaccggg

SEQ ID NO: 162965 - DNA, 467 bp, Homo sapiens
  misc_feature: GYAE6OF02GEMMK.34.86.H09.1.454.CMB.1.raw
  modified_base (319)..(319): a, c, t, g, unknown or other
  misc_feature (319)..(319): n is a, c, g, or t
  modified_base (454)..(467): a, c, t, g, unknown or other
  misc_feature (454)..(467): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacacaatcggccctcaggggtccctgaccgattctctggctccaagtctggcacctcagcctcctggccatcactgggctccgggctgaggatgaggctgtattattactgtcagttcctttgacngcagcctgatgcttatgtcttcggaactgggaccaggtcaccgtctagtcacgcccaagcccaacccatcgtcactctcgttccccaccctcctcactcacgtcgtatcgcggcggctggacacggcacatacgnnnnnnnnnnnnnn

SEQ ID NO: 162966 - DNA, 471 bp, Homo sapiens
  misc_feature: GYAE6OF02GZGG6.34.86.H09.1.454.CMB.1.raw
  modified_base (427)..(427): a, c, t, g, unknown or other
  misc_feature (427)..(427): n is a, c, g, or t
  modified_base (454)..(471): a, c, t, g, unknown or other
  misc_feature (454)..(471): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaatcctcatctatgctaacaccaatcggccctcaggggtccctgaccgattctctggctccaagtctggcacctcagcctccctggccatcactgggctccgggctgaggatgaggctgattattactgcgcctcatatacattcactgccactctcgatgtgtattttcggcggaggaccaaactcaccgtccttcgtcagcccaagctcgcccctcggtcactctcgttcccgccctcctcactcacgtntactgagcggctgcaagcgacatagtnnnnnnnnnnnnnnnnnn

SEQ ID NO: 162967 - DNA, 771 bp, Homo sapiens
  misc_feature: GYAE6OF02ISIEM.34.86.H09.1.454.CMB.1.raw
  modified_base (154)..(154): a, c, t, g, unknown or other
  misc_feature (154)..(154): n is a, c, g, or t
  modified_base (195)..(195): a, c, t, g, unknown or other
  misc_feature (195)..(195): n is a, c, g, or t
  modified_base (276)..(276): a, c, t, g, unknown or other
  misc_feature (276)..(276): n is a, c, g, or t
  modified_base (298)..(298): a, c, t, g, unknown or other
  misc_feature (298)..(298): n is a, c, g, or t
tcagtacacgtgatcacgaccggtgctcgatttagtgctatagacttgggtttgggaggctcgtgcttcagctgtgggcacaagaggcagcactcaggacaatctccagcatggcctggtctcctctcctctcactctcctcgctcactgcacncggtcctcggcccagtctgtgctgacgcacgcccgtcctcngtcgtccgtcggggaccccagggcaggacgggtccacctatccgttccgtgcctacgtgggacacgacgcctaccaaacgngtcccggggatacgggtttacngaacgtcgtactacgttggtaacaagcgaacgtccgttaccgaacggaaacacccgaaccccctaaatcccgtacacttaccaagttccgacctaaaccaaccgaacgttcccgggccctaacggtaaccgggttcccctaggtaaaccctagtttccgtacgtccgtaccgttacccgtaaacggtcccgttacggacccttaacccgttaccgttaacccgggtcccctttaacccgttcggtacccctaacgttcccgtaaccggttccggggcccgttcccgggaccgttaacgggaaccgggtcgttaccgggaaccggttcccgttaagggttaaccgtttaacggttaccgtggttaccccgttagtttacccggtttagaacccggtaacggtcggtaaccggtccgtttaaggaccgttcgtacctttacggttcggttacccgtttacgggaaccgttccggg

SEQ ID NO: 162968 - DNA, 610 bp, Homo sapiens
  misc_feature: GYAE6OF02H4CPF.34.86.H09.1.454.CMB.1.raw
  modified_base (292)..(292): a, c, t, g, unknown or other
  misc_feature (292)..(292): n is a, c, g, or t
  modified_base (393)..(393): a, c, t, g, unknown or other
  misc_feature (393)..(393): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgccctgactcaggctgcctccgtgtctgggtctcctggacagtcgatcaccatctcctgcactgtaaccggcagtgacgttgatgattataagtctgtctctcggtaccaacaaccaccccggnaaacgcctacccaaactcaatcgtatttatgtatgtactaataacgtccggccctcgtaggttcgtttctctactcgtcttactctcgcctcctatcgtcncggacacgaccggtccctccctcgaccctattcctcgtacggtacctcgaggtctacgggacggtacgggtaagggtcgtaatttacgttaccgtcgtccgtaccgtacttaagtacttaacctactttcgtacccttcggtaacccctacctttaccgtacgttacgttacggtttagggttaccggtttttccggggaacgggttaaaccccggg

SEQ ID NO: 162969 - DNA, 617 bp, Homo sapiens
  misc_feature: GYAE6OF02J3RDG.34.86.H09.1.454.CMB.1.raw
  modified_base (242)..(242): a, c, t, g, unknown or other
  misc_feature (242)..(242): n is a, c, g, or t
  modified_base (346)..(346): a, c, t, g, unknown or other
  misc_feature (346)..(346): n is a, c, g, or t
  modified_base (522)..(522): a, c, t, g, unknown or other
  misc_feature (522)..(522): n is a, c, g, or t
  modified_base (599)..(617): a, c, t, g, unknown or other
  misc_feature (599)..(617): n is a, c, g, or t
tcagtacacgtgatcacgaccggtgctcgatttagtgctatagacttgggtttgggggctgttcctggaagctgcttgtaccagagggtcaccatctcctgcactggggagcagctccaacatcggggcaggttatgatgtacactggtacaagcagcttaccaggaccacgcccccaatcctacatctagtcgacctaaacaccgaagtccggccctacgaccggggtcccctgaaccgtnttcctcgtacggcctaccgaaggttcctggccctaccttccacgtcccctcccgtacggcccagttccgacgttccggggccttccggggctaggaggactggngtctagtattattcgttgtacctagttcccttagactacggctacgtccgtaggtacgtgtacttacgtcgtcggtttaacggacgtacgggtaaccagtcctaccgtaccgtacgcgaaccgacccgtaacgaccctaaccctctccgtacctaccttccgtcccggttaccccnccctacctactactaccgtacgtttcgacggtggaccgggtccggtacgtcggaaccgtacgcacgtacgtagctcnnnnnnnnnnnnnnnnnnn

SEQ ID NO: 162970 - DNA, 575 bp, Homo sapiens
  misc_feature: GYAE6OF02I0UVI.34.86.H09.1.454.CMB.1.raw
  modified_base (170)..(170): a, c, t, g, unknown or other
  misc_feature (170)..(170): n is a, c, g, or t
  modified_base (238)..(238): a, c, t, g, unknown or other
  misc_feature (238)..(238): n is a, c, g, or t
  modified_base (258)..(258): a, c, t, g, unknown or other
  misc_feature (258)..(258): n is a, c, g, or t
  modified_base (277)..(277): a, c, t, g, unknown or other
  misc_feature (277)..(277): n is a, c, g, or t
  modified_base (304)..(304): a, c, t, g, unknown or other
  misc_feature (304)..(304): n is a, c, g, or t
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (549)..(549): a, c, t, g, unknown or other
  misc_feature (549)..(549): n is a, c, g, or t
  modified_base (556)..(557): a, c, t, g, unknown or other
  misc_feature (556)..(557): n is a, c, g, or t
  modified_base (559)..(559): a, c, t, g, unknown or other
  misc_feature (559)..(559): n is a, c, g, or t
  modified_base (562)..(563): a, c, t, g, unknown or other
  misc_feature (562)..(563): n is a, c, g, or t
  modified_base (565)..(565): a, c, t, g, unknown or other
  misc_feature (565)..(565): n is a, c, g, or t
  modified_base (567)..(569): a, c, t, g, unknown or other
  misc_feature (567)..(569): n is a, c, g, or t
  modified_base (571)..(571): a, c, t, g, unknown or other
  misc_feature (571)..(571): n is a, c, g, or t
  modified_base (574)..(575): a, c, t, g, unknown or other
  misc_feature (574)..(575): n is a, c, g, or t
tcagtacacgtgatcacgaccggtgctcgatttagtgctatagacttgggtttgggggcgtggttcctggaagctgcttgtaccagagggtcaccatctcctgcactgggagcagctccaacatcggggcaggttatgatgtacactggtacaagcagcttccaggaacncgacccccaaactcctcactctatgctaaacaccaagtccggaccctcgacggggtccctgaaccgtnttctctggcctccaagttcnggccacctcagcctcccgnggccatcacgtggcctcgggctgaggntgaggctgacttntactgtncagcagtggatgacngctgaatcgactctattcgacttacgggaactggggaacccttagggactacccgtaccgtggtaccacgtaccgaacgtaccccgaaaccctactcgtacctaccgttacccgttccggttaccccgcccttacccacctacctcccgttacgaccgttacgaggacccggcgggtcgtcggaaccggacgtccggacaaatacgggtncgcagcnncncgnncncnnncncgnn

SEQ ID NO: 162971 - DNA, 848 bp, Homo sapiens
  misc_feature: GYAE6OF02IK0RK.34.86.H09.1.454.CMB.1.raw
  modified_base (818)..(818): a, c, t, g, unknown or other
  misc_feature (818)..(818): n is a, c, g, or t
  modified_base (825)..(825): a, c, t, g, unknown or other
  misc_feature (825)..(825): n is a, c, g, or t
  modified_base (832)..(833): a, c, t, g, unknown or other
  misc_feature (832)..(833): n is a, c, g, or t
  modified_base (835)..(835): a, c, t, g, unknown or other
  misc_feature (835)..(835): n is a, c, g, or t
  modified_base (837)..(838): a, c, t, g, unknown or other
  misc_feature (837)..(838): n is a, c, g, or t
  modified_base (840)..(840): a, c, t, g, unknown or other
  misc_feature (840)..(840): n is a, c, g, or t
  modified_base (842)..(843): a, c, t, g, unknown or other
  misc_feature (842)..(843): n is a, c, g, or t
  modified_base (845)..(848): a, c, t, g, unknown or other
  misc_feature (845)..(848): n is a, c, g, or t
tcagtacacgtgatcacgaccggtgctcgatttagtgctatagacttgggtttgggggctgttcctggaagctgcttgtaccagagggtcaccatctcctgcactggggagcagcctccaacatcggggcaggttatgatgtacactggtacaagcagcttccaggaacacgcccccaaactcctcatctatgacaacaccaagtccgccctcgacgggtccctgaccgtattcctcgtcggcctacctaagttccgtcggacctacctcgaccgtccccttccccgtcggcccacttcccgaacggttccggggccccgttccccgggggtccttaggggaacgggtgttaacgggacgggtaccgtttaggttaaattttttaaccgtttaaccggttcggtttaaccgtaccggtttttacccgtttttaggaaacccgtacggtaccgtaacggtccccggttaaggaggtttacgttacttttaaggtttccggtttacccggtttaacggggtaaacccggttccgggggaaaacccgttaaaaccggggtttccccgtaaacccccgggtttttaccggttaaaccggggtacccgtaaaccccgggtaaccccccggtaaaaccgggaaccccccccctaaaaccccccgttaggtttacccgtaacccttaaccccgtttcgtttaccccggtttaccccccctaaacccccgtttcccgtactaaccgttaccgttaccggttaccgttaccgtagggaccgggtcgggtcgtacgggaccgaacggggtcctagtaaacgttcgganacgcgcngcgtgcnncncnngncnngnnnn

SEQ ID NO: 162972 - DNA, 525 bp, Homo sapiens
  misc_feature: GYAE6OF02G8F8B.34.86.H09.1.454.CMB.1.raw
tcagtacacgtgatcacgaccggtgctcgatttagtgctatagacttgggtttggggctgcttcagctgtgggcacaagaggcatcactcaggacaatctccagcatggcctggtctcctctcctcctcactctcctcgctcactgcacagggtcctgggcccagtctgtgctgacgcagccgccctcagtgtctgggccccagggcagagggtcaccatctcctgcacgtgggagcagctccaacagtcggggcaggttatgatgtacactggtacagcagctccaggacacgaccccaaactcctcatctatgactaacacctaatccggcctcgacgggtcctgacctatctctggctcaagtctggcacctcacgcctcccgtggcccatccacgtcgggcctccgggctaggaggactggacggtctagtatttacgttacgtgtcgacagcgtagtagggactggaacgcgtaccgtagaacgtcggtcctccgttatcggttaccgtacggtaaccgg

SEQ ID NO: 162973 - DNA, 470 bp, Homo sapiens
  misc_feature: GYAE6OF02G8371.34.86.H09.1.454.CMB.1.raw
  modified_base (325)..(325): a, c, t, g, unknown or other
  misc_feature (325)..(325): n is a, c, g, or t
  modified_base (415)..(415): a, c, t, g, unknown or other
  misc_feature (415)..(415): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (454)..(470): a, c, t, g, unknown or other
  misc_feature (454)..(470): n is a, c, g, or t
tcagtacacgtgatcacgaccggtgctcgatttagtgctatagacttggggtttgggggctgttcctggaagctgcttgtaccagagggtcaccatctcctgcactgggagcagctccaacatcggggcaggttatgatgtacactggtacaagcagcttccaggaacagcccccaaatcctcatctatgctaacaccaatcggccctcaggggtccctgaccgattctctggctcccaagttctggcacctcagcctccctggccatcactggctccggctgagatgagctgattatattgcagctcacataccaactataacnctctgtttcgcggaggaccaagttcgaccgtctacgtcacgcccaaggcctcgccccctcggtctacctctccgttcccaccctctaccntcacgtcgtactgagcggctgggacaggcgctanagngnnnnnnnnnnnnnnnnn

SEQ ID NO: 162974 - DNA, 474 bp, Homo sapiens
  misc_feature: GYAE6OF02G545I.34.86.H09.1.454.CMB.1.raw
  modified_base (444)..(444): a, c, t, g, unknown or other
  misc_feature (444)..(444): n is a, c, g, or t
  modified_base (446)..(474): a, c, t, g, unknown or other
  misc_feature (446)..(474): n is a, c, g, or t
tcagtacacgtgatcacgaccggtgctcgatttagtgctatagactttgggtttggggagcagctccaacatcgggggcaggttatgatgtacactggtacaagcagcttccaggaacagcccccaaactcctcatctatgctaaacaccaatcggccctcaggggtccctgaccgattctctggctccaagtctggcacctcacgcctccctggccatcactgggctccgggctgaggatgaggctgattatactgtcagtcctttgacagcagcctgagtgctttatgtccttacggaacgtcggggaccaaaggtccaaccgtccgtaggtccagacccaaaggcccaaccccactcgtcacctctcgtccccaccctcctcatccgaacgttgtactggaacggcggggtactgggaccgtaaagggctacgaacgtagnannnnnnnnnnnnnnnnnnnnnnnnnnnnn

SEQ ID NO: 162975 - DNA, 641 bp, Homo sapiens
  misc_feature: GYAE6OF02IJG16.34.86.H09.1.454.CMB.1.raw
  modified_base (613)..(613): a, c, t, g, unknown or other
  misc_feature (613)..(613): n is a, c, g, or t
  modified_base (618)..(618): a, c, t, g, unknown or other
  misc_feature (618)..(618): n is a, c, g, or t
  modified_base (620)..(621): a, c, t, g, unknown or other
  misc_feature (620)..(621): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (627)..(630): a, c, t, g, unknown or other
  misc_feature (627)..(630): n is a, c, g, or t
  modified_base (632)..(634): a, c, t, g, unknown or other
  misc_feature (632)..(634): n is a, c, g, or t
  modified_base (636)..(641): a, c, t, g, unknown or other
  misc_feature (636)..(641): n is a, c, g, or t
tcagtacacgtgatcacgaccggtgctcgatttagtgctatagacttgggtttgggggcgtgttcctggaagctgcttgtaccagagggtcaccatctcctgcactgggagcagctccaacatcggggcagggttatgatgtacactggtacaagcagcttccaggaacagcccccaaactcctcaatctatgctaaccaccaatcgccctcacggggtcccctgaccgatttcctcgttacggccttcccaaagttcctggccacctccagccctccctggccctaatccacgtcggcgttcccgggactggacgggtatggaggtcctagtaatttagttacctgtctacgttccttttgaacctagcctagccgtgtagtcgtactttagtcgtgttccggaacgtcgggtaacaacggttccaccggtaccttacgggtccgtacggaaccccgtaaaccgggacccaaaacccccgtaccgttacgtaccctaaccgttccttacccggtttacccccaccccgttccttaccctaccttacccgtacggtttaccgtaccttacgggccgtccgggcgttccggacgaccggtcgaccgagtaacgnacgcncnncncncnnnncnnncnnnnnn

SEQ ID NO: 162976 - DNA, 668 bp, Homo sapiens
  misc_feature: GYAE6OF02J2CSO.34.86.H09.1.454.CMB.1.raw
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtggggccccagggcagacgggtcaaccgatctcctgcacgtgggacgcagcctccaacgagtccggggactaggttatagatcgtaacacgtggtaaccaagcacgtcttaccgaaggaaccaccgaccccctaactcctcgactctatcgacctaacgaccaacgtcccggccctacggacggggtcccctaggaaccgtacttccgtacgtcggacctaccgtaacgttccgtcgggtaccctaccgtccgaccgtcccttcccgtcggtaccacgtacgccgttcgggtccgtccgggctgggaacggtacgtcggtacggcgttaacgttacgtttaacttaacggtcgttacgttaacccgtttccgttaacggacccgtacggtacctacggtcccgttaggtaaccgttcgttacgttacgtttccggttaacgtttaccccgggtaagttaacccgggg

SEQ ID NO: 162977 - DNA, 593 bp, Homo sapiens
  misc_feature: GYAE6OF02IOGRF.34.86.H09.1.454.CMB.1.raw
  modified_base (243)..(243): a, c, t, g, unknown or other
  misc_feature (243)..(243): n is a, c, g, or t
  modified_base (340)..(340): a, c, t, g, unknown or other
  misc_feature (340)..(340): n is a, c, g, or t
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (581)..(584): a, c, t, g, unknown or other
  misc_feature (581)..(584): n is a, c, g, or t
  modified_base (586)..(586): a, c, t, g, unknown or other
  misc_feature (586)..(586): n is a, c, g, or t
  modified_base (588)..(593): a, c, t, g, unknown or other
  misc_feature (588)..(593): n is a, c, g, or t
tcagtacacgtgatcacgaccggtgctcgatttagtgctatagacttgggtttgggggctgttcctggaagctgcttgtaccagagggtcaccatctcctgcactggggagcagctccaacatcgggggctaggtttttgttgtacactggtaccagcagattcccggaacacgcccccaaactcctcattctttaggtaaacaacaatccggccctcgacggggtccctgaccgtattttcngcctccaagtctggcacctcacgccctcctggactattacgtggactccagcctggagatgagtctgattattactgtcagtcactatgaacaaccncccgtggggccgggttcttcgggacgggaagggaccaaggcctacggacccgtcctcgaacgtcgacggacccgaagggtccctccggacccccgtggtaccacgttccgttaccgtcccccaccttcccgtctaacgttccgaaccggttcgtaaccgtgggtacggccggggtctacgggaccaaacggggtcacgtaacgtggcncgngngcncncncncncncncncncncgncncnnnncncnnnnnn

SEQ ID NO: 162978 - DNA, 495 bp, Homo sapiens
  misc_feature: GYAE6OF02JAYJ3.34.86.H09.1.454.CMB.1.raw
  modified_base (286)..(286): a, c, t, g, unknown or other
  misc_feature (286)..(286): n is a, c, g, or t
  modified_base (401)..(401): a, c, t, g, unknown or other
  misc_feature (401)..(401): n is a, c, g, or t
  modified_base (474)..(474): a, c, t, g, unknown or other
  misc_feature (474)..(474): n is a, c, g, or t
  modified_base (477)..(495): a, c, t, g, unknown or other
  misc_feature (477)..(495): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaatcctcatctatgctaacaccaatcggccctcgaggggtcccctgaccgattctctggctccaagtctggccacctcagcctccctggccatcactgggctcggctgagntgaggctgattattactgtcagtcctttgacagcagcctgagtgtcttagtgtcttacggacgtgggacctaaggtccaccgttcctaggtccagtcccaacggcccaaaccccngtcgtacacttctcgttccccgccctcctcactcacgttgtactgacgtcgggctcggacgaggcgcataggncgnnnnnnnnnnnnnnnnnnn

SEQ ID NO: 162979 - DNA, 598 bp, Homo sapiens
  misc_feature: GYAE6OF02JLCUB.34.86.H09.1.454.CMB.1.raw
  modified_base (306)..(306): a, c, t, g, unknown or other
  misc_feature (306)..(306): n is a, c, g, or t
  modified_base (324)..(324): a, c, t, g, unknown or other
  misc_feature (324)..(324): n is a, c, g, or t
  modified_base (576)..(576): a, c, t, g, unknown or other
  misc_feature (576)..(576): n is a, c, g, or t
  modified_base (579)..(580): a, c, t, g, unknown or other
  misc_feature (579)..(580): n is a, c, g, or t
  modified_base (587)..(598): a, c, t, g, unknown or other
  misc_feature (587)..(598): n is a, c, g, or t
tcagtacacgtgatcacgaccggtgctcgatttagtgctatagacttgggtttgggggtcgtgttccgtggaagctgcttgtaccagagggtcaccatctcctgcactgggagcagctccaacatcgggcaggttatgatgtacactggtacaagcagcttccaggaacagcccccaaactcctcatctatgctaacaccaatccggccctcacggggtcccctagacccgatttcctctggcctccgaagtcctggccacctcacgccctccctcggccatccgactcgggctccgggctgaggntcgaggctgattattacngtcagttcctttagacacgtcagtccctgagtcgctttatgttccttacggaactcggggaaccaaggttccacccggttcctaggggttccccaggacccccgtaaacgggcccctaaacccccgaacgttccggtaccaaccgttccgttacccgttaccccctacccccgtcccttaccacctttccaaaccggttccgttactacgggacgtccgggacttcgggaccgacggccgcgataggcagcnacnngttcaannnnnnnnnnnn

SEQ ID NO: 162980 - DNA, 555 bp, Homo sapiens
  misc_feature: GYAE6OF02IIWWA.34.86.H09.1.454.CMB.1.raw
  modified_base (438)..(438): a, c, t, g, unknown or other
  misc_feature (438)..(438): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacagtcggggcaggttatgatgtacactggtacaagcagcttccaggacacgacccccaaactcctcatctatgactaaacaccaatccggaccctcgacggggtccctgaccgtattcctctggcctaccgaagtctcggccaccctcacgtccctcccgtgcccatccacgtcgggctccgggctggaggtntggaggtctagtaactttactacgttgtctacgttcctttagaccagcgacgtcccgtaggtacgttcgtacgtttagttcggttaccgttacgggaacgttcgggacctaaccggg

SEQ ID NO: 162981 - DNA, 596 bp, Homo sapiens
  misc_feature: GYAE6OF02FJ447.34.86.H09.1.454.CMB.1.raw
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtacaagcagcttccaggaacagcccccaaatcctacatctatcgactaacaccaatccggccctcgacggggtccctgacccgtattcctcgtcgggctaccaagtctcgggcaccctcacgtccctccccgtggcccatccgacgtcgggccttccgggctggacggatcggacgggtctaggtaactttagttaccgttcgttactacgtttcccgtttagaccgtaggcctaaggtcccttaggtaacggttcggtccgttttaacgttcggtttaccgtttaccgggtaaccgttacgggggaaccccttaaaccgggg

SEQ ID NO: 162982 - DNA, 616 bp, Homo sapiens
  misc_feature: GYAE6OF02JAEWV.34.86.H09.1.454.CMB.1.raw
  modified_base (230)..(230): a, c, t, g, unknown or other
  misc_feature (230)..(230): n is a, c, g, or t
  modified_base (594)..(594): a, c, t, g, unknown or other
  misc_feature (594)..(594): n is a, c, g, or t
  modified_base (598)..(601): a, c, t, g, unknown or other
  misc_feature (598)..(601): n is a, c, g, or t
  modified_base (603)..(616): a, c, t, g, unknown or other
  misc_feature (603)..(616): n is a, c, g, or t
tcagtacacgtgatcacgaccggtgctcgatttagtgctatagacttggggtttgggggctgttcctggaagctgcttgtaccagagggtcaccatctcctgcactgggagcagctccaacatcggggcagggttatgatgtacactggtacaagcagcttccaggaacacgcccccaaactcctcatctatgctaacaccaatcggccctcgacgggtccctgaccgtnttcctcgtggcctccaagtctggccacctcacgccctcccgtggccacttcacgtcgggcctccgggctggacggtatggacggctagtatttacgttaccgtggtcctacggtttccctttagactaacgccacggccttggtaacgtcgttacttacgtcggttccgttaacgggaaccgtacggggtaaaccgtacggttactacccggttacccgttacgggacctccggaaccccgaaccggtacccccaaacccgtcgttccgtacctccgttccgtcccgttccccgcccttcctccaacgtctaccgtcgtacgcggacgggtccggacgtacggaccgaggtccgtacgaattgntgcnnnngnnnnnnnnnnnnnn

SEQ ID NO: 162983 - DNA, 546 bp, Homo sapiens
  misc_feature: GYAE6OF02HTWVR.34.86.H09.1.454.CMB.1.raw
  modified_base (405)..(405): a, c, t, g, unknown or other
  misc_feature (405)..(405): n is a, c, g, or t
  modified_base (531)..(546): a, c, t, g, unknown or other
  misc_feature (531)..(546): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggctaggttttgttgtacactggtaccagcagattcccggaacacgcccccaaactcctcatcttggtaacaacaatccggccctcgacggggtcccctgacccgtattttctcgtcctccaaagtctggcacctcacgcctcccgtggactattattggaactccagcctggaggatgaggctgtaattattactgtacagtacacgatgaaccaaccacccggtggggccggggtcgttacgggcgggaacggggaccaagtactcggtacgtccctnacgtcaacgacccgaacggtctcccgcccccgtacggtcctaaccgttccgtccgttcccccgccccttcctccatccgtacgtcgtaactggacgccgggtcgtcggacaagggtccatacgagnnnnnnnnnnnnnnnn

SEQ ID NO: 162984 - DNA, 527 bp, Homo sapiens
  misc_feature: GYAE6OF02F5OK9.34.86.H09.1.454.CMB.1.raw
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcacgtgggagcagctccaacagtcggggcagattatgatgtgcattggtaccaacagcttccaggaacacggaccccaaactcctcatcncaggtnacaacatcggccctcgacggggtccctggccgattctcgtggcctacaagtctggcctcctcacgtccctccctcggcctagtccacgtcgggcctccgaggctggaggagtggacggctagtatttatctgccttgtcctagtcgaacaagtcgtcctagtacgttgtttacgtcgttacgttacggtacgtcgggtaacccg

SEQ ID NO: 162985 - DNA, 519 bp, Homo sapiens
  misc_feature: GYAE6OF02GTX89.34.86.H09.1.454.CMB.1.raw
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (468)..(468): a, c, t, g, unknown or other
  misc_feature (468)..(468): n is a, c, g, or t
  modified_base (493)..(493): a, c, t, g, unknown or other
  misc_feature (493)..(493): n is a, c, g, or t
  modified_base (498)..(499): a, c, t, g, unknown or other
  misc_feature (498)..(499): n is a, c, g, or t
  modified_base (501)..(501): a, c, t, g, unknown or other
  misc_feature (501)..(501): n is a, c, g, or t
  modified_base (503)..(504): a, c, t, g, unknown or other
  misc_feature (503)..(504): n is a, c, g, or t
  modified_base (506)..(519): a, c, t, g, unknown or other
  misc_feature (506)..(519): n is a, c, g, or t
tcagtacacgtgatcacgaccggtgctcgatttagtgctatagacttgggtttgggggctgttcctggaagctgcttgtaccagagggtcaccatctcctgcactggggagcagctccaacatcggggcaggttatgatgtacactggtacaagcagcttccaggaacacgcccccaaactcctcatctatgctaacaccaatcggccctcacggggtccctgaccgattctctggctccaagtctggcacctcagccctccctggccatcacgtgggctccgggntgaggntggaggctgattattactgtctacgttcctttgacagccagcctggagttgtcttagtcgttcttacgggaacgtgggaacctaaggtccaccgtctaggtccagccccgaaggaccccaacccacgtcgtacctacttccgtccgttccccgccctcctcactctacgtctacgngacggcgggctcggacgaggcgacngtagnngnanngnnnnnnnnnnnnnn

SEQ ID NO: 162986 - DNA, 567 bp, Homo sapiens
  misc_feature: GYAE6OF02G8J2M.34.86.H09.1.454.CMB.1.raw
  modified_base (177)..(177): a, c, t, g, unknown or other
  misc_feature (177)..(177): n is a, c, g, or t
  modified_base (228)..(228): a, c, t, g, unknown or other
  misc_feature (228)..(228): n is a, c, g, or t
  modified_base (344)..(344): a, c, t, g, unknown or other
  misc_feature (344)..(344): n is a, c, g, or t
  modified_base (480)..(480): a, c, t, g, unknown or other
  misc_feature (480)..(480): n is a, c, g, or t
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctgggcccagtctgtgctgacgcagccgccctnagtgtctggggccccagggcaggagggtcaccatctcctgcacgtggggancagctaccaacagtcggggcaggttatgatgtacactggtacaagcagcttccaggaacacgacccccaaactcctcatctatgactaacaccaatccggccctcgacgggtcccngaccgattctctggctacaagtctggcacctcacgcctccctggccatcacgtcgggcctccgggctggaggtatggacgtctagtatttatacttgtactacgttccttagactacgctacgccgttagtacgtntctttaagtcgttaccgttacggaacgttacgggtaaccgtaacggttccgtacccggttccgtacgggtcctaccggtaaccccgg

SEQ ID NO: 162987 - DNA, 659 bp, Homo sapiens
  misc_feature: GYAE6OF02HUZB3.34.86.H09.1.454.CMB.1.raw
  modified_base (230)..(230): a, c, t, g, unknown or other
  misc_feature (230)..(230): n is a, c, g, or t
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
tcagtacacgtgatcacgaccggtgctcgatttagtgctatagacttgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggnagtgacgttgatgattataagtctgtctcctggtaccaacaaccaccccggnaaacgcctacccaaactcatgtatttangattcgtacaattaacgtccggccctagtaggttctttcactatcgtcttctctcgcctctatcgtctggacaaccgccggtcccttccgagtacctatcctcgtcgaccttccgagtcgtaggacgggacgtagggttacgtaatttacgttacgtcggtccgtacccttagtaacttaaccttacgtacctttaccgaccgttccgaccccttacgtccgttacggtagtttcggttacggtttacggttttaccggggaaccgggttaacggaaaccccttaaccgtcccgtaccccggtttccgttaccggtacccgaaccggtaccccggtaacggtcccccgg

SEQ ID NO: 162988 - DNA, 695 bp, Homo sapiens
  misc_feature: GYAE6OF02I4ONE.34.86.H09.1.454.CMB.1.raw
  modified_base (291)..(291): a, c, t, g, unknown or other
  misc_feature (291)..(291): n is a, c, g, or t
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtcgtcgtcggggccccgagggccaggtacgggtccaccgattcctcctcgcacgtcgggacgcacgcctaccaactacggtccggggctaggttangtacttcgtacacggttggtaacagcacgtccttacgaacgggaaccaccggtaaccccctaacttcccgtactactcttaacgtacgtaacctaaaccacctaaccgtcccggtacccgtcggtaccgggtccctacggaccgttactttccgtacgtcgtacctaccggtaacgtcgtacggcctacctaccgtcctacccgtccgtaccggtcctacgtaccgtaccgggtccggggtcccgtttccggggccgtacgggtacgggtacgtacgggtaccggtgttacgttacgtttaacgtcgttacgtacgttaccgtttccgttacgtaaccgtcgacgtaccgtcgttacgtacggttctacgtttagtccgttacggttaccggtagtaacccggg

SEQ ID NO: 162989 - DNA, 527 bp, Homo sapiens
  misc_feature: GYAE6OF02JWWKZ.34.86.H09.1.454.CMB.1.raw
  modified_base (471)..(471): a, c, t, g, unknown or other
  misc_feature (471)..(471): n is a, c, g, or t
  modified_base (499)..(499): a, c, t, g, unknown or other
  misc_feature (499)..(499): n is a, c, g, or t
  modified_base (507)..(527): a, c, t, g, unknown or other
  misc_feature (507)..(527): n is a, c, g, or t
tcagtacacgtgatcacgaccggtgctcgatttagtgctatagacttgggtttgggggctgttcctggaagctgcttgtaccagagggtcaccatctcctgcactggggagcagctccaacatcggggcaggttatgatgtacactggtacaagcagcttccaggaacacgcccccaaactcctcatctatgctaacaccaatccggccctcgaggggtccctgaccgtattctctggctaccaagtctggccacctcacgccctccctggccatcagttcgggcctccgggctgaggatggaggctgtattattacgtgtcagttcctttgacagtcagcctgatgcttatgtctcggaactgggaccaaggtccacgtacctaggtccagacccgaacggccccaaacccctctgtacccacgttccttccgttcccctaccctcctcctaacttccacgttacgtacngggacgtcgggctgggactaacgggccntaacgtgnnnnnnnnnnnnnnnnnnnnn

SEQ ID NO: 162990 - DNA, 487 bp, Homo sapiens
  misc_feature: GYAE6OF02HY7W4.34.86.H09.1.454.CMB.1.raw
  modified_base (390)..(390): a, c, t, g, unknown or other
  misc_feature (390)..(390): n is a, c, g, or t
  modified_base (464)..(464): a, c, t, g, unknown or other
  misc_feature (464)..(464): n is a, c, g, or t
  modified_base (471)..(472): a, c, t, g, unknown or other
  misc_feature (471)..(472): n is a, c, g, or t
  modified_base (474)..(487): a, c, t, g, unknown or other
  misc_feature (474)..(487): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagccccaaactctcatctatgctaacaccaatcggccctcgaggggtccctgaccgattctctggctccaagtctggcacctcagcctccctgtccatcactggctccgggctgagatgagctgattattactgtcagttcctttgacagcagcctgagtgcttatgtcttaggactgggaaccaaggtcaccgtctaggtcacgacccaacggcccaacccntgtcacttctcgttccccgccctcctcactcacgtgtactgacgcgggctgggactaacgggcactagtaacgntcagctnngnnnnnnnnnnnnnn

SEQ ID NO: 162991 - DNA, 961 bp, Homo sapiens
  misc_feature: GYAE6OF02JR2YG.34.86.H09.1.454.CMB.1.raw
tcagtacacgtgatcacgaccggtgctcgatttagtgctatagacttgggtttgggggtggggtcgacgaaggaggcagcactcaggacaatctccagcatggcctggtctcctctcctcctcactctcctcgctcactgcacagggtcctgggcccagtctgtgctgacgcagccgccctcagtcgtcgtcggggccccagggcaggagggtccaccgtagtctccgtgctacgtggggacgcgaacgcctaccaaacgcgtacggggggactagggtttacgtaggacgttagtaaccgtaacggttacgggtaaccgaaacggtcggtaacggtacccgtttaacccgaacggggtaaaaccaccggaaccccccctaaaacttccctaacgtaaccttaccttacgttaccggtacctaaaaccggtaaccccgtaaacgttaccccgggtccccgttaaggtaacccggggggtttacccctaacccgggttaaccggttaaccttttaccgggttccgttaccggggtaccctttaacccggtaaacgtttcccggttacggacccttacccgttacgacccgtcccgttaccccggtcgggtaccccctaaggtttccccgaacgggtttcgggggacccccgttcggggggtaccctttacggggaaacgggttaaccgttccggggaaaccggggtttcgttaaacgggttaaacttttaccgggttaaacccggttcggtttaaccgttaaccgggttttaccctttaaccgggaacgttaaaccggtcccggtaaaggttttcccccgagggtttaaccgggtcccgtttaagtttacggtttaccgggtttaccggttaaaccgggtttaacccgggaacggggtaccctaaacgggtttccccacccggggtttaacccggttaggtacccggtaacctaaccccggg

SEQ ID NO: 162992 - DNA, 462 bp, Homo sapiens
  misc_feature: GYAE6OF02IH154.34.86.H09.1.454.CMB.1.raw
  modified_base (194)..(194): a, c, t, g, unknown or other
  misc_feature (194)..(194): n is a, c, g, or t
  modified_base (226)..(226): a, c, t, g, unknown or other
  misc_feature (226)..(226): n is a, c, g, or t
  modified_base (266)..(266): a, c, t, g, unknown or other
  misc_feature (266)..(266): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (324)..(324): a, c, t, g, unknown or other
  misc_feature (324)..(324): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (445)..(462): a, c, t, g, unknown or other
  misc_feature (445)..(462): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggacaagcagcttccaggaacagcccccaaatcctcatctatgctaacnccaatcggcctcgagggtccctgaccgattcnctggactccaagtctggcacctcagcctcctaggccatcnctgggctccgggatgaggatgagctgattatacngtnagtccttgaactgcaggtccngtatgcttatgtcttaccggaatgggacaggtcacgctagcagcccaagccaacccntcgnactctgtcccgctcgnaatcaatgtacngagtcggcctaggacaacggtcacatncgnannnnnnnnnnnnnnnnnn

SEQ ID NO: 162993 - DNA, 505 bp, Homo sapiens
  misc_feature: GYAE6OF02IPF85.34.86.H09.1.454.CMB.1.raw
  modified_base (458)..(458): a, c, t, g, unknown or other
  misc_feature (458)..(458): n is a, c, g, or t
  modified_base (462)..(462): a, c, t, g, unknown or other
  misc_feature (462)..(462): n is a, c, g, or t
  modified_base (482)..(482): a, c, t, g, unknown or other
  misc_feature (482)..(482): n is a, c, g, or t
  modified_base (489)..(505): a, c, t, g, unknown or other
  misc_feature (489)..(505): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatccggccctcgacggggtccctgaccgattctctggctccaagtctggcacctcacgccctcccgtggcccatccactgggcctccgggctgaggatggaggctgatttatactgtcagttcctttgactgcagcctgagtgcttatcgtcttcggaacgtcgggacctaaggtccaccgtccgtaggtcacgacccgaacggccccaaaccccacgtcgtccaccttcctccgttccccaccctcctcactcacgtntacngacgcggcgtcggacaggcncatacgnnnnnnnnnnnnnnnnn

SEQ ID NO: 162994 - DNA, 482 bp, Homo sapiens
  misc_feature: GYAE6OF02GLP9Q.34.86.H09.1.454.CMB.1.raw
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (394)..(394): a, c, t, g, unknown or other
  misc_feature (394)..(394): n is a, c, g, or t
  modified_base (467)..(482): a, c, t, g, unknown or other
  misc_feature (467)..(482): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcagggtcccctgaccgattctctggctccaagtctggcacctcagcctccctggccatcacgtgggcctccgggntgaggntggaggctgattattactgtctagttcctttgacagcacgcctgagtgcttatgtcttcgaactggaccaaggtcaccgtctaggtcacgcccaagcccaacccntcgtcactcctcgttccccgccctcctcactcacgttgtactggagccgggctggacgaaggcgactagtagnnnnnnnnnnnnnnnn

SEQ ID NO: 162995 - DNA, 661 bp, Homo sapiens
  misc_feature: GYAE6OF02HIFRL.34.86.H09.1.454.CMB.1.raw
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacagggtcctgggcccagtctgtgctgacgcagccgcctcagtgtcgtcggggccccagggcaggacgggtcaccatcctcctgccacgtgggagcacgctccgaacacgtcggggctaggttatgacgtgtacacgtacggtaacaaggcacgtccttaccgaacggaaccaccgacccccaaacttcctactactactactacgtacctaaaccacctaacgtcccggaccctacggtaccggggtccctacggacccgtactttcctcgtacggtcccttaccgtaacggtccgtcggaccctacccgtccgaccggtcccctacccgtcggaccctacgttaccgtaccggtccgggtcccgtccggggtcgtagggaacggtagtcgggtacggtacgttgttaacgtttacgtttacgttcgtacgttacgtttccgttagacgtcgtccgtacgtcgttgtacggttcgtctttagtcggtttacgtacggtacggtacggg

SEQ ID NO: 162996 - DNA, 546 bp, Homo sapiens
  misc_feature: GYAE6OF02G3M36.34.86.H09.1.454.CMB.1.raw
  modified_base (528)..(528): a, c, t, g, unknown or other
  misc_feature (528)..(528): n is a, c, g, or t
  modified_base (530)..(546): a, c, t, g, unknown or other
  misc_feature (530)..(546): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacacgcccccaaactcctcatctatgctaacaccaatcggccctcgacggggtccctgaccgtattcctctcggcctaccaagtctggccacctcacgccctcccgtggccatcacgtgggcctccgggctgaggatggaggctgtatttattactgtactagttcctttagacagcgagtcctgagtgtcttagtgtcgttacggaacgtcgggaaccaaggtccaccgttccgtaggtccacggtacccgaacgacccctaaccccacgttcgtcctaccttcgtccgttaccccacccttcctactaactcgtacgtcgtacgtgacggcggtctacggccaaggccgactagtagcagncnnnnnnnnnnnnnnnnn

SEQ ID NO: 162997 - DNA, 656 bp, Homo sapiens
  misc_feature: GYAE6OF02IZ344.34.86.H09.1.454.CMB.1.raw
  modified_base (623)..(623): a, c, t, g, unknown or other
  misc_feature (623)..(623): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (647)..(647): a, c, t, g, unknown or other
  misc_feature (647)..(647): n is a, c, g, or t
  modified_base (649)..(649): a, c, t, g, unknown or other
  misc_feature (649)..(649): n is a, c, g, or t
  modified_base (651)..(651): a, c, t, g, unknown or other
  misc_feature (651)..(651): n is a, c, g, or t
  modified_base (653)..(655): a, c, t, g, unknown or other
  misc_feature (653)..(655): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacacgcccccaaactcctcactctatgactaacaccaactccggccctacacggggtcctgaccgattctctcggctaccaagtctggccacctcacgccctcctggccatcacgtggcctccgggctggaggatgaggtctgtacttattacgtcgtactacgttccgtttgacctagccgtaagtcccttaggaacgttgtaccttaagtttcggttccttaccgggtaaacggtaccgggtaacgaaacggtttccgaacccgttaccgtaacgggttcccaacgaccccgaaaccgggacccccaaaacccctacgtaccgtacccgtaccttccgttcccggtttacccccgtcccctaccctctaacgttaccctacggttaccgttaccgtcggaacggtccggggtaccgttacgggaccggtaaccggaccgtaccgtaagttaacggnacgacngnctcgcacntnacagcncnancnnnc

SEQ ID NO: 162998 - DNA, 512 bp, Homo sapiens
  misc_feature: GYAE6OF02FH1JN.34.86.H09.1.454.CMB.1.raw
  modified_base (402)..(402): a, c, t, g, unknown or other
  misc_feature (402)..(402): n is a, c, g, or t
  modified_base (445)..(445): a, c, t, g, unknown or other
  misc_feature (445)..(445): n is a, c, g, or t
  modified_base (491)..(492): a, c, t, g, unknown or other
  misc_feature (491)..(492): n is a, c, g, or t
  modified_base (494)..(497): a, c, t, g, unknown or other
  misc_feature (494)..(497): n is a, c, g, or t
  modified_base (499)..(512): a, c, t, g, unknown or other
  misc_feature (499)..(512): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaaacaccaatcggccctcaggggtcccctgaccgtattctctggctccaagtctggccacctcagccctccgtggccatcacgtgggctccgggctgaggatgaggctgatttattactgtcagttcctttgacagcagcctgatgcttatgtcttcggaactgggacaaggtcaccgtcctaggtccaagccccaacggcccaaccccntcgtccactcctcgttccccgccctcctccacttccacggttntacgtcgagtccgggcttgggaccgaacggccgtacgtagtacganncnnnngnnnnnnnnnnnnnn

SEQ ID NO: 162999 - DNA, 786 bp, Homo sapiens
  misc_feature: GYAE6OF02G657G.34.86.H09.1.454.CMB.1.raw
  modified_base (181)..(181): a, c, t, g, unknown or other
  misc_feature (181)..(181): n is a, c, g, or t
  modified_base (253)..(253): a, c, t, g, unknown or other
  misc_feature (253)..(253): n is a, c, g, or t
tcagtacacgtgatcacgaccggtgctcgatttagtgctatagacttggtttgggaggctctgcttcagctgtggcacaagaggcagcactcaggacaatctccagcatggcctggtctcctctcctcctcactctcctcgctcactgcacgaggtcctcggcccagtctgtcgctgaccncacgccgccctcgagtcgtccggtcgggccgaggcgacggacggtccaccgtctccgtcgcgacgtggcganccgtaccgtccgtaaccgacggtacgggtacggtagttaacgttgtacgtacgtacgtacgtacggttacgtaacgacgacgttaccgtacccgaccgaacccgtaacccgtaccctaacccgttactactactacctacgtaacctaccgtaacctaccgtaccggtcccggttacccggtaccggtaccggttaccgtaccgttaccgttaccgtaccgttaccggtccgtacccgttaaccgtacggtcccggttaaccgcccgttaccctcccgtacccgttaccccggtccgttaacccgtacccggttgtaaccccgggtgggttacccggtcgggtcccggttacggaccgggtaacggttacggttaccggtacggtttacgttactttacccggtttactttaacggtcccgttagttaacccgtccgttaccgagggtcccgaggttcccgttacggtaacgttcgttacggttacgttacggtacccgggtttagacccggggttactacccggtaacccgg

SEQ ID NO: 163000 - DNA, 403 bp, Homo sapiens
  misc_feature: GYAE6OF02HBWGT.34.86.H09.1.454.CMB.1.raw
  modified_base (392)..(392): a, c, t, g, unknown or other
  misc_feature (392)..(392): n is a, c, g, or t
  modified_base (397)..(403): a, c, t, g, unknown or other
  misc_feature (397)..(403): n is a, c, g, or t
tcagtacacgtgatcacgaccggtgctcgatttagtgctatagacttgggtttgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctccctggccatcactgggctccgggctgaggatgaggctgattattactgtcagtcctttgacagcagcctgagtgcttatgtcttcggaactgggaccaggtcaccgtctaggtcagcccaaggccaacccatgtcactctcgttccccacctcctcatccacgtgtactgagcgggctggcaaggcncatgnnnnnnn

SEQ ID NO: 163001 - DNA, 551 bp, Homo sapiens
  misc_feature: GYAE6OF02GLRDW.34.86.H09.1.454.CMB.1.raw
  modified_base (253)..(253): a, c, t, g, unknown or other
  misc_feature (253)..(253): n is a, c, g, or t
  modified_base (276)..(276): a, c, t, g, unknown or other
  misc_feature (276)..(276): n is a, c, g, or t
  modified_base (301)..(301): a, c, t, g, unknown or other
  misc_feature (301)..(301): n is a, c, g, or t
  modified_base (366)..(366): a, c, t, g, unknown or other
  misc_feature (366)..(366): n is a, c, g, or t
  modified_base (449)..(449): a, c, t, g, unknown or other
  misc_feature (449)..(449): n is a, c, g, or t
  modified_base (507)..(507): a, c, t, g, unknown or other
  misc_feature (507)..(507): n is a, c, g, or t
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcacatctcctgcacgtgggagcagctaccaaangtcggggcaggttatgatgtacncgtggtacagcagcttacaggaacncgacccccaatcctagatctatcgactaaacacaactccggccctaaggcgggtcccagtaccgnttcctacgtcggcctaccgtaagtcgtcggcctaaccctcaccgtcccttccgacggcctaatccgacgttcgggctccgggntggacggtatcggaagtccgtagtacgttattacgtcgtacacgtttctgacgtcgcncgcttagcgtcgttaccttatccggtcgttacggacgttacggg

SEQ ID NO: 163002 - DNA, 534 bp, Homo sapiens
  misc_feature: GYAE6OF02F62ME.34.86.H09.1.454.CMB.1.raw
  modified_base (516)..(534): a, c, t, g, unknown or other
  misc_feature (516)..(534): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggccacctcacgccctccctggccatcactgggcctccgggctggaggatggaggctgatttattactgtcagttcctttgacagcagcctgacgtgtacttagtgttcgttacggaacgtcggggaccaagggtccacccggttccgtaggtccaacggaccccgaacggcccccaaacccctactcggtaccaccttccgtccgtttcccccgccctccctctactccgtacgttcgtactggacggcggtcgtggcgaacggcacatagnnnnnnnnnnnnnnnnnnn

SEQ ID NO: 163003 - DNA, 637 bp, Homo sapiens
  misc_feature: GYAE6OF02H9DBR.34.86.H09.1.454.CMB.1.raw
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcagccgcctcagtgtcgcgggcccagggcagaggtcaccatctctgcacgtgggagcacgctaccaacaggtcggggcaggttatagatgtacacgtggtacagcagccttcaacggacacgaccccaaactccactactctatagacctaacacctaagtccgccgtaccgacggggtccctagacccgtacttcgtccgtacgggtcctacgtacgtcgtccggtccaaccgtctccgtacctcccgtgcccgacttaccgacggtcgggaccgttccggggacttcgggaaggtactcgggtaacgggtccttaacgtaactttacgtttaccgtacgtacgtaccgttttacccgttagaccacggtcgacggtttacccgtagttacggttacgttaccgttaggttaccggtttaccggttaaccgggtaacggtaccgggtaaccgttaacgg

SEQ ID NO: 163004 - DNA, 643 bp, Homo sapiens
  misc_feature: GYAE6OF02IGEH7.34.86.H09.1.454.CMB.1.raw
  modified_base (598)..(598): a, c, t, g, unknown or other
  misc_feature (598)..(598): n is a, c, g, or t
  modified_base (611)..(611): a, c, t, g, unknown or other
  misc_feature (611)..(611): n is a, c, g, or t
tcagtacacgtgatcacgaccggtgctcgatttagtgctatagacttgggtttgggggctgttcctggaagctgcttgtaccagagggtcaccatctcctgcactgggagcagctccaacagtcggggcaggttatgatgtacactggtacaagcagcttccaggaacacgcccccaaactcctcatctatgactaacaccaatccggccctcgacggggtccctgaccgtattcctctcggcctccaagttcgtggccaccgtcacgtcctcccgtggccatcacgtggcctcggctggaggataggagtctagtattacttacgtcgtcgacgttcccgtttagactaggctacgtcgtaggacgtctcgttatcgttaccgtacggtaacgtacggggaaccctaggtacctacccggttcgtacggtaccgaccgacccgaacggtccccaaaccctacgtcgtacctacgttcccgttacccgtccccctaccgtccctacgtaaccgttcgacgttccgtacgtacgggtaccggtccgggtacgtacgggacccgaacggggtacctacgtaacgttacggatcgacgtgngacgtcgcgtacncgtacgtacgcgtcgcgtcgacgcgtctctcg

SEQ ID NO: 163005 - DNA, 569 bp, Homo sapiens
  misc_feature: GYAE6OF02JW2DG.34.86.H09.1.454.CMB.1.raw
  modified_base (284)..(284): a, c, t, g, unknown or other
  misc_feature (284)..(284): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (554)..(569): a, c, t, g, unknown or other
  misc_feature (554)..(569): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtcccctgaccgattctctggctccaagtctggcacctcacgcctccctggccatcactgggcctccgggntggaggatgaggctgattattactgtcagtcctttgacagcagcctgagtgcttagtgtcctttacgggaacgttcgggaaccgtaaaggttccaaccccggttccgtaagggttccaacggacccccgaaagggccccctaaacccccgactttcggtaccctaccgttaccttgtttccctaccctaacccccttcctccaacttccgacgttcgtactcggacggtccgggacgttgggaccctaaggggcccagaagtacgngncnnnnnnnnnnnnnnnn

SEQ ID NO: 163006 - DNA, 836 bp, Homo sapiens
  misc_feature: GYAE6OF02J2FU9.34.86.H09.1.454.CMB.1.raw
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctcgggcccagtctgtgctgacgcagccgccctcagtgtcgtcggggccccagggcaggacgggtcacctatcctcctgcctacgtggggacncacggcctaccaacncggtccggggctaggttatcggatcgtacgtacgtaggtaaccaagcgacgtccttaccgacgggaaccaccgaccccctaaacgttcccacgtacttacctaacgtcgtaaccgtaaaccctaacccgtaaccgttacccggtacccccgttacgggaccgggttacccctacggtaacccgttacttttccgtcccggtacggtacccttacccgtaaacggttccggtaccggcccttaaccgtaccgtacccggtccccgtttccgtaccggtaccccgtaacgtcccgaaccggttcggggtaccggttccgggtagtaccgggtacggtaacggtcgggtacgtaccgttaacgggtttaactttaccgttttaccgacgggtttaaccttccgggttttaccccgttaaggtacccggtaacgttcccggtaaccggtcccgtaggttaaccggttcggttacgttttaacccggtcggtttaaccggttaccgggtaaccgggttaccgggtaaccgttccgggtaacccggttacccgttaccgggtaccggtaccgtacccgtaaacccccggg

SEQ ID NO: 163007 - DNA, 752 bp, Homo sapiens
  misc_feature: GYAE6OF02G9CP4.34.86.H09.1.454.CMB.1.raw
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcagcccgccctcagtcgtcgtcggggccccagggcaggacgggtccacctatcctcctgctacgtggggacgcaggcctaccgaacgtacggtccgggggactaagggttatggtacttcggtaacgtaacgttgggtaaacaaggcctacgtccgttaccgaacggaaccaccggaaccccctaaactcctacactctaactacgaacctaaccaaccaacgtcccggtccctacggaccggggtccctacgacccgtattccgtcgtacggtacctacgtaacggtcgtaccggaccctacctaccgtaccgtccctacccgtacggaccctacgtcccgttacggtccggggtacccggtcccgggtacgttacggacgggtaactcggggtacggtcgttacggttaacgtttacgttaccgttggttaccgttaccggtttaccgtttaccggacgtaccggtaccgtacggtaccgttcgggttaccggttacggtttacgtttaccggttccggtttaacccgggttaccgggtaaccggttaccggggtaaacccgttaacccgggg

SEQ ID NO: 163008 - DNA, 726 bp, Homo sapiens
  misc_feature: GYAE6OF02F85JF.34.86.H09.1.454.CMB.1.raw
  modified_base (189)..(189): a, c, t, g, unknown or other
  misc_feature (189)..(189): n is a, c, g, or t
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacgagggtcctgggcccagtctgtgctgacgcagccgccctnagtgtcgtcggggccccagggcaggagggtccaccatcctcctgaccacgtgggagcagcctaccaacncgtcgggcaggttangattcgtacacgttggtaacagcgacgtccttaccgaaggtaaaccaccgacccccctaaaacgtccctacacttctactcgaacctaaaccaacccgaacttccccgggtaccccgtaccggtaaccgggggttcccctacgggtaacccgtacgttttccgttaccgtacgggtcccttaccgaaacgttccgtacgggtaccctacccgtccgaacccggtccccgttaccccgtcggtaccctaaccgttaccgtaccggtcccggggttccggtcccgggtcgtacgggtaaggtcggtacgggaccggttacgttagttaacttttacgttacgttcggtacgttacgttccttacggacgtacgtaccgtacggtccgttaggtcgttacgttagtttacgtcggttccggttaacgggtaccgttaccgggtacctaacccgggg

SEQ ID NO: 163009 - DNA, 540 bp, Homo sapiens
  misc_feature: GYAE6OF02IJLO4.34.86.H09.1.454.CMB.1.raw
  modified_base (393)..(393): a, c, t, g, unknown or other
  misc_feature (393)..(393): n is a, c, g, or t
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccagggcagagggtccaccatcctctgcactgggagcagctccaacagtcggggcaggttatgatgtacacgtggtacaagcagcttcaggaacacgaccccaaactcctacactctatcgactaaacaccaagtccgaccctacgtacggggtccctgaccgtattctcgtgctccaagtctgcnctcacgcctcctggcctatcacgtcggccgtccgggctggacgagtcggacgtctgatttactactcgtctacgttccttagaccgtagaccacggtcctaggtacgttcgtacgtttagtcggttacgttccggtaacgtaccggg

SEQ ID NO: 163010 - DNA, 696 bp, Homo sapiens
  misc_feature: GYAE6OF02F7HW3.34.86.H09.1.454.CMB.1.raw
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacagggtcctgggcccagtctgtgctgacgcagccgcctcagtcgtcgtcggggccccagggcagacgggtcaccatctcctgcacgtggancagcctacaacgngtcggggcaggttatgatgtacactggtacaagcagcttaccgacgaacacgacccccaaatcctacactctagtcgacctaaaccaccgtaacgtcccggtcctacgtaccggggtccctacggaccgtacgtttccgtacgtcggtacctaccgtaaacgttccggtacggtaccctacccgtacgtaccgtccccgttccccgtacgggtaccctaacgtacccgtaccggtaccggggtccgtacccggggtccgtacgggtaacgggtacggttaccgggaacggttaccggttacgttaacgttttaaacgttacggttacggttaccgttaccgtttacccgtttaggtaacccgtaacgtaccgtacgtacccgttagtaccgttacgtacgtttacgtacggttaccgttaccggtaaccgtacccgggg

SEQ ID NO: 163011 - DNA, 744 bp, Homo sapiens
  misc_feature: GYAE6OF02F7H8O.34.86.H09.1.454.CMB.1.raw
tcagtacacgtgatcacgaccggtgctcgatttagtgctatagactttggggtttggggctgcttcagctgtgggcacaagaggcagcactcaggacaatctccagcatggcctggtctcctctcctcctcactctcctcgtctcactgctacgagggtcctgggcccagtctgtgctgacgcagcccgccctcgagttgtctcgggggccccaggggcacggagggtccaccatcctcctgccacgtgggagcagctccaactagtccggggctaggttatgagtcgtacacgtaggtacaagcaggccttaccgaggaaccacgtacccccaaacttcctactaacgtctaatcgaccttaaaccaccgtaaactcccggaccctcggaacggggttccctacggtaaccccgtatttccgtaccgtccgggtcccttaaccgtaacggttccgtaccgggtaccctaacccgttaccggaaccgttccccgtcccgttacgggacccctaacgttccgtaaccgtccggggtccgtacccggggcttaggaacgggtacgtcgggtaacggttcgtaagtacgttttacgttaccgttagtaccgttacgttcctttacggacgtaacggtaccggtaaccggtccggttagggtaccggttacggttcggtttttacggttaccggttttacccggtttaaccgggaaccggtttacggggtaaccccgttaaaccgggg

SEQ ID NO: 163012 - DNA, 723 bp, Homo sapiens
  misc_feature: GYAE6OF02JXLS6.34.86.H09.1.454.CMB.1.raw
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacgagggtcctcgggccctagtctgtgctgacgcacgcccgccctcgagtcgtcgtcggggccccgagggccaggtacgggtccaaccacttcctccgtgaccgtacgtacgggacgcacgcctaccaaactacggtacggggctaagggtttaacgtaggtaacgttacgtaacgtacggtacggtaacggaacgaccgtacgtccgttaaccgaacggaaaccgaccccgaaccccctaaaaccgtcctacctacttaccgaactccgtaacctaaaccgaaccgtagtcccggtacccgtcgggtaccggttcccgtacgacccgttacttcccgtcgtaccggtactacccgtaacgtcggttaccaccgtacctacgtacccgtccgtccggtacgtaccactaccgtacggtcgggtccgtaccgggtcgagggtcgtaacggcgtacggtacttgtaactttcgtcgttacggtacttccgttactaccgtcgagtaccgacggtactaggtacttcggttagtttacgtacgttccggttaacggtacggttacggacccgttaccgg

SEQ ID NO: 163013 - DNA, 623 bp, Homo sapiens
  misc_feature: GYAE6OF02GBNI0.34.86.H09.1.454.CMB.1.raw
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctgggcccagtctgtgctgacgcagccgccctcagtgtctggggccccagggcaggagggtcaccatctcctgcacgtgggagcagcctccaacagtcgggggcaggttatgatgtacacgtggtacaagcagcttaccgaaggaacacgcccccaaactcctacactctatcgactaaacaccaatccggccctacgacgggtccctacgaccgtattccgtctcggtcctaccaagttcctaggccctacctcgaccgtccctcccgtcgtccactctacgtcgggtccgtccgggcgtggaggtagtggaaaacggtctagtactttacttacgtcgtacgtacgttccgtttacgtacgtacgcgacgtccgtagtaggtacgtcgttagttcgttaccggttacggtaaccggttacggtaaccggtacggtacccgtacccggttaccgtacggtaccgtaccgtaaccccgg

SEQ ID NO: 163014 - DNA, 714 bp, Homo sapiens
  misc_feature: GYAE6OF02H2FLG.34.86.H09.1.454.CMB.1.raw
  modified_base (177)..(177): a, c, t, g, unknown or other
  misc_feature (177)..(177): n is a, c, g, or t
  modified_base (306)..(306): a, c, t, g, unknown or other
  misc_feature (306)..(306): n is a, c, g, or t
  modified_base (467)..(467): a, c, t, g, unknown or other
  misc_feature (467)..(467): n is a, c, g, or t
tcagtacacgtgatcacgaccggtgctcgatttagtgctatagacttgggtttggggaggctctgcttcagctgtgggcacaagaggcagcacgtcaggacaatctccagcatggcctggtctctctcctcctcactctcctcgctcactgcacaggtcctgggcccagtctgtcgngtacgacgcacgccgaccctcagtgtccgacggggccccagggtcaggagggtccaccgatccgtcgtgccgaacgtgggtaacggcacgtctacccgaacgtacggtacgggggcctaaggtttacgngtaactcggttaaccacggttaggaaaccgaaagtccgaagtcccggttaccgaacggaaaccaccgtaacccccaaaaccttcccgtagtaacctattaccgacggttaccaaaaccaaccgttaacgtcccggtaaccctccggtacggggttaacccncggggtaacctacttccgtaccgtacggctaccgaacgtccgttagaccgtaaccgttcgaccgtcccgtcgacgtcccaacgtttcgaccgtcggtcgtcccggtatcgggaacgagtcgaacggtcgtagttaacgtacgttcgacgttcgtaccgttaccgttagtaccggagtacccgtatacgggttaactggttacctacgtttacggtttacgtttccggtaccgggtacttaacggggg

SEQ ID NO: 163015 - DNA, 487 bp, Homo sapiens
  misc_feature: GYAE6OF02HDD43.34.86.H09.1.454.CMB.1.raw
  modified_base (421)..(421): a, c, t, g, unknown or other
  misc_feature (421)..(421): n is a, c, g, or t
  modified_base (432)..(432): a, c, t, g, unknown or other
  misc_feature (432)..(432): n is a, c, g, or t
  modified_base (461)..(461): a, c, t, g, unknown or other
  misc_feature (461)..(461): n is a, c, g, or t
  modified_base (468)..(487): a, c, t, g, unknown or other
  misc_feature (468)..(487): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcaggggtccctgaccgattctctggctccaagtctggcacctcagcctcctggccatcactggctccgggctgaggatgaggctgattatactgtcagttcctttgactagcagcctgagtgcttatgtcttacggaacgtgggaccaaggtccaccgtcaggtcagcccaaggcccaaccccactcgcctactcctcgttccccgccctccnctctccacgtntactgacggcgggactcgggacacgggcncagtagnnnnnnnnnnnnnnnnnnnn

SEQ ID NO: 163016 - DNA, 637 bp, Homo sapiens
  misc_feature: GYAE6OF02HUBE4.34.86.H09.1.454.CMB.1.raw
  modified_base (189)..(189): a, c, t, g, unknown or other
  misc_feature (189)..(189): n is a, c, g, or t
  modified_base (271)..(271): a, c, t, g, unknown or other
  misc_feature (271)..(271): n is a, c, g, or t
  modified_base (434)..(434): a, c, t, g, unknown or other
  misc_feature (434)..(434): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcacgccgccctnagtgtccgtcggggccccagggccaggagggtccaccatcctcctgcacgtgggagcagctaccaacagtcgggctaggttntgatgtacacgtggtaacgagcacgcttccgaacggaaccacgacccccaaactccctactactctatgactaaccacaacgtccggcctacgacgggtcctcgaccgtacttcgcgtcggcctaccgaagttccgtacggccacctccgacgtcccttccgnggccctacgtccgacgttcgggccgttccgggcgtggacgggtacgtcggtacggtcgtaacgttaacttttacgttacctttcggttacaaccggttttccgttggtacctacggaccggtacggtcccgttagggacgttcgttacgttacgttcggtttaccggttaaccgggaacgttacggggaacccgttaaccggg

SEQ ID NO: 163017 - DNA, 570 bp, Homo sapiens
  misc_feature: GYAE6OF02FVIJ3.34.86.H09.1.454.CMB.1.raw
  modified_base (297)..(297): a, c, t, g, unknown or other
  misc_feature (297)..(297): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (551)..(555): a, c, t, g, unknown or other
  misc_feature (551)..(555): n is a, c, g, or t
  modified_base (557)..(570): a, c, t, g, unknown or other
  misc_feature (557)..(570): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatcggccctcacggggtccctgaccgattctctggctccaagtctggccacctcacgccctccctggcccatccacgtgggcctccgggctggacggntggaggctgatttattactgtcagtcacatgaacaacctacccgtggggtccgggtcgttcgggcggggtaacggaccaaggtcgtacggacccgttccctacgacgtccgacggacccaaggtcctcccggccccccgttcggtcctaaccttccgttccgtttacccccaccccttccctacaccgttaccgaccggttcttaccgtcgggacggtcccgggtagtcggaccgaggccgacagtgntngacnnnnngnnnnnnnnnnnnnn

SEQ ID NO: 163018 - DNA, 673 bp, Homo sapiens
  misc_feature: GYAE6OF02I2HWP.34.86.H09.1.454.CMB.1.raw
  modified_base (207)..(207): a, c, t, g, unknown or other
  misc_feature (207)..(207): n is a, c, g, or t
  modified_base (633)..(633): a, c, t, g, unknown or other
  misc_feature (633)..(633): n is a, c, g, or t
  modified_base (636)..(636): a, c, t, g, unknown or other
  misc_feature (636)..(636): n is a, c, g, or t
  modified_base (639)..(639): a, c, t, g, unknown or other
  misc_feature (639)..(639): n is a, c, g, or t
  modified_base (643)..(643): a, c, t, g, unknown or other
  misc_feature (643)..(643): n is a, c, g, or t
  modified_base (649)..(649): a, c, t, g, unknown or other
  misc_feature (649)..(649): n is a, c, g, or t
  modified_base (652)..(652): a, c, t, g, unknown or other
  misc_feature (652)..(652): n is a, c, g, or t
  modified_base (657)..(657): a, c, t, g, unknown or other
  misc_feature (657)..(657): n is a, c, g, or t
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
  modified_base (669)..(669): a, c, t, g, unknown or other
  misc_feature (669)..(669): n is a, c, g, or t
  modified_base (672)..(673): a, c, t, g, unknown or other
  misc_feature (672)..(673): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaaccagcccccaaatcctcatctatgctacaccatcggccctnacggggtccctgaccgatttctgtcgcctccaacggtctggccacctcacgtccctccgtggcccattcgacgtcgggctcccgggcttggacggatggaggcgttgtatttacttcgtcgtctacggttccttttgacgtaagctaacggcctggtactcgtcgtttacgttcggttaccgtttaccgggaacgttacggggtaaccctaagggttaacccgtacccggtttaccgttacgggttcccaaacggtaccccgaaaccggcccccgaaaacccccgtcttaccggttaacctccttccgtttccgttacccccgtcccctttacccgtactaccgttaccgttaaccggtacgttaaacccgttggaacgggtccgggacgtccggaaccgtaacgggacgtaccgagttaaccggntcncgntcgngcgtcncgngcgcncgtcncncngcngtnn

SEQ ID NO: 163019 - DNA, 838 bp, Homo sapiens
  misc_feature: GYAE6OF02HDG4Y.34.86.H09.1.454.CMB.1.raw
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggccaggacgggtcaccatctcctgcacgtgggagcagctaccaacagtcggggcaggttatgatcgtacacgtggtaacagcagtctaccgaaggtaaccaccgtaaccccccaaacttcccgtactaacgttcttaacgtacgacccttaaaccaacccgaaacttccccgggtacccctacccgggtacgggggttacccctacgggtaacccgtactttccggtccgttaccgggtccctacccggtaaacgttcccgtacgggtaccctaaccccgttaccgaacccggtccccttccccgggtaccgtaccccgtaaccgttcccggtaaccggttccgggggtaccccggttaccccgggggtaccgttacgggggaccgggtaacgttacgggggaaccgggtttccgttaagggttaaccgtttttaacggtttaaccggtttacccggtttaaccggttaacgggttttaccccgttttacggacccgtaggtacccggtaacggttacccggttaacggttaccgggtttacggttaaccgtttttaccggttaccgggtttacccgggtttaacccgggtaaacccgggtttaccggggtaaacccggttaacccgggg

SEQ ID NO: 163020 - DNA, 575 bp, Homo sapiens
  misc_feature: GYAE6OF02FQ4O5.34.86.H09.1.454.CMB.1.raw
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (446)..(446): a, c, t, g, unknown or other
  misc_feature (446)..(446): n is a, c, g, or t
  modified_base (542)..(542): a, c, t, g, unknown or other
  misc_feature (542)..(542): n is a, c, g, or t
  modified_base (549)..(550): a, c, t, g, unknown or other
  misc_feature (549)..(550): n is a, c, g, or t
  modified_base (552)..(552): a, c, t, g, unknown or other
  misc_feature (552)..(552): n is a, c, g, or t
  modified_base (555)..(555): a, c, t, g, unknown or other
  misc_feature (555)..(555): n is a, c, g, or t
  modified_base (558)..(559): a, c, t, g, unknown or other
  misc_feature (558)..(559): n is a, c, g, or t
  modified_base (563)..(575): a, c, t, g, unknown or other
  misc_feature (563)..(575): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatggatgtacactggtacaagcagcttccaggaacagcccccaaactcctcatctatgactaacaccaatccggccctcgacggggtccctcgaccgtattctcgtggcctccaagtctggccacctcacgcctcccgtgccatcacgtgggccgtccgggctggacggatggaggcgttagtatttacttactgtctagttccttgaccngcncgcctgagttgcttatcgtcgttacggaacgtgggtaacccgtaaggtcccgacccgttcgtacgtccgaacgaccccgaaggaccccctaaaccccgngtccgtaccacccgttaccttcccggttcccccgacccctccttacctacgtcctacgttagtaccgtggacggccgggactaggcgaacgtccgntaacgtnntnctncgnngtcnnnnnnnnnnnnn

SEQ ID NO: 163021 - DNA, 708 bp, Homo sapiens
  misc_feature: GYAE6OF02HBRG8.34.86.H09.1.454.CMB.1.raw
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacgagggtcctggcccagtctgtgctgacgcacgccgcctcagtgtcgtcggggccccagggcaggacgggtcaccatcctcctcgccacgtgggagccaggtcctaccaacgaggtccggggtacgtagggtttatgattaggtacgtacgtaggtaacgaagcgacgccttaccgaggtaaccaccgtacccctaaactcctacctatacgtatacgaacctaaacaccgaacgtcccggaccgtaccggtacggggttccctacggtaccgtacgtttcctcgtaccggtccgtacccgtaacgtttccgacggtcctaccgtccgtaccgtccccgttacccgtccggacccttacgtacccgtaccggttccggggtcccgtccggggtccgtaagggtaacggtacgtcgggtacgtacgttacgttaacgttacgtttacttacggtacgttaccgtttacgtttacggacgtacggtccgtaccgtaccgttcggtacgttcggttacgtttacgttcggttaccggttaccggtacggttaaccggg

SEQ ID NO: 163022 - DNA, 609 bp, Homo sapiens
  misc_feature: GYAE6OF02GOHXY.34.86.H09.1.454.CMB.1.raw
  modified_base (145)..(145): a, c, t, g, unknown or other
  misc_feature (145)..(145): n is a, c, g, or t
  modified_base (336)..(336): a, c, t, g, unknown or other
  misc_feature (336)..(336): n is a, c, g, or t
  modified_base (508)..(508): a, c, t, g, unknown or other
  misc_feature (508)..(508): n is a, c, g, or t
  modified_base (568)..(568): a, c, t, g, unknown or other
  misc_feature (568)..(568): n is a, c, g, or t
  modified_base (581)..(581): a, c, t, g, unknown or other
  misc_feature (581)..(581): n is a, c, g, or t
  modified_base (591)..(591): a, c, t, g, unknown or other
  misc_feature (591)..(591): n is a, c, g, or t
  modified_base (598)..(598): a, c, t, g, unknown or other
  misc_feature (598)..(598): n is a, c, g, or t
  modified_base (604)..(604): a, c, t, g, unknown or other
  misc_feature (604)..(604): n is a, c, g, or t
tcagtacacgtgatcacgaccggtgctcgatttagtgctatagacttgggtttgggggctgttcctggaagctgcttgtaccagagggtcaccatctcctgcacgtgggagcagctccaacagtcggggcaggttatgatgtacnctggtacaagcagccttccaaggaaccacgacccccaaactcctcatctatgactaacaccaacgtccggccctcggacggggtccctggacccgtattccgtcgtcggacccttcctaaggttccgtcggaccctaccctcgaccgtccccgtacccgtcggacctactcgtacgtcgggccgtccgggntaggagagtcggagtcttgtactttatacgtgtactacggttcttacgacgcgacctgaccgtgtacgtgtcttagtcggttacgtacggtaacggtcggtaactacggtcctacgttcgtacgtccacgcccgaacgcccaacctgtcgtacctcttccgtccgttccccncctcactactacgtcgtacgtcgcggcggtcggtcgacgacgacgcacgatggctgacgngcaggtcaggtcngatacggctnacccgtnacgtcngatcg

SEQ ID NO: 163023 - DNA, 590 bp, Homo sapiens
  misc_feature: GYAE6OF02HG54O.34.86.H09.1.454.CMB.1.raw
  modified_base (570)..(575): a, c, t, g, unknown or other
  misc_feature (570)..(575): n is a, c, g, or t
  modified_base (577)..(581): a, c, t, g, unknown or other
  misc_feature (577)..(581): n is a, c, g, or t
  modified_base (583)..(590): a, c, t, g, unknown or other
  misc_feature (583)..(590): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaactcctcatctatgctaacaccaatccggccctcgaggggtccctgaccgattcctctggcctccaagtctcggccacctcacgcccttcccgtggccatccacgtcgggccgtccgggctggaggatggacggtctgtatttacttactcgttctacgtttcctttcgacacgcacggccgtgagtcgtcttagtcgttaccgttacggaacgtcggggaaccaacggtccaccgttacgtacggtaccacgtacccgaaccggaccccaacccctacgtcgtacctacctttcctccgttccccgtccccttcctacctacttccgacgttcggttaacgcgggacggtccggggccgtacgggaccgtaacgggcgtaccgagtacgcgannnnnncnnnnngnnnnnnnn

SEQ ID NO: 163024 - DNA, 767 bp, Homo sapiens
  misc_feature: GYAE6OF02G173E.34.86.H09.1.454.CMB.1.raw
tcagtacacgtgatcacgaccggtgctcgatttagtgctatagacttggggtttgggggaggctctgcttcatctgtgggcacaagaggcagcactcaggacaatctccagcatggcctggtctcctctcctcctcactctcctcgctcactgcacagggtcctcgggcccagtctgtgctggacgcagccgccctcagtgtcgtcggggccccagggcaggacgggtaccacctatcctcctggaccacgtggggacgccgacgtccctaccaacgacggttccggggggactaagggtttaactaggtacgttacgtaaccgtaaccgttacgggtaaaccaacggtaccgacgttaccccgttaccggaaccgggaaacccgaacccccggtacccccctaaaccgttcccctaaccgtaacttaccgttaacgtaccgtaaccgtaaaccctaaacccgtaaccgtccccggtccccgttacgggtacccggggttaccctaccggtaccggtactttccgtccgtcgtacctaccgacgttacgtccggaccacccgttacacccgggtccctcccggacgccttacgccgttccggtaccgggttcccgtccggcgtcggggaacggttacggtcgggtagtaccgtttaggttaacttacgttcgtaccggtcttccggtttactacggaaccgttcgaccggtacgtccggttagtcgttcgtttacttaggtccgttacggttacgtaccgggtacgg

SEQ ID NO: 163025 - DNA, 760 bp, Homo sapiens
  misc_feature: GYAE6OF02HBAP9.34.86.H09.1.454.CMB.1.raw
  modified_base (110)..(110): a, c, t, g, unknown or other
  misc_feature (110)..(110): n is a, c, g, or t
  modified_base (730)..(730): a, c, t, g, unknown or other
  misc_feature (730)..(730): n is a, c, g, or t
  modified_base (734)..(734): a, c, t, g, unknown or other
  misc_feature (734)..(734): n is a, c, g, or t
  modified_base (757)..(757): a, c, t, g, unknown or other
  misc_feature (757)..(757): n is a, c, g, or t
tcagtacacgtgatcacgaccggtgctcgatttagtgctatagacttgggtttgggggctgttcctggaagctgcttgtaccagagggtcaccatctcctgcactgggancagctccaacatcggggcaggttatgatgtacactggtacaagcagcttccaggacacgcccccaaatcctcatctatgcctaacaccaagtccggccctacgacggggttcccctaggacccgtattccgtcgtaggcctccgtaaggtctcggccaccgttcgaacgtccccttcccgtgggcccttaagtccgtaccgtggggtccccttccggggacttgggaaggtacttagggaacggtccttaggtaactttacgtttaccgttcgtaccgtaacggtttcctttaggaaccctaggtccaccggttccctaggtacggttctacttttaacgtgtttacccggttaacggaacggttacgggaacccgttaaaggtcccgaacccgttcggttaacggtccgaaaccgggtaccccgaaccggtacccccgaaacccccgtacgtccgtttaccctaacccgttcccgtttacccgttccccccggccccttttaccgaccgttaaacgtcccgtttacggtacggtaaccgtgggccggtcccggggtacgtaccggggacgtaacgggttcccgaacgtacgttcgcgtacgcgtacgcgcgcgtcgtcncgcncgtgtctcgtaccgctacgtctntcg

SEQ ID NO: 163026 - DNA, 685 bp, Homo sapiens
  misc_feature: GYAE6OF02H1RPT.34.86.H09.1.454.CMB.1.raw
  modified_base (262)..(262): a, c, t, g, unknown or other
  misc_feature (262)..(262): n is a, c, g, or t
  modified_base (372)..(372): a, c, t, g, unknown or other
  misc_feature (372)..(372): n is a, c, g, or t
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacgaggtcctgggcccagtctgtgctgacgcacgccgccctcagtcgtcgtcggggcccccagggcaggacgggtccaccatcctctgcacgtgggagcagcctaccaanagtcggggctaggttatgatgtacacgtaggtacaagcagcttccgaaggaaccaccgaaccccaaactcccacactactactcgacctaacacctaacgtccggacccncggacgggtcctacgacgtacttcctcgtcggtacctaccgtaacgtccgtacggccctacccgtctaacccgccccgttcccgacggaccctacgtaccgtaccggtccggggtaccgttcccggggacgttcgggaacggtagtacggacggttacgtaggttaacgtttacgttaccgtagttaccgttaccgttttaccgtttacggacctaacggtcctaccgggttaccctaggggtaacgtttcgttaccggttttaacgttcggtttaaccccggtttaccggggtaaaccggttaacccggggg

SEQ ID NO: 163027 - DNA, 694 bp, Homo sapiens
  misc_feature: GYAE6OF02GIW7Y.34.86.H09.1.454.CMB.1.raw
  modified_base (337)..(337): a, c, t, g, unknown or other
  misc_feature (337)..(337): n is a, c, g, or t
  modified_base (554)..(554): a, c, t, g, unknown or other
  misc_feature (554)..(554): n is a, c, g, or t
  modified_base (566)..(566): a, c, t, g, unknown or other
  misc_feature (566)..(566): n is a, c, g, or t
tcagtacacgtgatcacgaccggtgctcgatttagtgctatagacttgggtttggggaggctctgcttcagctgtgggcacaagaggcagcactcaggacaatctccagcatggcctggtctcctctcctcctcactctcctcgctcactgcacgagggtcctgggcccagtctgtcgctgacgcgagcccgccctcgagtcgtcgtcggggcccagggccaggacggtccactagtctctggcacgtgggacgctagcctaccaacgcgtcggggactacgggttactacgatacgtacacggttaggtacaaacgctacgtctaccgaagaaccnccgaacccctaactcccgtagacttaccgtatagtacctaaaccggtacctaacgttcccggacccgttccggtaacggggttcccctaggtaacccgttacgtttccgtacgtccggtaccgtaccgaaccgttcggtacgtacctaccgtccgtaaccgtccgtacccgttcgacctacgtccgacgttccggaccgccggtacgttcgggacgngttacggccgtnttacgtacgtttacgttacgtacgttccttacggttacctttacgggaccctaggttacccgacgtacccgttagttccgtacgttaccgtttagtaccggtttaccgtacgggtaaccgtacccggg

SEQ ID NO: 163028 - DNA, 662 bp, Homo sapiens
  misc_feature: GYAE6OF02FI3LL.34.86.H09.1.454.CMB.1.raw
  modified_base (585)..(585): a, c, t, g, unknown or other
  misc_feature (585)..(585): n is a, c, g, or t
  modified_base (605)..(605): a, c, t, g, unknown or other
  misc_feature (605)..(605): n is a, c, g, or t
  modified_base (631)..(631): a, c, t, g, unknown or other
  misc_feature (631)..(631): n is a, c, g, or t
  modified_base (635)..(635): a, c, t, g, unknown or other
  misc_feature (635)..(635): n is a, c, g, or t
  modified_base (648)..(648): a, c, t, g, unknown or other
  misc_feature (648)..(648): n is a, c, g, or t
  modified_base (651)..(651): a, c, t, g, unknown or other
  misc_feature (651)..(651): n is a, c, g, or t
  modified_base (654)..(662): a, c, t, g, unknown or other
  misc_feature (654)..(662): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggacagcccccaaatcctcatcgtatcgctaacaccaatccggcctcgacggggtccctcgaccgtattcctctaggcctaccgaaggttccttcgggcctaccctcgacgtcccctcccgtggcctactcaccggtgggccctccggggtctcgggacggactggacggtcctagtaactttacttaccgtgtcctacggtttccctttaggaacctaccggacctaacggtcccgttaggtaccgttcgtaccgttttaacgtcgtttaccggttaaccggggaacgttaccggggaacctaaacgggtcccttacccggttacgtacggtaccgaaccgaccccgtaaacgccctaaaccccgtagtcccgttacacccgttctccggttacccccacctccgtcaagtccctaacggtntaacctcggacacccgggtnttacggacgtaacgccgtacaggtcngacngacactgcaacgnacntgnnnnnnnnn

SEQ ID NO: 163029 - DNA, 632 bp, Homo sapiens
  misc_feature: GYAE6OF02IO9A2.34.86.H09.1.454.CMB.1.raw
  modified_base (164)..(164): a, c, t, g, unknown or other
  misc_feature (164)..(164): n is a, c, g, or t
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
  modified_base (317)..(317): a, c, t, g, unknown or other
  misc_feature (317)..(317): n is a, c, g, or t
  modified_base (414)..(414): a, c, t, g, unknown or other
  misc_feature (414)..(414): n is a, c, g, or t
  modified_base (443)..(443): a, c, t, g, unknown or other
  misc_feature (443)..(443): n is a, c, g, or t
tcagtacacgtgatcacgaccggtgctcgatttagtgctatagactttgggtttggggaggctctgcttcagctgtgggcacaagaggcagcactcaggacaatctccagcatggcctggtctcctctcctcctcactctcctcgctcactgcacgcgggtccncgggcctagtctgtcgcgtacgacgcacggccctccnctagtcgtcgacgggcccagggcagtggcaccnctcgtccagcgagtggagcacgctaacctacgacggtcgggactaggttagactgttacgaccgtagttacgaagaccggacncgtaccttaccggaagtaacccaccgtaccccaatactacgacttcgacgtcaacgtaccacacgtcccgtactccggtacggcctacacgtactcncgttacgccgtacacgtacgccgctaccncgtacgtccctaccgtacgaccttacgaccgacgggttccgcgggtaccgacgccggttaaggaccttgggacccgtgttaccggtaatttccggttactcgtaaccgggtttctacccgttgaacggtcctaagaccggtcgtacgtggtaacgttcgttactcggtaccggttaggtacgtaaccgg

SEQ ID NO: 163030 - DNA, 424 bp, Homo sapiens
  misc_feature: GYAE6OF02GA3PC.34.86.H09.1.454.CMB.1.raw
  modified_base (359)..(359): a, c, t, g, unknown or other
  misc_feature (359)..(359): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (417)..(424): a, c, t, g, unknown or other
  misc_feature (417)..(424): n is a, c, g, or t
tcagtacacgtgatcacgaccggtgctcgatttagtgctatagacttgggtttgggagcagctccaacatcggggcaggttatgatgtacactggtacaagcagcttccaggaacagcccccaaactcctcatctatgctaacaccaatcggccctcaggggtccctgaccgattctctggctccaagtctggccacctcacgcctccctggccatccacgtgggcctccgggctggaggatggaggctgattattactgtcagtcctttgacagcagcctgatgcttatgtcttcggaacgtgggaccaaggtccaccgtcctaggtcacgcccaacggacccaaccccactcgtccnctctcgttccccgccctcctcactcacgtgtactcggagcggcgtggcagggcnangnnnnnnnn

SEQ ID NO: 163031 - DNA, 493 bp, Homo sapiens
  misc_feature: GYAE6OF02GGCV2.34.86.H09.1.454.CMB.1.raw
  modified_base (284)..(284): a, c, t, g, unknown or other
  misc_feature (284)..(284): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (441)..(441): a, c, t, g, unknown or other
  misc_feature (441)..(441): n is a, c, g, or t
  modified_base (472)..(474): a, c, t, g, unknown or other
  misc_feature (472)..(474): n is a, c, g, or t
  modified_base (476)..(493): a, c, t, g, unknown or other
  misc_feature (476)..(493): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacagcccccaaatcctcatctatgctaacaccaatcggccctcgaggggtcccctgaccgattcctctggcctccaagtctggcacctcagccctcctggccatcactgggctccgggntgaggatggaggcttgatttattactgtcagttccttgacagtcagcctgagtgtcttatcgtcttgggaacgtgggaccagggtccaccgtcgtaggtccagacccagcccaacccngtntcactctcgtcccaccctctcactcgtacgtgtacnggtacggccggctaggcaacggtcacatagnnntnnnnnnnnnnnnnnnnnn

SEQ ID NO: 163032 - DNA, 936 bp, Homo sapiens
  misc_feature: GYAE6OF02IEBG9.34.86.H09.1.454.CMB.1.raw
tcagtacacgtgatcacgaccggtgctcgatttagtgctatagacttgggtttgggggctgcttcagctgtgggcacaagaggcagcactcaggacaagtcctccagcatcggccgtggtctcctctcctcctcacctctcctcgctccactgcacgacggtcctcgggaccctagtctcgtcgtccgttcgaccgccgaccgtccccgtcccctacgtacggtcggttccggttccggggggacccccgaaggggaccgtaaacgggtacgggttacccaaccgtaccttaccgtcccggtcggcgtaaccggtgggacgcgaacgtacctaacccgtaacgtacgggtccggggtctaagggtttatacggtacttacgtaacgtaacgttacggaacgtaacgtaccgtaacgtccgttaaccgaaccgaaccgtaacccgtaacccccgtaaacgtcccttaactaacttacgttaacctacgtaaacctaaacccgtaaaccgtaccggtaccccggtacccttaccgggttaccggggtacccctacgggtaacccgtacgtttccggttaccggtacggtacccttaacggtaaccgttacccggtaccggtacccctaccgtacccgtaacccgttccccgacccgggttccgaaccccgttaacttacccgggttcccgggttccgggtacccggttacccgggaggttaaccgggaacggttacggttaccgggtaaccggtttcgttaaaaccgtttacgttttaacccgtttaacgttacgttaacccggttacgttttaccccggttagtaacccggtaacgttacccggacgtttaccgggtacggtacgttaacccggtttagttaccggtacgtttacccgggtaaagggtacccgttaacgggtacccttaacccgggg

SEQ ID NO: 163033 - DNA, 671 bp, Homo sapiens
  misc_feature: GYAE6OF02IMM2X.34.86.H09.1.454.CMB.1.raw
  modified_base (239)..(239): a, c, t, g, unknown or other
  misc_feature (239)..(239): n is a, c, g, or t
  modified_base (328)..(328): a, c, t, g, unknown or other
  misc_feature (328)..(328): n is a, c, g, or t
  modified_base (629)..(629): a, c, t, g, unknown or other
  misc_feature (629)..(629): n is a, c, g, or t
  modified_base (639)..(639): a, c, t, g, unknown or other
  misc_feature (639)..(639): n is a, c, g, or t
  modified_base (665)..(665): a, c, t, g, unknown or other
  misc_feature (665)..(665): n is a, c, g, or t
tcagtacacgtgatcacgaccggtgctcgatttagtgctatagacttgggtttgggggctgttcctggaagctgcttgtaccagagggtcaccatctcctgcactggggagcagctccaacagtcggggcaggttatgatgtacacgtggtacaagcagtcttccgaggaaccacgacccccaaatcctcatctatcgactaacaccaatccggccttacgacgggtccctagaccgtnttctcgtggccttaccaagtctcggactaccgtcacgtccctcccgtggcccagtcgtaggtcggtccgtccggtacttggaacgggtntcggacggtctagtaacctttaatcgtggcggtcacggtacgaggttcgggatacgacgtacgtactaggacgtcggacttacgtatcggttaccgtacgggaacttccgggaactacggtcctacggtacgtgtccgaacgaccgtaacccgtacccaacccgtcgtacgtactaccgttccgtccggttcccctcccgttaccctaccttactccgtaaccgtcgttacggtacggaccggtaccgggtccgtacgggtaaccggtaacggcccggtaagtaccgtacgtacgtcgtancgtcgacgtnactacgtcgtacgtacgctacggacngtcacg

SEQ ID NO: 163034 - DNA, 747 bp, Homo sapiens
  misc_feature: GYAE6OF02JAEK3.34.86.H09.1.454.CMB.1.raw
  modified_base (144)..(144): a, c, t, g, unknown or other
  misc_feature (144)..(144): n is a, c, g, or t
  modified_base (313)..(313): a, c, t, g, unknown or other
  misc_feature (313)..(313): n is a, c, g, or t
  modified_base (451)..(451): a, c, t, g, unknown or other
  misc_feature (451)..(451): n is a, c, g, or t
  modified_base (709)..(709): a, c, t, g, unknown or other
  misc_feature (709)..(709): n is a, c, g, or t
  modified_base (713)..(713): a, c, t, g, unknown or other
  misc_feature (713)..(713): n is a, c, g, or t
  modified_base (722)..(722): a, c, t, g, unknown or other
  misc_feature (722)..(722): n is a, c, g, or t
  modified_base (725)..(725): a, c, t, g, unknown or other
  misc_feature (725)..(725): n is a, c, g, or t
  modified_base (728)..(728): a, c, t, g, unknown or other
  misc_feature (728)..(728): n is a, c, g, or t
  modified_base (732)..(732): a, c, t, g, unknown or other
  misc_feature (732)..(732): n is a, c, g, or t
  modified_base (742)..(742): a, c, t, g, unknown or other
  misc_feature (742)..(742): n is a, c, g, or t
  modified_base (745)..(745): a, c, t, g, unknown or other
  misc_feature (745)..(745): n is a, c, g, or t
tcagtacacgtgatcacgaccggtgctcgatttagtgctatagacttgggtttgggggctgttcctggaagctgcttgtaccagagggtcaccatctcctgcactgggagcagctccaacagtcggggcaggttatgatgtacnctggtacaagctagcttccaggaaccacgtaccccctaaactcctacgacttctaatcgtacctaaaccacctaactccggacccccttcgaacgggggtttccccagtacccggtacttcccgttcgtcgtaccctcccgtaagttccgtcggcctacctccgaaccncccttcccgttcggaccctaccgttcgaaccgtcgggggtaccgttaccccggggcttgggaacgggcttaggggacgtacctagtaagttttacttaccgttctacgtacctttcgtttacgagtctacgacgtccnggttaacgtcgtaactttgtctttccggtaaccgtagggttaaccggacgttaacggtcccgtacccgggttacctacgggtaccgacccgtaacccgacccgtaaccccgacccgtaccgtccgtacctcggtacctttaccggtccccgtacccctcctacgtaaccctcgttaccggtattaccggtcggtaaccgggtcgggtaccggttacggacccgggtaacgggtccgtacgttaacgaagtcgccctanccgngtcacgtcnctntcncgcnctcgcacacncancg

SEQ ID NO: 163035 - DNA, 781 bp, Homo sapiens
  misc_feature: GYAE6OF02F9ZCT.34.86.H09.1.454.CMB.1.raw
  modified_base (726)..(726): a, c, t, g, unknown or other
  misc_feature (726)..(726): n is a, c, g, or t
tcagtacacgtgatcacgaccggtgctcgatttagtgctatagacttgggtttggggctgcttcagctgtgggcacaagaggcagcactcaggacaatctccagcatggccttgtctcctctcctcctcactctcctcgctcactgcacgagggtcctgggcccagtctgtgctgacgcagccgccctcagtgtcgtcggggccccagggcaggacgggtccaccatcctccgtgaccgacgtggggactcgacgtcctaccaaacgtcggtacggggactaaggtttagtggattcggtaacacggtaggtaacacgtcacggtccttaccgaagggaaccaccgaacccccctaaaacttccctactaacttaccttaacgtcgtaaccctaaaccgtaacccgtaaacgtccccgggtaacccctttaccgggaaacccggggggtttcccctaacgggtaacccgttacgttttacccgtccgtttacgggacccttacccggtaaccggttcgttacccgggacctaaccctaccgtacccgggtaccccttcccggtcggtaccctacgttacccggtaacggttccggggtacccgttccgggggtactacgggacgtaggtccggagggttcttaacggtttaactttaacttcgttcgttacgttaaccgtttccttagggacctacgggtacctaaccgggtcctaggtacggttnttacgttacgttcgttaacccggttacgggacggttaccgggtacgtaacccggg

SEQ ID NO: 163036 - DNA, 610 bp, Homo sapiens
  misc_feature: GYAE6OF02ITWSV.34.86.H09.1.454.CMB.1.raw
  modified_base (362)..(362): a, c, t, g, unknown or other
  misc_feature (362)..(362): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (591)..(597): a, c, t, g, unknown or other
  misc_feature (591)..(597): n is a, c, g, or t
  modified_base (599)..(599): a, c, t, g, unknown or other
  misc_feature (599)..(599): n is a, c, g, or t
  modified_base (601)..(602): a, c, t, g, unknown or other
  misc_feature (601)..(602): n is a, c, g, or t
  modified_base (604)..(610): a, c, t, g, unknown or other
  misc_feature (604)..(610): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggacacgcccccaactcctcatctatgacctaaacaccagtccggccctacgacggggtcccctagacccgtatttcctcgtaggccttaccgaagttcgtacggcctaccctcgaacgtccccttcccgtaggacctacgttcgacggttcggccgtaccgggtctggaggagtacggagtctagtatttacttacgtntctacgttctttagacctagactacggcctaggtagttctcttagttcgttcgtacggaagtacgggactacggtccctacgtcgtacggtacacgacccaacggtacccacccttacgtactaccctacgttcctacccgttccctacccttctacgactttcgacgttactaccgtaggccggcgggtaccgtacggaaccgtcgggactacgtaacgtcgncntcnnnnnnncncnncnnnnnnn

SEQ ID NO: 163037 - DNA, 626 bp, Homo sapiens
  misc_feature: GYAE6OF02FYD8Q.34.86.H09.1.454.CMB.1.raw
  modified_base (182)..(182): a, c, t, g, unknown or other
  misc_feature (182)..(182): n is a, c, g, or t
  modified_base (352)..(352): a, c, t, g, unknown or other
  misc_feature (352)..(352): n is a, c, g, or t
  modified_base (576)..(576): a, c, t, g, unknown or other
  misc_feature (576)..(576): n is a, c, g, or t
  modified_base (590)..(590): a, c, t, g, unknown or other
  misc_feature (590)..(590): n is a, c, g, or t
  modified_base (595)..(595): a, c, t, g, unknown or other
  misc_feature (595)..(595): n is a, c, g, or t
  modified_base (602)..(602): a, c, t, g, unknown or other
  misc_feature (602)..(602): n is a, c, g, or t
tcagtacacgtgatcacgaccggtgctcgatttagtgctatagacttgggtttgggggctgttcctggaagctgcttgtaccagagggtcaccatctcctgcactggggagcagctccaacatcggggcaggttatgatgtacactggtacaagcagcttccaggacagcccccaaactccncatctatgctaacaccaatcggccctacgaggggtccctgaccgattcgtctcggtctccaagtctggccacctcacgccctcctggccatccactcggggctcccgggctaggacggatcggaggtctgattacttactgtcagtttccttgacagcagcctagacgtntctttacgtgttcgttacggacgtcgggtaacctaaggttccaccccggttcgttacgggtaccgacgaccccgaaacggaccccaacccccgtactcggttaccaaccgttccgttaccggttaccccctaccccgtcccctacgtacttcccgaaccggttcgttaaccgtggtaccgggtccgggtaccgtcggacggtaaccgggtcgaccgtaacgtancgtcgagtctacgntacgngccgtanctcgctagtagacgtgctacagtc

SEQ ID NO: 163038 - DNA, 773 bp, Homo sapiens
  misc_feature: GYAE6OF02HIYVS.34.86.H09.1.454.CMB.1.raw
  modified_base (310)..(310): a, c, t, g, unknown or other
  misc_feature (310)..(310): n is a, c, g, or t
  modified_base (762)..(762): a, c, t, g, unknown or other
  misc_feature (762)..(762): n is a, c, g, or t
  modified_base (770)..(770): a, c, t, g, unknown or other
  misc_feature (770)..(770): n is a, c, g, or t
tcagtacacgtgatcacgaccggtgctcgatttagtgctatagacttgggtttggggggggggtctcaggaggcagcgctctcgggacgtctccaccatggcctgggctctgctattcctcaccctcctacactcagggcacagggtcctgggcccagtctgccctagactcaggctgcctccgtgtcgtgggtcctccgtggacagtcgatcaccagtcctcctgctactcggtaaccgctagtagacgttagatagtacttaagtaagttctcgtctccgtaggtaacccaacgaaccaaccccgganaactcctaaccccaaaactcattacgtatttagagtaactagtacgtaaactaacgcccgggttacctacggtaaggtttcttccgactacgtcctcttctccgtcgtaccctctagttcgtcgtacgaacctaacccggtcccggtacccttcccggtaactaccctactccgtaccgtacggtacccgtacggtacggtacggttaacggggaaccgggtaacgggtaccgggtaacgtaacccgggtaacccgtaaccgggtcccggttaccccccgtcccccggttacggtaacccggttacccgttccccggtttccccggttcccccggttccccttaccctaacctccgttacccggttaccggtttaccgaccggtttacgggcccgggtttaccgggacggtttaccgggaaccggtaacgggaccggttacgaacgtccggntacgtcanacg

SEQ ID NO: 163039 - DNA, 718 bp, Homo sapiens
  misc_feature: GYAE6OF02HBYUC.34.86.H09.1.454.CMB.1.raw
  modified_base (108)..(108): a, c, t, g, unknown or other
  misc_feature (108)..(108): n is a, c, g, or t
  modified_base (141)..(141): a, c, t, g, unknown or other
  misc_feature (141)..(141): n is a, c, g, or t
  modified_base (166)..(166): a, c, t, g, unknown or other
  misc_feature (166)..(166): n is a, c, g, or t
  modified_base (679)..(679): a, c, t, g, unknown or other
  misc_feature (679)..(679): n is a, c, g, or t
  modified_base (684)..(684): a, c, t, g, unknown or other
  misc_feature (684)..(684): n is a, c, g, or t
  modified_base (700)..(700): a, c, t, g, unknown or other
  misc_feature (700)..(700): n is a, c, g, or t
tcagtacacgtgatcacgaccggtgctcgatttagtgctatagacttgggtttggggctgttcctggaagctgcttgtaccagaggtcaccatctcctgcactgggancagctccaacagtcgggcaggttatgatgtacnctggtacaagcagcttccgaggacncgccccaatcctcatctatcgcctaacaccaagtccgcctcgacgggtccctgaccgtacttccgtcgtcggacctaccgaagttccgtcggacctaaccgtcacgtccccttacccgtggaccctaagtccgtaccgtcgggtaccgtcccgggtctaggaggtactacggacggtctagttaatttaccttacgttcgtcctacgttccgtttagacgtagcgtactccgtggtacgtcgttccgttaagttcgttaaccggtaccggtaacggttccgggtaaaccgtaacgggtaccctacccgggtttaccgtaggtaaccccgtaacggacccccgaaccggtacccccgaaacccccgttgtaccgttacccctaaccgtttccgtaccccgtttacccccaaccccggttcccacgttaccgtacgttaccgtacgtaccgtacggcgggtacccgtcggtacgccggtaaccggcgtaccgtacgttacggctcgacgtctacngtacnctcgaaacctgccganccgttcagcacctgtcag

SEQ ID NO: 163040 - DNA, 555 bp, Homo sapiens
  misc_feature: GYAE6OF02G0L61.34.86.H09.1.454.CMB.1.raw
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (516)..(516): a, c, t, g, unknown or other
  misc_feature (516)..(516): n is a, c, g, or t
  modified_base (520)..(555): a, c, t, g, unknown or other
  misc_feature (520)..(555): n is a, c, g, or t
tcagtacacgtgatcacgaccggtgctcgatttagtgctatagacttgggtttggggagcagctccaacatcggggcaggttatgatgtacactggtacaagcagcttccaggaacacgcccccaaactccccatctatgctaacaccaatcggccctcgagggggtcccctgaccgatttctctggctccaagtctggcacctcacgccctccctggccactcacgtgggcctccggggctggaggatggaggctagtatttatactgtacagttcctttgacagcacgctggagtgctttagtgtccgttacggaacgtcgggaaccgtaaggtccctaccggtccgtaggtacaccggtaccccgaacgggtcccccaaaccccgtacgttcgtaccctaccttccgtttcccgttacccccaccctttcccaccgtaactccgtacggttacgtacctgggtacggccgggtcgtacgggaaccggaacggggtcgactagtacggntncgntcgnnnnnnnnnnnnnnnnnnnnnnnnnnnnnnnnnnnn

SEQ ID NO: 163041 - DNA, 803 bp, Homo sapiens
  misc_feature: GYAE6OF02GXF44.34.86.H09.1.454.CMB.1.raw
  modified_base (769)..(769): a, c, t, g, unknown or other
  misc_feature (769)..(769): n is a, c, g, or t
  modified_base (772)..(772): a, c, t, g, unknown or other
  misc_feature (772)..(772): n is a, c, g, or t
  modified_base (775)..(775): a, c, t, g, unknown or other
  misc_feature (775)..(775): n is a, c, g, or t
  modified_base (778)..(778): a, c, t, g, unknown or other
  misc_feature (778)..(778): n is a, c, g, or t
  modified_base (780)..(781): a, c, t, g, unknown or other
  misc_feature (780)..(781): n is a, c, g, or t
  modified_base (784)..(784): a, c, t, g, unknown or other
  misc_feature (784)..(784): n is a, c, g, or t
  modified_base (791)..(791): a, c, t, g, unknown or other
  misc_feature (791)..(791): n is a, c, g, or t
  modified_base (793)..(793): a, c, t, g, unknown or other
  misc_feature (793)..(793): n is a, c, g, or t
  modified_base (801)..(801): a, c, t, g, unknown or other
  misc_feature (801)..(801): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttcaggaacacgacccccaaactcctcatctatcgactaaccaaccaatccggccctacggtacggggtccctagaccgtacttcgtcgtacggtcctaccgtaacggttcgtcggacctacccttaccgaccgttcccccgttaccccgtcgggtacccctaacttcccggtaaccggttccgggggcccgttccccgggggtcgttaacggggagggtaacggtcgggtacgggtccgttaggttaaacgttttaacgtttaacggttcggttaccggttaccggttttaaccccggttttgaaaccgggtaacgtaccgtaaccggttcccggtaaggtaacggttcgtttaccgtttacgttacggtttaccggttaaccgggtaacggtaccggggtaaccgttaacgggtaccccgttacccgttacggttaaccgggtccgaacccggaacccgtacccgtacccccgaaaccctcgttaccgtacctaccgtttacccgtccccgttaccctaccccgttaccctcgtacttcccgtaacgttccgtacggtacgcggggtaccgtacggtcggtaaccgacgtacggaactacgtgacgacgntcncgncgngnngcntcgcgcncncgcgtctntg

SEQ ID NO: 163042 - DNA, 750 bp, Homo sapiens
  misc_feature: GYAE6OF02IL75W.34.86.H09.1.454.CMB.1.raw
  modified_base (191)..(191): a, c, t, g, unknown or other
  misc_feature (191)..(191): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacgagggtcctgggccctagtctgtgctgacgcacgccgccctnagtcgtccgtcggggccccagggcaggacgggtccaccattcctccgtgcgacgtgggacgcagctaccaaacgacgtcggggctagggttactgatacgtactacgtaggtaacaacgctagccttaccgaacggaaccaccgaccccaaactcctacacttctactacgaccttaaccaaccgtaacgtccggtacccgtacggccgggttaccctacggtaacccgtactttccgtccgttcggacccttaccgaacggttccgtaccggaccctacccgtaccgaccggttccctacccggtaccgtaccctaccgttaccggtaccggttaccggggtcccgtacccggggtccgttaaggaccgggttacgtaccggggtacggttccgttaaacgggtttacttttaaccgtttaccggttcgttaccgtttaacccgtttccgtttaacgaccggtaacgcggtacctacccggtagttccggttacgttaccgtttacggttccggtttaaccgtaccggggtaacggtccgggtaaaccgttcccgggg

SEQ ID NO: 163043 - DNA, 696 bp, Homo sapiens
  misc_feature: GYAE6OF02IY5GO.34.86.H09.1.454.CMB.1.raw
  modified_base (256)..(256): a, c, t, g, unknown or other
  misc_feature (256)..(256): n is a, c, g, or t
tcagtacacgtgatcacgaccggtgctcgatttagtgctatagacttgggtttgggggaggctctgcttcagctgtgggcacaagaggcagcactcaggacaatctccagcatggcctggtctcctctcctcctcactctcctcgctcactgcacagggtcctgggcccagtctgtgctgacgcagcccgccctcagtcgtcgtcggggccccagggcaggacgggtccaccacttcctcctgccacgtggggacncgacggcctaccaaacgacgtccgggggactaggttactggtacttagtaaccgtacgtaggtacaaggcgtacgtaccgttaccgaacggaaccacccgaacccctaaacgttcctactacttacctacgtacgaccttaaaccgacctaacgtcccggcccgttacggaccggggttccctacgacccgttatttccgtcgtcggtcctaccgtaacgtcgtacgccaccgtcaccgtcccgtcccgtcgacctactccgtacgtcgggtacctaccggtacggcgtaggacggtacgtacggtacggtcttacgttaactttacgttacgttacgttacgttacggtttaccgttaacggacgtacgtaccgtacggttccgttaggtacggttacgttacgttacggttaccggttaccggttacgggtaaccggg

SEQ ID NO: 163044 - DNA, 772 bp, Homo sapiens
  misc_feature: GYAE6OF02FJOKJ.34.86.H09.1.454.CMB.1.raw
  modified_base (134)..(134): a, c, t, g, unknown or other
  misc_feature (134)..(134): n is a, c, g, or t
  modified_base (761)..(761): a, c, t, g, unknown or other
  misc_feature (761)..(761): n is a, c, g, or t
tcagtacacgtgatcacgaccggtgctcgatttagtgctatagacttgggtttgggggctgttcctggaagctgcttgtaccagagggtcaccatctcctgcactgggagcagctccacatcggggcaggttangatgtacatggtacaagcagcttccaggacagcccccaaatcctcatctatgctaacaccaatcggccctcaggggtccctggaaccgattctctggcctccaagtctggccacctcagcctaccgtggccatcactcgggactccggggctaggaggactgtaggccgtgtaagtttacttacttcggtacgtaaggtcccctttagacctaaggccgtaacgcctaggtaacggttcgccgttttaaagccggttacgttaccgggaaacgttcgggggaaaccctaaacggggtccctaacccgggtaccgttaaacgggtccgaaccggtaaccccgaaaccgggtaacccgtaaacccccgtaaccggttaccgggttaacctaaccccgttacccggttaacccggtttccccccggtaccccccgtttacccgttacccggttaaacgttacccggttaacccggtacggtttaacgttaccgggaaccgggttacccggggaccggtttaccgggacccgttaaaccgggggtaccgaaccgtaaacggtaccggacgacgttaccgaatccgtaaggtcaacgttcgacgtccgagttaccctaggacccgttagtanacgtacagtag

SEQ ID NO: 163045 - DNA, 735 bp, Homo sapiens
  misc_feature: GYAE6OF02H0YMS.34.86.H09.1.454.CMB.1.raw
  modified_base (699)..(699): a, c, t, g, unknown or other
  misc_feature (699)..(699): n is a, c, g, or t
  modified_base (712)..(712): a, c, t, g, unknown or other
  misc_feature (712)..(712): n is a, c, g, or t
  modified_base (715)..(715): a, c, t, g, unknown or other
  misc_feature (715)..(715): n is a, c, g, or t
  modified_base (719)..(721): a, c, t, g, unknown or other
  misc_feature (719)..(721): n is a, c, g, or t
  modified_base (730)..(730): a, c, t, g, unknown or other
  misc_feature (730)..(730): n is a, c, g, or t
  modified_base (733)..(733): a, c, t, g, unknown or other
  misc_feature (733)..(733): n is a, c, g, or t
  modified_base (735)..(735): a, c, t, g, unknown or other
  misc_feature (735)..(735): n is a, c, g, or t
tcagtacacgtgatcacgaccggtgctcgatttagtgctatagacttgggtttgggggctgttcctggaagctgcttgtaccagagggtcacatctcctgcactgggagcagctccaacatcggggcaggttatgatgtacactggtacaagcagcttcaggaacacgacccccaaactcctcatcctatgactaaccaccaatcggaccctcgacggggtcccagtaccgtatcctactggctaccaagttctacgggccacctacacggtccctcccgtggaccaatcgactcgggcgtccgggccgtggtaacggattacggaggtccgttaggtaactttaacgttaaccgttggtaacctacggtttacccgttttacgaacgtaacgtccggaactcccgtaggtaggttacgtcgttttaaactcggtttcggtttaaccgggtaaaccggttcggggaaacccgtttaaaacgggaccccgttaacccggttacccgtttaggggtaccaaacccggacccggtaaaacggccccgtaaaccccccaaagggtttcccgttaaccgtacccgttaccgttacccgtttccccggtcccccgttacccgttacaaaccgttccggaacgtttaccgttacgaagccgggtcgggtaccgttaccggacgtaaagggtcccgaacgtaatggnaagccatgatagntangacnnncacgactcncangn

SEQ ID NO: 163046 - DNA, 721 bp, Homo sapiens
  misc_feature: GYAE6OF02H01CM.34.86.H09.1.454.CMB.1.raw
  modified_base (260)..(260): a, c, t, g, unknown or other
  misc_feature (260)..(260): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacgacggtcctgggcccagtctggtgctgaccgctacgccgccctgagtcgtcgtcggggccccagggtcaaggacgggtccaaccgtactcctcccgtgacacgtggggacncacggtcctaccgaacgcggtaccggggactaggttatacgacttaggtaaccacgtcggtaacaagtccaagtccgttaccgaaacggaccacccgacccctaaagtcccttacaattccgtagtccgaacctaaccgaccgtaaccgtcccggtacccttcgggaccgggttaccctacggaacccgtttacttccgtacgttccgggccttaacccgtagtcccgtacgtaccgtaccctacgacccgttcccgtcccgaacggtccctaacgttccgaccggtttacgggccgtcgggtacgtaggacggtacgttccggacgttcgtacgtaacgtttacgttactcgtaccgtttacgttaccgttaggaccgtacgttccgaaccggttccgttaggtaccgtcgttacgtttgtaccgttacggtttaccggacgtacccggaccgttaccgg

SEQ ID NO: 163047 - DNA, 732 bp, Homo sapiens
  misc_feature: GYAE6OF02H98XA.34.86.H09.1.454.CMB.1.raw
  modified_base (668)..(668): a, c, t, g, unknown or other
  misc_feature (668)..(668): n is a, c, g, or t
tcagtacacgtgatcacgaccggtgctcgatttagtgctatagacttggggtttgggggctgcttcagctgtgggcacaagaggcagcactcaggacaatctccagcatggcctggtctcctctcctcctcactctcctcgctcactgcacgacgggtcctcgggcccagtctggtgcgtcggaccgcaccggcccgccctagcggtcgttccggcgggggaccccagggccgaggtacgggtccaacctctcctccgtacaccgtacgggtagggaaccgccgacggtaccctaccaacgtagggttccgggggactaggtttgtacgagttacgaacgtacggtacggtaacgaactcgtaacgtaccgtacgaaccggaaccgacccgaacccctaacctcctacaatcttaacgtcgtaaccctacctaaccgaacgtccccggtaccgtacgggtacccggttacccgtaccgacgtttaacccgtcgtaccggtccggtaccgttaccgtacgtccgtacggtaccctaccggtccgtcccgtccctccgtccgccgtacgtccggtcgtccggggtccgcccggtaggtcgaaccggtgtacccggtacgtccgttaagttacgttactttcgtcggtctaccgttcgtacgacgcgtacncggttgcgttaacggtcgttcgttacgtcggttaccggtacggtaacgccgggttaactaccgg

SEQ ID NO: 163048 - DNA, 750 bp, Homo sapiens
  misc_feature: GYAE6OF02JAR8C.34.86.H09.1.454.CMB.1.raw
  modified_base (145)..(145): a, c, t, g, unknown or other
  misc_feature (145)..(145): n is a, c, g, or t
tcagtacacgtgatcacgaccggtgctcgatttagtgctatagacttgggtttgggggctgttcctggaagctgcttgtaccagtgtacatcataacctgccccgatgttggagctgcctcccagtgcaggagatggtgaccctntgccctggggccccagacactgagggcgctgcgtcagcacagactcgggcccacggaccctggtgctagtgagcgaggagagtgaggaggagacggaagaccgagtccaagtcgcaggacgtacttacgtccgtagaggtcacttcggcccttccgttggtccgaccccaagacggtactaggaacggccgtaagaccggaccttaaccaaaacttccgtactaactacgtacacggtaacttaaaccaaaccaacgtcccggacccttggaaacccgggggttcccccttaggaaccccgtactttccgtaggttccgaacttacccgtaacgtccgtacggacctaacccgtcctaacgtcccttacccggtcgacctacctacgacggaccgggtcctccgggtaccgtggaacggtagttaccggagttccgttaacgttaagtttaccgttacgtacgtttaccggtaacgttttacccgttaggtacccgaacggttaccgaccgggtttaccctaacgggtacgtttaccgggttaccgttttaaaagttcccgggttttacggttaaaccccgggggttaaccgttaaacccggggg

SEQ ID NO: 163049 - DNA, 819 bp, Homo sapiens
  misc_feature: GYAE6OF02HD8XV.34.86.H09.1.454.CMB.1.raw
  modified_base (231)..(231): a, c, t, g, unknown or other
  misc_feature (231)..(231): n is a, c, g, or t
  modified_base (270)..(270): a, c, t, g, unknown or other
  misc_feature (270)..(270): n is a, c, g, or t
tcagtacacgtgatcacgaccggtgctcgatttagtgctatagacttggggtttgggggtgggcacaagaggcagcactcaggacaatctccagcatggcctggtctctctcctcctcactctcctcgctcactgcacagggtcctgggcccagtctgtgctgacgcacgccgccctcagtcgtcgtcggggaccccagggcaggacgggtccaccatcctcctgccacgngggacacagcctaccaactacgtccggggactaggttangtattagtaccacgttaggtaacaacgcgaccggtaccttaccggaacggtaaacccgacccgacccccctaaacgttcccctactaacttaccgttaagtaccggtaaccctaaaccgaaccccgtaaacgtccccgggtaaccccttacgggtaacccggggtacccctacggtaacccggttaccttaccgttaccggtccggtacccgttaacctaacggttccggtacggacccctaccgtacgcccggtaccccttcccgtacggtaccgtaccgtaccggtaccggttcggggaccgtccgggtacgacggtacgggtaacgtcgggtaacgtcgttaacgtagttttaacgttacgttacggttaacccgtttcgggttacccgtttaggtaaccgtaccgttaaccggtaacggttccctagggtaccgttcgttaccggtttacgttcggttacccggttaacggtaaccggttaccggtaaccggttacggtacccggtacggtaaccgtttacgggcccgtaaccggtaaccccggg

SEQ ID NO: 163050 - DNA, 645 bp, Homo sapiens
  misc_feature: GYAE6OF02ITIXI.34.86.H09.1.454.CMB.1.raw
  modified_base (246)..(246): a, c, t, g, unknown or other
  misc_feature (246)..(246): n is a, c, g, or t
  modified_base (613)..(613): a, c, t, g, unknown or other
  misc_feature (613)..(613): n is a, c, g, or t
  modified_base (621)..(621): a, c, t, g, unknown or other
  misc_feature (621)..(621): n is a, c, g, or t
  modified_base (633)..(633): a, c, t, g, unknown or other
  misc_feature (633)..(633): n is a, c, g, or t
  modified_base (636)..(638): a, c, t, g, unknown or other
  misc_feature (636)..(638): n is a, c, g, or t
  modified_base (642)..(642): a, c, t, g, unknown or other
  misc_feature (642)..(642): n is a, c, g, or t
tcagtacacgtgatcacgaccggtgctcgatttagtgctatagacttgggtttgggggctgttcctggaagctgcttgtaccagagggtcaccatctcctgcactgggagcagctccaacatcggggcaggttatgatgtacactggtacaagcagcttccaggaacacgcccccaaactcctcatctatgactaacaccaatccggccctcgacgggtccctgaccgattctctgctccaagtcnggccacctcacgcctcccgtgccatccacgtcgggcctccgggctggacggtagtgagggctaggtaatttattaccgttgtctacgttccttttgaccagacgtagccgtagacgttcgtacttaagttcgttacgttacggtaacgtcgggaaccgtaaacggtccgaaccgttcccggttaggtccaaccggcccgtaaacggacccctaacccctactacggtacctaccgttccgttaccgtttaccccgtcccccttccctaccgttacttaccgtaccgttacgttaccgtacggaccgggtcggggaccgttacgggaccgtaaacgggccggtacgtaacgttaggctacagtgactnagcacggntacgcgagtacncgnnntcgntcg

SEQ ID NO: 163051 - DNA, 921 bp, Homo sapiens
  misc_feature: GYAE6OF02HBRPW.34.86.H09.1.454.CMB.1.raw
tcagtacacgtgatcacgaccggtgctcgatttagtgctatagacttgggtttgggggtgggcacaagaggcagcactcaggacaatctccagcatggcctggtctcctctcctcctcactctcctcgctcactgcacgagggtcctcgggcccagtctgtgcgtgaccgcgacgccccgtccctcgtaggttcgttccggtccgggggacccccagggggccaagggtacgggggtccaacccgtacttccgtcccgtgaccgtaccggtggggacggccacgtccgtaccgaaaccgaggttccggggggacgttaacgggtttagtaggtacgttcggttaaccgaccggttaggtaacgtaacgcgtaacgttcccgttaccgaacgggtaaacccaaccccggtaaccccctaaaccttccctaccaattaccgtaacgtaccgtaccctaaaccgacccgtaacggtaccccggtaccggttaccggtcccggggtaccctacggtacccgttacttcccgtacgtaccgtaccgttaaccgtacgtaccgttaccggtcctaacccgtacggacccgtcccgttccggtcccggtacccttaaccgtccggttacgggtccgggtcccggttaccggggtccgaacgggtaacggttacggtaccgggtacggttcgttacgttaacgttttaacgtttaccgttaggttaccgttacggtttccgttacgtaacgtacgttccggaaacgttcccggttagttaccggtttcgttacccggttttacgttcccgggttttaacccggttaccgggtaaaccgggttttaacccgggaaccggtttaacccggtacccgggtttaaccccgttaccggttaacccggggttacccgaccccggtaaaccccggg

SEQ ID NO: 163052 - DNA, 626 bp, Homo sapiens
  misc_feature: GYAE6OF02F97T9.34.86.H09.1.454.CMB.1.raw
  modified_base (232)..(232): a, c, t, g, unknown or other
  misc_feature (232)..(232): n is a, c, g, or t
  modified_base (325)..(325): a, c, t, g, unknown or other
  misc_feature (325)..(325): n is a, c, g, or t
tcagtacacgtgatcacgaccggtgctcgatttagtgctatagacttgggtttgggggtgggcacaagaggcagcactcaggacaatctccagcatggcctggtctcctctcctcctcactctcctcgctcactgcacagggtcctgggcccagtctgtgctgacgcagcccgccctcagtgtcgtcggggccccagggcagacgggtcaccatctcctgcacgtggggacncagcctaccaacacgtcggggactaggttactgtatcgtacacgtggtaccaagcacgtcttaccgaacggaaccaccgacccccaaactccnctactctatcgactaaccactaacgtccggccctcgacgggtccctacgacgtcttcgtcgtcggtacctacgtaacgtccgtcgacctaccgtcgaccgtccctcccgtcggaccctactaccgacgtcgggtcccgtccgggacgtgggaagtagtcggacggtctagtatttacgttacgtcgtacttcgttccgttcgactcgtcgacgtacgtgtacgttgtacttaggttccgttacgtacgggaacgttacggaaccgtacggtccctaccggtcgtacgtccgaccgaccccg

SEQ ID NO: 163053 - DNA, 890 bp, Homo sapiens
  misc_feature: GYAE6OF02HRT7R.34.86.H09.1.454.CMB.1.raw
  modified_base (140)..(140): a, c, t, g, unknown or other
  misc_feature (140)..(140): n is a, c, g, or t
tcagtacacgtgatcacgaccggtgctcgatttagtgctatagacttgggtttgggggtgggcacaagaggcagcactcaggacaatctccagcatggcctggtctcctctcctcctcactctcctcgctcactgcacgngggtcctgggcccagtctgtgctgacgcagcccgcctcagtcgtccgtcggggccccagggcaggacggtccacctagtcctccgtgactacggtaggggacgcacgcctaccaacgtggtccgggggctaagggtttactggaattcggtaactaaccgttcggtaaacaaggtcctacgtaccgttaacccgaacgggtaaacccaacccggtaacccccctaaaaccgttcccttacaacgttcctaagtaccgaaccttaaaccaacccgtaacgtcccggtaccccgttacgggaaccgggttccccgtagtacccgtactttccgacgtcgtaccgttaccgaacgttccggaccgtaccctaccgtacccgaccccgtaccccggttccggacccgtaccgttaccgtacccgggtcggggtaccgggttcccggtacgtaacggggttacggtaacgggtacgggttaacggtacgtttaaccgggttaacgttttaaccgttttaaccggttacgttaccggtttaaccgtttacccggtttacggtaaccgaccggtaaccgttaccggtaccgttaacggttcgttcggtttacctttaccggttaaccggtttacccgggtttaccgggtaaaccggttacccggggtaaacccggtttaaaccggttaccccgggttaacccgttaaccccggggttttagaaaccccggttacccggtacccccggaaaccccggg

SEQ ID NO: 163054 - DNA, 758 bp, Homo sapiens
  misc_feature: GYAE6OF02IJRVS.34.86.H09.1.454.CMB.1.raw
  modified_base (160)..(160): a, c, t, g, unknown or other
  misc_feature (160)..(160): n is a, c, g, or t
  modified_base (180)..(180): a, c, t, g, unknown or other
  misc_feature (180)..(180): n is a, c, g, or t
  modified_base (237)..(237): a, c, t, g, unknown or other
  misc_feature (237)..(237): n is a, c, g, or t
  modified_base (266)..(266): a, c, t, g, unknown or other
  misc_feature (266)..(266): n is a, c, g, or t
tcagtacacgtgatcacgaccggtgctcgatttagtgctatagacttggggtttgggggtggcacaagaggcagcactcaggacaaatctccagcatggcctggtctcctctcctcctcactctcctcgctcactgcactagggtcctcgggcccagtcngtgctgacgcacgccgcctnagtcgtcggtaccgggcccctagggacacggacgggtccaacctagtcctaccgtcncacgtaggacggtcagtcctaccgaacgnggttccggggatacggttaatcgtaacgtcgtaacctacggtaacgtaaccacggctaacgtccttaccgaacggtaaccaccgaccccttaaactccgtatacttcgtaacgtccgtaactaaaccgaaccgacgtccccggtaccgttaccggggtaccggttaccccaggtaccccgttaagttcttcccggtcgtaccttaacgtaactcgtcggaacccttccgtacgtaccgtcccgtacccgtacgcccttaacgaccgtacgggtccggcccgggttaacggtcggtggtaaccggtgtaacgtccggttattcgttaacgtttaacctttcgggtacctaacggtttccgtttaaccgtaggactacgtaccgtaaacggtcgtacgtaggttcgtactttgtcgttaccggtaccggtacgggtcccggtaactaccgggttaccctacggacccgtttacgaccccgttacggaaccccgg

SEQ ID NO: 163055 - DNA, 757 bp, Homo sapiens
  misc_feature: GYAE6OF02JLO0I.34.86.H09.1.454.CMB.1.raw
  modified_base (699)..(699): a, c, t, g, unknown or other
  misc_feature (699)..(699): n is a, c, g, or t
tcagtacacgtgatcacgaccggtgctcgatttagtgctatagacttgggtttggggctgttcctggaagctgcttgtaccagagggtcaccatctcctgcactgggagcagcctccaacagtcggggcaggttatgatgtacactggtaacaagcagtcttaccgaaggaaccacgaccccctaaactcctacattcctaatcgacctaaacaccgaagtccggaccccgtcgaaccggggttcccctaggacccgtattccgtacgtcggaccttccgtaacggttcctaggacctaccctacgtaccggtccccttcccgtaggacccctaattaccccgtacgggttccggggtccccgttacccggggacttacggggaaacgggttactacggggtaacggtccgtttaaggtttaaaccttttacgttaaccgttcggttaccgttaaccgggtttccgtttaacgaacgtaccgacgttaccggtccgtaggtaacgtcgttaaacgttaccgtgttaccggtacggaacgtaccgggaacctacgtccgttaccgtacgtaggtccaccgtaccgacgacccgtacctcgtactacgtctaccgttacgtaccctcctccgacttacgtactcggttactaccgtcggaacggtcgtcggacggtaccgacgtacgtcgtaacgtcgacnctacgtactcgagtctacggctacgcgtaccagttccgagtacaaccgctcgtaagtg

SEQ ID NO: 163056 - DNA, 664 bp, Homo sapiens
  misc_feature: GYAE6OF02JXTSV.34.86.H09.1.454.CMB.1.raw
  modified_base (177)..(177): a, c, t, g, unknown or other
  misc_feature (177)..(177): n is a, c, g, or t
  modified_base (181)..(181): a, c, t, g, unknown or other
  misc_feature (181)..(181): n is a, c, g, or t
  modified_base (185)..(185): a, c, t, g, unknown or other
  misc_feature (185)..(185): n is a, c, g, or t
  modified_base (547)..(547): a, c, t, g, unknown or other
  misc_feature (547)..(547): n is a, c, g, or t
  modified_base (595)..(595): a, c, t, g, unknown or other
  misc_feature (595)..(595): n is a, c, g, or t
  modified_base (630)..(630): a, c, t, g, unknown or other
  misc_feature (630)..(630): n is a, c, g, or t
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
  modified_base (642)..(642): a, c, t, g, unknown or other
  misc_feature (642)..(642): n is a, c, g, or t
  modified_base (645)..(645): a, c, t, g, unknown or other
  misc_feature (645)..(645): n is a, c, g, or t
  modified_base (649)..(650): a, c, t, g, unknown or other
  misc_feature (649)..(650): n is a, c, g, or t
  modified_base (652)..(652): a, c, t, g, unknown or other
  misc_feature (652)..(652): n is a, c, g, or t
  modified_base (657)..(658): a, c, t, g, unknown or other
  misc_feature (657)..(658): n is a, c, g, or t
  modified_base (662)..(664): a, c, t, g, unknown or other
  misc_feature (662)..(664): n is a, c, g, or t
tcagtacacgtgatcacgaccggtgctcgatttagtgctatagacttgggtttgggggctgttcctggaagctgcttgtaccagagggtcaccatctcctgcactgggagcagctccaacagtcggggcaggttatgatgtacactggtacagcagctcaggacacgccccaatccnctanctangactaacacctaatccggccctcggacgggtcccctagacctacttccgtacttgaccgtaccgaagtccgtacggccacctcgtacgtccccttaccgtcggacctactaccgtaccggttaccgggtccgtaccggggtccttacgggtaggaacgttcggacggtaccgttagtaacgttttacgttaccttggttaccgtaggtttactttacgaagtaccggactaccgtacgtgtaacgtctaccgtttgttacgttcgtacggaaccgtacggaactacggtaccctacgtcggtacgtcgaaccgaccgtaccgaccctaccctcgtcgtaccaccgttccgcccgtttacccncccttacctaccgtacgttaccgacgttaccgtacgtcggtaaccggngggtccgacggacgtacgaccgtacgtagtacganagtcgncngtancgngcanncncgcgnncgtnnn

SEQ ID NO: 163057 - DNA, 732 bp, Homo sapiens
  misc_feature: GYAE6OF02FICIV.34.86.H09.1.454.CMB.1.raw
  modified_base (240)..(240): a, c, t, g, unknown or other
  misc_feature (240)..(240): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacagggtcctgggcccagtctgtgctgacgcacgcccgccctcagtgtcgtcggggccccagggcagagggtcaccatctctgcacgtgggancacgcctaccaacgagtcggggtacaggttatagatgtacacgtaggtaacgaacgcacgtccttacgaacggtaaaccgaccgaaccccctaaacttccctactacttactacttacggaccttaaaccaacccgtaacgtacccggtacccttacgtaccggggttacccctacggaacccgtacgtttccgttaccgtacggtaccttaccgtaacggttccgtcgggaccttaacccgacgtacccgtcccgttcccgtcgtaccctaacgtacccgtcggtaccgggtcccgttaccgggcgtacggacgggtaacgtgggtaacgtaccggttattaacgtttacgttaccgttcgtacgtttaccgtttaccgtttaacgaccggtgtacccgtacggtaccgtacggttaccggtcgtttaacgtttacgttccggtttaaaccggtttccgggtaaccggttacgggttacccgtaaaccggg

SEQ ID NO: 163058 - DNA, 620 bp, Homo sapiens
  misc_feature: GYAE6OF02IJI11.34.86.H09.1.454.CMB.1.raw
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (568)..(568): a, c, t, g, unknown or other
  misc_feature (568)..(568): n is a, c, g, or t
tcagtacacgtgatcacgaccggtgctcgatttagtgctatagacttgggtttggggctgcttcagctgtgggcacaagaggcagcactcaggacaatctccagcatggcctggtctcctctcctcctcactctcctcgctcactgcacgtagggtcctgggcccagtctgtgctgacgcagccgccctcgagttcgtcgtcgggggccccagggcaggaggtccacctgtcctcgtgcngtaggganacgcaccaagacgtcggggactaggttatgatgtgctattcggaaccacgacgtccttacgaaggaaccacggacccctaaactccctatacgttctacgacggtcgaacaactaacgtccggacccctagacggggtaccctgggacccgtacttcgtacgtggtacctacgaacgttcgtcggccttccacgacgtccctccgtaccggtccacgtctaccggacggttccgtaccgacggtccgtggaaggtcgtagggtacggctagttacgttttacttacgtacgtccgttacgtcttagacgtaagacggtcnccgtagtcctttagtacttgttccgtaccggagtaccggtacggtactccgg

SEQ ID NO: 163059 - DNA, 519 bp, Homo sapiens
  misc_feature: GYAE6OF01DTOJQ.8.1.A01.1.454.CMB.1.raw
  modified_base (389)..(389): a, c, t, g, unknown or other
  misc_feature (389)..(389): n is a, c, g, or t
tcagctcgcgtgtccacgaccggtgctcgatttagacgtctcatcagggggtgggctcaggaggcagagctctgggaatctcaccatggcctggaccctctcctgctccccctcctcactttctgcacagtctctgaggcctcctatgagctgacacagccaccctcggtgtcagtgtcccaggacaaacggccaggatcacctgctctggagatgaattgaccaaaagaaatatgcttattggtaccagcagaagtcaggccaggcccctgtcctggtcatttatgaggacaagaaacgccctcggatccctgacagactctctggctccagctcgagggacagtggccacttgactatcacgtgggcccaggtggagatggaagganactactattgttactctaccagagaaggatggtacatcagttgggtgttcgggcggagggacaggctagaccgtctaagtcgacgacccaaggcctcgcccctcggtcacgtctcgttccccgccctccg

SEQ ID NO: 163060 - DNA, 544 bp, Homo sapiens
  misc_feature: GYAE6OF01C807P.8.1.A01.1.454.CMB.1.raw
  modified_base (290)..(290): a, c, t, g, unknown or other
  misc_feature (290)..(290): n is a, c, g, or t
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgaattgaccaaaagaaatatgcttatggtaccagcagaagtcaggccacggcccctgtcctggtctatttangaggacaagaacgccctcggatccctgacagactctctggcctcagctcgagggacagtcggccctacttgactagtccacgtcggggcccgagggtcggaggagtaggaaggagactacttattcgttactctaccgagagaaggatggtcatctagttgggtgtcgggcgggaggaccgagcgtcgaccgtcctagtcgacgcccgacggcctccgccccgtcggtcctactcgtccgttcccgccctcccg

SEQ ID NO: 163061 - DNA, 563 bp, Homo sapiens
  misc_feature: GYAE6OF01C0NKP.8.1.A01.1.454.CMB.1.raw
  modified_base (286)..(286): a, c, t, g, unknown or other
  misc_feature (286)..(286): n is a, c, g, or t
tcagctcgcgtgtccacgaccggtgctcgatttagacgtctcatcagggggtgggctcaggaggcagagctctgggaatctcaccatggcctggacccctctcctgctcccctcctcactttctgcacagtctctgaggcctcctatgagctgacacagccaccctcggtgtcagtgtccccaggacaaacggccaggatcacctgctctggagatgaattgaccaaagaaatatgctttatggtaccagcagaagtcaggccaggcccctgtcctggtcatttangagacaagaacgcctcggatccctgacagactctctgctcagctcgagggacagtcggccaccttgactatcacgtggggcccaggtcggaggagtaggaaggacgtaacttaactattgttactcttaccgaagagaacggtataggtcaagttcgaagtttggggtagttcgggcggtacgggaccaggcgtaggacccgtctaagtcgacgacccaaggcctaccgtccccccgtcggtaccctaccttcttaccgttccccgtacccttcccg

SEQ ID NO: 163062 - DNA, 514 bp, Homo sapiens
  misc_feature: GYAE6OF01EOWV3.8.1.A01.1.454.CMB.1.raw
  modified_base (287)..(287): a, c, t, g, unknown or other
  misc_feature (287)..(287): n is a, c, g, or t
  modified_base (368)..(368): a, c, t, g, unknown or other
  misc_feature (368)..(368): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
  modified_base (488)..(488): a, c, t, g, unknown or other
  misc_feature (488)..(488): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtcccaggacaaacggccaggatcacctgctctggagatgaattgaccaaagaaatatgcttattggtaccagcagaagtcaggccaggcccctgtcctggtctatttangaggaacaagaaaccgcccgtccgggatccctgacagactctctggctccagctcgaggacagtcggcctacttgacttanctacgtcgggccaggtggaggataggaaggagactactattagttactctacgagagaagntggnatcgtagttggtggttcggacggaggacgaagcgtgaccgtctaagcagccagcncgccctcgtcactctctcccgctccg

SEQ ID NO: 163063 - DNA, 645 bp, Homo sapiens
  misc_feature: GYAE6OF01CTF29.8.1.A01.1.454.CMB.1.raw
  modified_base (238)..(238): a, c, t, g, unknown or other
  misc_feature (238)..(238): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagatgaattgaccaaaagaaatangcttatggtaccagcagaagtcaggccaggcccctgtcctggtctatttagtagaaggaaaagaaaccgacccgtaccgggatccctagacagacctctctggctccagctcgagggacaggtcggccaccgttgacctatcctacgtcggggcccgagggtacggaaggagtaggaaaggagtaactacgttaatttcgttactctaccgtaagacggaaggtatggtactagtcgtaagtttggggttcggttcggggacgggtaacggggaccaacgggtctacgggtacccgtaccgtaaacggttaccgaacggacccgaacgggtccttcccggaccccccgttcggtaccctaccgttcccgttacccggttcccccctaccccgttcccgtaaccccgg

SEQ ID NO: 163064 - DNA, 533 bp, Homo sapiens
  misc_feature: GYAE6OF01EZ1IE.8.1.A01.1.454.CMB.1.raw
  modified_base (429)..(429): a, c, t, g, unknown or other
  misc_feature (429)..(429): n is a, c, g, or t
  modified_base (523)..(523): a, c, t, g, unknown or other
  misc_feature (523)..(523): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaaagaaatatgcttattggtaccagcagaagtcaggccaggcccctgtcctggtcatttatgaggacaagaaacgaccctccgggatcccgtgacagactctctggctccagctcgagggacagtcggccacttgactatcacgtcggggcccaggtgggaggagtaggaaggagtactactattgttactctcagagaagntgcatctagtgggtgttcgggcgggaggaccaagctcggaccgtcctaagtcgacgcccaacggctccgcccctcggtcactcctcgttccccncccgttcccg

SEQ ID NO: 163065 - DNA, 631 bp, Homo sapiens
  misc_feature: GYAE6OF01BRGW4.8.1.A01.1.454.CMB.1.raw
  modified_base (285)..(285): a, c, t, g, unknown or other
  misc_feature (285)..(285): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtcccaggacaaacggccaggatcacctgctctggagatgaattgaccaaagaaatatgcttattggtaccagcagaagtcaggccaggccctgtcctggtcatttangagacaagaaaccgccctccgggatcccgtgacagactctctggctccagctcgaggacaggtcgcctacttgactatcacgtcgggacccgagggtcggaggacgtaggaaggacgaacttacttaagtttacgttacctccgtaccgaaggtaacgaagggtagtggtccaagttccgtaagtttggggtcggttcgggacgggaacgggtaccaacgggtcctacggtacccggttacgtaaacggttccgaacggtaccccgaagggtcccgtacccggccccccgttaccgggttccctaaccgttcccttcccggttccccccggcccccgttaccccgg

SEQ ID NO: 163066 - DNA, 664 bp, Homo sapiens
  misc_feature: GYAE6OF01EWVSH.8.1.A01.1.454.CMB.1.raw
  modified_base (287)..(287): a, c, t, g, unknown or other
  misc_feature (287)..(287): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaaagaaatatgcttattggtaccagcagaagtcaggccaggccctgtcctggtcatttangaggacaagaacgaccctcgggactcctgacagactctctggctccagctcgagggacaggtcggacctaccgttgaacttactcgaccgtcgggggaccccgtagggtggagggagtaggaaagggtaacgaacgttaacgttaagtttacgtttaacctccgttaccgaaggaaggaaggtatacgggtacacttacgtaaggtttcggggttggtttccgggacgggtaacggggtaaccgtaacggccgttacggtacccggttaccgtaaacggtaccgaacggaccccggaacgggtcccgtaccggtacccccccgttcgggttaccctaccgttcccgttacccgtttccccccgaccccgttaccccg

SEQ ID NO: 163067 - DNA, 661 bp, Homo sapiens
  misc_feature: GYAE6OF01A6DLF.8.1.A01.1.454.CMB.1.raw
  modified_base (287)..(287): a, c, t, g, unknown or other
  misc_feature (287)..(287): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagcccaccctcggtgtcagtgtcccaggacaaacggccaggatcacctgctcgtggagatgaattgaccaaaagaatatgcttattggtaccagcagaagtcaggccaggccctgtcctggtcatttangaggacaaggaaccgacccgtcgggactccctgacagactctcgtcggctcgagctacgagggacacggtcggccctaccgttgaaccttataccgacggtcgggggcccaaggggtcggaagggacgtaggaaaggagtactaacgttaagtttacgttacctctaccgaggtaaggaaggagttgggtacctagttaccgtaagtttcgggggttacgttcggggaccggggtaacgggaacccgtaaggtccgtacggtacccggttaccgtaacggttccgaacggtaccccgaagggtccctacccgggtccccccgttcgggtaccctacccgtttaccgtcccggtttccccccgcccgttaccccg

SEQ ID NO: 163068 - DNA, 733 bp, Homo sapiens
  misc_feature: GYAE6OF01DLOSV.8.1.A01.1.454.CMB.1.raw
  modified_base (181)..(181): a, c, t, g, unknown or other
  misc_feature (181)..(181): n is a, c, g, or t
tcagctcgcgtgtccacgaccggtgctcgatttagacgtctcatcgagggggtgggctcaggaggcagagctctgggaatctcaccatggcctcggacccctctcctcgcctccccctcctctactttctgcacagtctctgacggcctcctatgagctgacacgacgcccacccgtggtntcgacgtccgtacccgaaggaaccgaaaccggccgaaggactccgacctcggcctacgtaggagtatagtaagttacgaaccgaaaaagtaattagtcgtacgtttaagttacggaacccagacgaaggaacggtcgacgggccgaccggtccccttggtccctggtacttaagtttagacgaacggaaccaaacgaacccggtcccggtacggtactccgagaacacgtaccttcgcgtcgacctaccgagtctacgggaggaccgcggtccggtaacctaccgttagacccgttagtaccgaccgggtccggggacgtagggacggtagggtaacagggaacgtacgtaacgttattactttcgtacctcgaacgaaggtacgaggtacttacggactagtggtacgggtttgggtaccggtcgggaacgggtaacggaactacgtacgtacggtaccgtacggtaacgccgtaccggacccgtcgtccccgtcccggtaccccgttaccgtccttacccgttacgtcccccgttcccctccggtacccg

SEQ ID NO: 163069 - DNA, 654 bp, Homo sapiens
  misc_feature: GYAE6OF01BU44I.8.1.A01.1.454.CMB.1.raw
  modified_base (289)..(289): a, c, t, g, unknown or other
  misc_feature (289)..(289): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagcccaccctcggtgtcagtgtcccaggacaaacggccaggatcacctgctctggagatgaattgaccaaaagaaatatgcttattggtaccagcaagaagtcaggccaggccctgtcctggtctatttangagacaaagaaaccgacccgtcgggactcccgtagacacgactctctcggcctccgagctacgacgggacacggtcggccctacgttagacttatcgacggtcggggcccgagggtggagggtagtaggaagggtagtaacttacttagtttgttacctcgttaccgaagtaaggaagggtagttggtactaagtcgttaggtttggggtggttcggggacgggtacgggtacgaacggtccgttacggacccgttacgtaaacggtccgaaccggacccgaacgggcccgttaccccgaccccccggttcggtaccccgtacctttaccccgttcccggtttccccccgtccccgttaccccgg

SEQ ID NO: 163070 - DNA, 857 bp, Homo sapiens
  misc_feature: GYAE6OF01DGVKI.8.1.A01.1.454.CMB.1.raw
  modified_base (126)..(126): a, c, t, g, unknown or other
  misc_feature (126)..(126): n is a, c, g, or t
tcagctcgcgtgtccacgaccggtgctcgatttagacgtctcatcagggggtgggctcaggaggcagagctctgggaatctcaccatggcctggacccctctcctgcctccccctcctcactttcngcacagtctctgacggcctcctatgagctgacacacgccacccgtcggtgtcagtccgtaccccgaggaaccgaaaccggccaggactccaccgtcgctcgtaggagtagtagtaattacgaccaaaaagtaatatgtactttaagtcggtaccagacgagaagtcgacggccacggtcccctagtccgtggtctaattacgtgaacggacaaacgaaacccgcccgtaccgggactccccgtagaaccgagtaaccttcgtcgtcggaccttaccgacgccgtacggaacgggactacggaccggtacccttaacgttcggtaacctaacggttcccgacgggttaccgggggccccgtaagggggttacgggaagggtaacggttaacggggaaaacggttaaacggtaaccgtttaaacgtttaaccgtttaacggttttacccttaccggtaacccgttaaggaaacgggaaagggtttacgtacgggttaccgtaacgtttacgggttaacgggtttagggggtttaccggggttaccggggaaccggggtaaacgggtaaccgtaacgggtacccggttaccggttaaccccgggtaccgtaaaccggttacccggaaaccgtacccccgggtaaacggtccccggtacccccgggtacccccttacgggtacccctacccgtttcccgtacccccggttttccccccgacccgttaacccccgg

SEQ ID NO: 163071 - DNA, 697 bp, Homo sapiens
  misc_feature: GYAE6OF01A5BZ8.8.1.A01.1.454.CMB.1.raw
  modified_base (215)..(215): a, c, t, g, unknown or other
  misc_feature (215)..(215): n is a, c, g, or t
  modified_base (289)..(289): a, c, t, g, unknown or other
  misc_feature (289)..(289): n is a, c, g, or t
  modified_base (337)..(337): a, c, t, g, unknown or other
  misc_feature (337)..(337): n is a, c, g, or t
tcagctcgcgtgtccacgaccggtgctcgatttagacgtctcatcagggggtgggctcaggaggcagagctctgggaatctcaccatggcctggacccctctcctgctcccctcctcactttctgcacagtctctgaggcctcctatgagctgacacagccaccctcggtgtcagtcgtccccaggacaaacggccaggatcacctgctctgganatgaattgaccaaagaatatgcttattggtaccagcaagaagtcaggccacggcccctgtcctggtctatttangagacaagaaccgcccgtcgggactccctgacagtactctcgtcggcnccagcctacgagggacacggtcggccctaccgttgaaccttacacgaccggttcgggggaccccgtaggggttgggaacgggtagtaacgggaaacggggtaacgtaacgttaacgttagttttaccgttaaccgttcccgtaaccgaaggtaaacgggaagggtaacgttcgggtacctaaggttaccgttaaggttttggggggttaccggttccgggggtacgggggtaacgggaaccgtaacggccgttacgggtacccgttaaccgtacgtaccgaccggacccgaacggtcccgtacccgtcccccgttcggtaccctacgtcccgtttcccgttcccccctaccccgttcccg

SEQ ID NO: 163072 - DNA, 982 bp, Homo sapiens
  misc_feature: GYAE6OF01C78WW.8.1.A01.1.454.CMB.1.raw
tcagctcgcgtgtccacgaccggtgctcgatttagacgtctcatcagggggtgggctcaggaggcagagctctgggaatctcaccatggcctggacccctctcctgcctcccccctcctcactttctgcacagtctctgaggccctcctatgagctgaccacacgccaccctcggtgtcagtcgtaccccaggaccaaacggccaggactcacctgctcgtggagatgaattgaaccaaagaaatatgtacctttagttacggtaaccaggacaagtaacgtaccgacgggcccgaccggtccccttggtcccgtttgggtctttaagttttagtcggaaacgggaaaccaaaaccggtaaaccccggacccccggttaccggggaccttccccgttacgaaccgacggtacccttccgttccgtccggccttacccaacggtccttacgggaaccggggtaactaccgggtccggaacccccgttaaccgtttacgtaacccgtttaaacgtaccccggtaaccggggttaccccgggggggtaccccgtaaaggggggttacggggaaacggggtaaacggttaacggggaaaaccgggtaaccgtttaaaccggttaaacggttttaccgtttttaaccggttttaacccttacccggtaaacccggaaagggttaaggaaacggggtttacgttttaaccgggtaccgtaacggtttacccggttaaggggttttaccggggggttaggggtttacccgggggtaaccgggggaaaccccggggtaacgtaacccgggggttacccgttaaccccggggttaacccccgttaaacccgttaaaccgggttacccgaacccgggggtaacccctaaaccggggtccccttaccccccgggttacccccggtcccgggtttaaaccttccccgtttaacccgggtttcccgtttacccccgttccccggttaaccccccg

SEQ ID NO: 163073 - DNA, 947 bp, Homo sapiens
  misc_feature: GYAE6OF01AHVIE.8.1.A01.1.454.CMB.1.raw
tcagctcgcgtgtccacgaccggtgctcgatttagacgtctcatcagggggtgggctcaggaggcagagctctgggaatctcaccatggcctggacccctctcctgctccccctcctcactttctgcacagtctcgtgacgtcctctagtgacgtctacgaaccacgaccgcccgtacccgttcggtcgtacgtacgtccgtaccccgaaggaaccgaaaccgggcccgaaggtacctaccgtaccgttcgtccgttacggtaggaagtagttacgtaacgttaccgaaaccgtaaaagtaaacttacgttacgttaccgtttaaggttaccggaaccgacggacgaaacggtaacgtccggaaccggtccccgaccggtccccgtttgtcccggttaggttacttaagtttacggaacgggaaacggaaaaccgtaaacccgggtaaaccccggtccccggtttaccgggaaccttcccggtaacggtaccgtaaaccggttccctttccggttccgaacgggttccctaacggtaccgtaccggtacgggaacggtacgtcccggtaccggtacccttaccggtacgtaccgttaacggtcccggtaccggggtccggggtaaccggtagggtacggaaggtaaccgtaagggtaacggtaaccgttaacgtttaaccgttagtttccgtaacccttccgaagggaacgtacggtaaggtcgttacggtaccttaacgtttcgggttacgggttcggggttacgggaaccgggtacgggaacggtaacccttacgggtcccgtaacccgggtaccttaaaccggtaccggacccgtaaaccggacccccgggtaacggttccccgtacccccgggttcccttaccccggttccccttacccgggttccccccttaccccggttccccgaccccccgtaaccgggg

SEQ ID NO: 163074 - DNA, 827 bp, Homo sapiens
  misc_feature: GYAE6OF01C79J3.8.1.A01.1.454.CMB.1.raw
  modified_base (127)..(127): a, c, t, g, unknown or other
  misc_feature (127)..(127): n is a, c, g, or t
  modified_base (231)..(231): a, c, t, g, unknown or other
  misc_feature (231)..(231): n is a, c, g, or t
tcagctcgcgtgtccacgaccggtgctcgatttagacgtctcatcgagggggtgggctcaggaggcagagctctgggaatctcaccatggcctcggacccctctcctgcctccccctctcactttcngcacagtctctgacggtcctctatgagctgacacacgcccacccgtggtgtcagtcgtaccccgaaggaaccaaaccggcaaggtatccacctgctcgtagganatagtaattgaaccaaaaagtaatatgactttagttacggaaccagactaaggaagtaccgaacggcccacggtcccccttgtacccgtaggttactaagttttaagacggaaacggaaaccgtaaaacggaaaaccccgtcccccggtacggggaacttaccccgaagaacccgtaacgtaccttacgtccgtaggtccctaccgaacgaccgtacggaagggtaaccagggtacccggaccctaacgtttagaaccttaacgcccggtaaccgggtacgggggaccccgtagggtaggaagggaagtaacgggaaagtacgtaaccgttaacgttaacgtttacgttaccgtaccgttaacgaaggtaagtaaggtagtacgggttactaacgttcggtaaggtttcggggttaacgggttccggggaacgggtaacgggtaaccgtaacgggtacccgtaaccggttaacccggtaccgttaaacggtacccgaaaccggtaccccgaacggtcccgtaccccggtccccccggttacggttaccctaacccgttcccgtttacccgtttaccccccgaccccgttaccccgg

SEQ ID NO: 163075 - DNA, 856 bp, Homo sapiens
  misc_feature: GYAE6OF01B1IMB.8.1.A01.1.454.CMB.1.raw
tcagctcgcgtgtccacgaccggtgctcgatttagacgtctcatcagggggtgggctcaggaggcagagctctgggaatctcaccatggcctggaccctctcctgctcccctctcactttctgcacagtctctgacggtcctcctatgagctgacacagccacccgtggtcgtcagtcgtaccccgaggaaccgaaaaccggccaaggactccacctggcctcgtggaagatagtaacgttacgaaaccgaaaagtaaattagtagtactttagtacggtaccagacgaaggtaacgtcgaacggtccgaccggtccccttggttaccgtggtaccttaagttttagaggaacgaaccgaaaacggaacccgtacccggtaccggtactacccgtagaacgaacgtcctacgtcgtacgcctacgacgtaccgtacggacggtacgtacgggtccgtaccgttaaccgttacgaacttaccgtaacgtacccgggttacggggacccgggtagggtacgggaacggaaggttaacggaaacgggtaacgtaaccgttaagtttaccgtttacggttaccgtacgtaacggtaacggaaggttaacggtagttcggtaactacggtttacgtagggttttcggggtacgggttaccgggtacgggtaacgggtaaccggtacggtacccggttaacgggttaacccggttaccgtaacggtacccggttaacccggaaccccgggttacggttcccccggttacccccgggtaccccccgttacgggttaacccccgtaacccggtttccccggtttacccccgggtttccccccgtacccccggttaaaccccggg

SEQ ID NO: 163076 - DNA, 592 bp, Homo sapiens
  misc_feature: GYAE6OF01E47S8.8.1.A01.1.454.CMB.1.raw
  modified_base (299)..(299): a, c, t, g, unknown or other
  misc_feature (299)..(299): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctcgtggagatgaattgaccaaaaagaaatatgctttaagttggtaccagcaagaagtcaggccacggcccctgtcctggtctatttagnggagaacaaagaaaccgcccgtcgggactcccgtgaccagactctctggctccgagctcgaggcaggtcgaccacttgactgccacgtcgggacccgaggtggaggagtaggaaggagtaactactagttacgttactctaccgagagaaggtatgtcatcgtagttgggttggttcgggacggacgggaccgaacgcgtacggtacccgtaccgtaacgtaccgacgacccgaacggccgtccgcccccgtcggtcctaccgttccgttcccgttcccccgccccgttcccg

SEQ ID NO: 163077 - DNA, 811 bp, Homo sapiens
  misc_feature: GYAE6OF01DV423.8.1.A01.1.454.CMB.1.raw
  modified_base (130)..(130): a, c, t, g, unknown or other
  misc_feature (130)..(130): n is a, c, g, or t
  modified_base (135)..(135): a, c, t, g, unknown or other
  misc_feature (135)..(135): n is a, c, g, or t
  modified_base (177)..(177): a, c, t, g, unknown or other
  misc_feature (177)..(177): n is a, c, g, or t
  modified_base (340)..(340): a, c, t, g, unknown or other
  misc_feature (340)..(340): n is a, c, g, or t
tcagctcgcgtgtccacgaccggtgctcgatttagacgtctcatcaggggggtgggctcaggaggcagagctctgggaatctcaccatggcctcggacccctctcctcgcctccccctcctctactttcngcacngtctctgacgcctctatgagctgacacacgcccacctcggtntcacgtcgtacccaggaaccaaaccggccaaggtactccaccgtgctcgtggaagatagtaattacgaacctaaaagtaattagtagtactttagttacggtaaccaagacaaggaacgtcgacggcccaccggtcccttggttcctggtacttagtttacgnggaacggtaacaaacggaaacccggcccgttaccgggactcccgtagaactacgtaccgttcgtaccgtcggccttaccgacgtcgtacggaacgggacacgggtccggtaccctaacgttacggaaccttacgtccggtacgggtaccggggacccggtaggggtacgggagggtaacggtaagggtaaacgggtaacgttaacgtttaacgtttaacggtttacgtttaaccgttaccgtaaccggtaaggtaaacggtaacgggtacgttaggtaccttaagttaccggttaggggtttcggggttaccgggttaccgggggaaccgggtaacgggaacccgtacggtaccggtaaccggtacccggttaaccgtaacggttacccgaacggtacccgaaccggtccgtaccccgtccccgttaccggtacctaccctccgttacccgtcccctacccgttacccccg

SEQ ID NO: 163078 - DNA, 890 bp, Homo sapiens
  misc_feature: GYAE6OF01D3JHA.8.1.A01.1.454.CMB.1.raw
  modified_base (221)..(221): a, c, t, g, unknown or other
  misc_feature (221)..(221): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagcccaccctcggtgtcagtcgtccccgaggaccaaacggccaggactcacctgctcgtgganatagaattacgaccaaaagaatagtgtactttagttacggtaccaagacaaggaacgtccgaacggtcccgaacggtcccccgttggtcccgttagggtaccttaagttttacgtacgggaaacgggtaaaccgaaaaccggtaaaacccggtacccccggttacccggggtaaccttacccccggttaggaaccctacggtaaccctttccgtccgttacgggtccctaccgtaaggtcccgttacggaacggggtacctacgggtaccgggtaccccttaaccgtttacgtaacccgttacgtacccggtaaccggggtaccgggggtaccccgtaagggggttaccgggaagggtaacgttaagggaaacgggtaacgttaaccgttaacgtttacgttttaccgttaaccgttacccgttaccggaaggtaacgggtaacggttaggttacggtactaacgttcgttaagggtttcgggggttacggttacgggggtaccggggaacgggtaacccgtaagggtcccgttaaccggtacccgggttaaccgtaacggtaacccgaccggtaacccgacgggtccccgtaccccggtacccccgttacccgggttaccctacccgtttcccggttcccccggttcccccgtccccgttacccccgg

SEQ ID NO: 163079 - DNA, 838 bp, Homo sapiens
  misc_feature: GYAE6OF01A2BAF.8.1.A01.1.454.CMB.1.raw
  modified_base (124)..(124): a, c, t, g, unknown or other
  misc_feature (124)..(124): n is a, c, g, or t
  modified_base (216)..(216): a, c, t, g, unknown or other
  misc_feature (216)..(216): n is a, c, g, or t
tcagctcgcgtgtccacgaccggtgctcgatttagacgtctcatcaggggggtgggctcaggaggcagagctctgggaatctcaccatggcctggaccctctcctgctcccctcctcactttcngcacagtctctgaggcctctatgagctgacacagcctacccgtcggtgtcagtcgtccccaggacaaacggccaggatcacctgctctgganatgaattgaccaaagaatatgcttaatggtaccagcaagaagtcgacggccacggccctgtcctggtactatttacgtaggaacggaaccgaaagaaacccggacccgtaccggggactacccgtagaacagtactctcgtcggcctaccaggtcctacggaacgggactacggtacggtcctaacctttacggtaacttacgtaccgtaaaccgggttcggggggaaccccgtaaggggttacgggaacgggtaacggttaagggtaaaacgggaacggtaaaccgtttaaacgtttaacgttttaacgggtttaaccttacccggtttaacccgaaacggggtaaagggtaaacgggtaggttaacgggttaccgtaaacgttaccgtttaaggggttttaccggggttacggggtttaccggggaaccggggtaacgggtaaacccggaaacgggtccgttaaccggggtaacccgttaaccgttaaaaccgggttacccgaaaccgggtacccccggaaacgggttccccttaccccggggtacccccccgttacggggttaacccctaccggttaacccgtttacccgttacccccgtaacccccgtttaaccccgg

SEQ ID NO: 163080 - DNA, 743 bp, Homo sapiens
  misc_feature: GYAE6OF01C7GZM.8.1.A01.1.454.CMB.1.raw
  modified_base (127)..(127): a, c, t, g, unknown or other
  misc_feature (127)..(127): n is a, c, g, or t
  modified_base (132)..(132): a, c, t, g, unknown or other
  misc_feature (132)..(132): n is a, c, g, or t
  modified_base (156)..(156): a, c, t, g, unknown or other
  misc_feature (156)..(156): n is a, c, g, or t
tcagctcgcgtgtccacgaccggtgctcgatttagacgtctcatcagggggtggctcaggaggcagagctctgggaatctcaccatggcctcggacccctctcctgcctccccctcctctactttcngcacngtctctgacggtcctcctatgacncgtacgaccacgacgccctacccgtcggtgtccacgtccgtaccccgaaggaaccgaaaccggccaaggtactcctacctcgtctcgtagggatataggaacttacgaacaaaagtaattgtacgtactttagtacggtaacagtacgaacggaacgtcgacggacccgaccggtccccgttgttcccgttggtaacctttaagttttaggacggaaacggaacgtaaaaccgtaaacccgtccccggtacggtaccttacccgagaacctcgtactcgtcgtacggtcctaccgacgtcgtaacggacgggacctacggtaccgacccttacgttaacgaccgttacgtccgaacgggttcccggggaaccgttaggggaacgaggtacgtaagggacggtaacttacgttaacgttagtacgttaacgtcgaaccgtaagggacgttaaggtcgtacggactagttcgttaggttcgggtcgtacgggacggtagaacctacggtctacgaccgtaagtaccgtacgacgtaccgacgtccctaccgcccgtacgtctaccgtcctcccggtcccctcgtacccg

SEQ ID NO: 163081 - DNA, 956 bp, Homo sapiens
  misc_feature: GYAE6OF01EG814.8.1.A01.1.454.CMB.1.raw
  modified_base (131)..(131): a, c, t, g, unknown or other
  misc_feature (131)..(131): n is a, c, g, or t
tcagctcgcgtgtccacgaccggtgctcgatttagacgtctcatcagggggtgggctcaggaggcagagctctgggaatctcaccatggcctggacccctctcctgcctccccctctctactttctgcacngtctctgacgcctctatgagctgacacacgcccacccgtcggtgtcaggttccgtaccccgaaggaaccgaaaaccgggccaagggtactaccgacccgttggtccttacgggtagggaaagtagttaacgggtaaactttaccgggaaaaccctaaaaaaggtaaaactttagttacggttaacctttttaacggtttaccggggtaaacccaagggtaccgaaaagggttaaaccggtccggaaaccggggaccccgtaaccggggtcccccccgttggttccccgtttagggtaacctttaagttttaacgacgggaaacgggtaaaacccgaaaaccggtaaaaccccggtccccggtaccggggtaccttaccccgtaagaaccgacgtaccttccgtcgtaccggacctaccgacgtcgtacggaacgggactaacggtcccgaccttaacgttcgaacgttacgccggtaaccgggtccggggaccggtagggtacgggaaggtagtaaggaaacgggtacgtaaccttaagtttactttacgttaccgtccgtaacggaggtaaggtaacggtagtcggtaacgaagtttccgggttaggttcggggttacgggttaccggggaacggggtaaccgggaacgtacggtaccgtaaccggtaccgttaaaccggtaaccgggtaccgaaacccgggtaccccgtaacggggtccccccgttaccccgggtaccccccgtttaccggggttaccccttaaccccggttacccccgggtttcccccggtttcccccccggtaccccgttaaccccccggg

SEQ ID NO: 163082 - DNA, 708 bp, Homo sapiens
  misc_feature: GYAE6OF01DIH7V.8.1.A01.1.454.CMB.1.raw
  modified_base (343)..(343): a, c, t, g, unknown or other
  misc_feature (343)..(343): n is a, c, g, or t
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagccaccctcggtgtcagtcgtcccaggaccaaacggccaggatcacctgctcgtggagatgaattgaccaaaagaaatatgtacttagtggtaaccagcaagaagtcaggccaggtccctgtctggtctattatagaggactaaagaaccgtacccgtcgggatcccgtgacacgactctcgnggacctcgagctacgagggtcaggtcggccctacttgactagtcacggtcggggcctagggtaggaggtagtaggaaacgggacgtaacttaacgttagtttacggtttacctaccgtacccgtaaggtaacggaaaggttacgttacgggttacctagttaccgtaagggtttacgggggttacggtttaccgggggacgggttaacccggggaaccctacggtaccggttaccggtaaaccccggttccgttaaacggttacccggacggtaaccccggaacgggtcccgtacccgggtccccccgttacggtaccctaccgttcccgtttacccggttacccccctaccccgtttaccccgg

SEQ ID NO: 163083 - DNA, 840 bp, Homo sapiens
  misc_feature: GYAE6OF01AXW9G.8.1.A01.1.454.CMB.1.raw
  modified_base (130)..(130): a, c, t, g, unknown or other
  misc_feature (130)..(130): n is a, c, g, or t
  modified_base (134)..(134): a, c, t, g, unknown or other
  misc_feature (134)..(134): n is a, c, g, or t
tcagctcgcgtgtccacgaccggtgctcgatttagacgtctcatcgagggggtgggctcaggaggcagagctcgtgggaatctcaccatggcctcgacccctctcctcgcctccccctcctctactttcngcangtctctgacgtcctctagtgagtctacgacacgaccgtaccctacccggttcggtacgtctacggtccgtaccccgaaggaaccgaaaccggccgtaaggactccgtaccgtgtccgtacggtagggaacgtagtacggtaacgttaaccgaaaaccgtaaaagtaaattcgtacggttaccgttttaagtaccgggtaaccaggtacgaaaggtaccgtcggaccggtccgtaccggtccttcgtcgttgtacttaagttacggacggacgaaccgtaaaccggaaccccgtccggtccgtacctaccgtagacctaccgtacgttccgtcggtccgacctaccgacggtaccggtacggaacggtaccgtaacggtcccgtaccttaccggtaacgtaccgtacgtaccggtaaccgggccgggtacggtagggtacggaacgggtagaaccgggtaacgttaccgtaaacgtttaccgtttaggttaccctaaccgttacgtaacgggaaggaaaccgggttacgtacggtttacgacgtttacggttaaggttcgggggtttcgggtaccggggttaaccgggaagggttacccgaagttccgggaactttacccggtaacgtacgtagtaccccgggacctacggcccgtcccgtccccgtacgtccctacgtcccttacctcccgtccccgtctacccgg

SEQ ID NO: 163084 - DNA, 890 bp, Homo sapiens
  misc_feature: GYAE6OF01D2ICF.8.1.A01.1.454.CMB.1.raw
  modified_base (172)..(172): a, c, t, g, unknown or other
  misc_feature (172)..(172): n is a, c, g, or t
  modified_base (191)..(191): a, c, t, g, unknown or other
  misc_feature (191)..(191): n is a, c, g, or t
  modified_base (808)..(808): a, c, t, g, unknown or other
  misc_feature (808)..(808): n is a, c, g, or t
tcagctcgcgtgtccacgaccggtgctcgatttagacgtctcatcgaggggggtgggctcaggaggcagagctctgggaatctcaccatggcctcggacccctctcctgcctccccctcctctactttctgcactgttctcgtggacggtccctctatgagtctcgaccacncgcccctaccgttcgggtntcacggtccgtacccgaaggacccgaaacggcctaaggactccaccgtgctcggtaggagtactaagtaacgttacgaaaccgtaaaagtaaattcgttacgttaacgttttaacgttaacgggtaacccaggtaaccgtaaagggtaccgtaacccggaacccggggtacccgtaccgggtcccccgttacggttaccgttcgggtaactttaaaggttttaacggacgggtaacgaaaccgtaaaaccggaaccccggttaccccggtacgggtaccttcccgtaagaacccgtacgtaccttccgtacgtcggtacctccgaggttccctaacggggacgtctacgggtcccacccttagtcaacgttcgtacccggtcggggtacccgggtacgggagggttaacggggacgttaagggtacggaagggtactacgtttaacgttacttaccgttccgttacgtaaccggaggaagtaggtaacgtttgacgttcgttaggtttccggggttcggggttaacggggttaccggggtaacgggaacgggtacccggtagggtccccggttaacgtaacccgttacggtacccggaccgacccggggttaacccnccgggtcccccgtacccgggtccccgttaccgggttccctacccgtttacccctaccccggtcccccgttaccgtaccccgg

SEQ ID NO: 163085 - DNA, 1078 bp, Homo sapiens
  misc_feature: GYAE6OF01EM584.8.1.A01.1.454.CMB.1.raw
  modified_base (119)..(119): a, c, t, g, unknown or other
  misc_feature (119)..(119): n is a, c, g, or t
  modified_base (125)..(125): a, c, t, g, unknown or other
  misc_feature (125)..(125): n is a, c, g, or t
  modified_base (153)..(153): a, c, t, g, unknown or other
  misc_feature (153)..(153): n is a, c, g, or t
  modified_base (164)..(164): a, c, t, g, unknown or other
  misc_feature (164)..(164): n is a, c, g, or t
  modified_base (172)..(172): a, c, t, g, unknown or other
  misc_feature (172)..(172): n is a, c, g, or t
  modified_base (183)..(183): a, c, t, g, unknown or other
  misc_feature (183)..(183): n is a, c, g, or t
tcagctcgcgtgtccacgaccggtgctcgatttagacgtctcatcgagggggtgggctcaggaggcagagctctgggaatctcaccatggcctcggaccctctcctgcctcccctctcnctttcngcactgtctctgacgtcctcctatgacnctacgacgacncgtacccncccgtcgggtntaccgtacggtaccgtaccccgaagggaaccgaaaaccgggtcccgaaggacctacccgtaccgtcgtccgtacggttagggaagtactaggtaacgttaaccgaaaccggtaaaagtaaacttacggttacgttaacgtttttacggtaaccgggtaaccacggttaaacccgaagggttaaccgtaccggaaccgggtaccccgtaacccgggttccccgttaacccggtccggtttaccggttacttttaaggtttaaccgggaacggtaaaaccgggaaaccgtttaaaacccgaacccgggtttaccccgggtaaccccgggaaccttttaccccggacgtaaacccggtaccgttaccgtaccggttccgggtacccaaccgttaccggaacgggttaccgaacccgggggtaaaaggtacccgggttccgggtaccccgtttaaacccctttacggggtaaaaccctttccggtaaaccccggtccggggttacccgggtaacccgggggttaaccgggtaaggggggtaacggttaaacggaaacccggggttagggtaaaaaccggttaacgttaaaccggtttaactttaaccgggttttacccgtaccgtaaaccggttaccgtaaaggaaagggttacccgtaggttacgttacgttaccgggttcgggtttaacgtttcggggggtaccgtaacggggtaccggggaaaccgttacccggtaacgacccgggtttaacggttacccgtaaaaccccgggtaacgggtaacccgttaacccgggtaaccccgtaacgggtccccccggttaccccgtacccgttaacccgtttccccggttaacctttaaccccggttcccctacccccggtccgtaaccccg

SEQ ID NO: 163086 - DNA, 845 bp, Homo sapiens
  misc_feature: GYAE6OF01AGF2J.8.1.A01.1.454.CMB.1.raw
  modified_base (127)..(127): a, c, t, g, unknown or other
  misc_feature (127)..(127): n is a, c, g, or t
  modified_base (175)..(175): a, c, t, g, unknown or other
  misc_feature (175)..(175): n is a, c, g, or t
  modified_base (189)..(189): a, c, t, g, unknown or other
  misc_feature (189)..(189): n is a, c, g, or t
  modified_base (356)..(356): a, c, t, g, unknown or other
  misc_feature (356)..(356): n is a, c, g, or t
tcagctcgcgtgtccacgaccggtgctcgatttagacgtctcatcagggggtgggctcaggaggcagagctctgggaatctcaccatggcctcggacccctctcctgcctccccctctactctttcngcactacgtctctggacgtcccttccgtatggacgtctcgacacgacnccctacccgtggtntcgtagtccgtacccgaggaaccaaacggccaaggtctacctaccgtgacgtcgtagggactcttagaacttcgaactaaaagtatacgtgttactttagtacggaccaaggacaaggtaacgtcgacggccctacggtacccttcgtccgtagtacttattaaggngaacgaacgaaacggaacccgtcccggtaccgtaacgtccgtaacacggaccgttccttacggtccgtacgccgttacccgagtaccggtagggaaccggacgtacgtccgtaccgttactacggtaacttagcccggtaccgggtaccgggtacggttaggacgggaagttaaccggaggtaaccgggttaacccctagttttaaacgttccggttacttcccgtttaacccaagggaaacggttacgggaaaggtttcccctagggttaacctacggttttaaaggtttccgggggacgggggttttaccgaaccgggggacggggttacgtaaaccgaccggttcggtttaaaccccggtaaccggttcgtaaaccggaccccggttaacgggaaccccgttcggggtaaccccggttcccccggttaacctcgtaccccgtttacccgttccgttaccccccgggtcccgtaccgttaacccccg

SEQ ID NO: 163087 - DNA, 736 bp, Homo sapiens
  misc_feature: GYAE6OF01A1I6A.8.1.A01.1.454.CMB.1.raw
  modified_base (130)..(130): a, c, t, g, unknown or other
  misc_feature (130)..(130): n is a, c, g, or t
  modified_base (157)..(157): a, c, t, g, unknown or other
  misc_feature (157)..(157): n is a, c, g, or t
  modified_base (431)..(431): a, c, t, g, unknown or other
  misc_feature (431)..(431): n is a, c, g, or t
  modified_base (676)..(676): a, c, t, g, unknown or other
  misc_feature (676)..(676): n is a, c, g, or t
tcagctcgcgtgtccacgaccggtgctcgatttagacgtctcatcgagggggtgggctcaggaggcagagctcgtgggaatctcaccatggcctcggacccctctcctgcctccccctcctctactttcngcacagtctctgacgccctctagtganctagacacgaccgccctaccgtggtctcgacgtccgtacccgaaggaaccgaaccggccgagactccgaccgtgtcctcgtaggatagtaagtacgtacgaacgtaaaagtaatgtacgttcttaggtcgtaaccgagtacaaggtaccgtacgaccggcctaccggtcccttcggtccgtagtacttagttagacggtaacgacgtaaaccgtaacccggccgtaaccgggacttccgaggtactaccgtacgtcgttacgccggtctaccgngtacgtacgaaggtaccgtcgtaccgtactacgttacacgtacggtcggaccggtaccgggacggtaggacggaggtaacgtaggaacgtaataaccttaagttacttacggtacctacggtaacgaggtaacgtacgtagtacggtagtacgtaaggttcgggtacggtagggttaccgggaaccggtaacggaaccgtacgtacgaaccggttaccgtaaccgtacgtaacgccgggtacccncggtaccccgttccgacccgtcccgttactacccgtcgtacccctcccgtcccgtacccg

SEQ ID NO: 163088 - DNA, 857 bp, Homo sapiens
  misc_feature: GYAE6OF01ACMG2.8.1.A01.1.454.CMB.1.raw
tcagctcgcgtgtccacgaccggtgctcgatttagacgtctcatcgagggggtgggctcaggaggcagagctctgggaatctcaccatggcctcggacccctctcctgcctccccctcctctactttctgcacagtctctgacggtcctcctatgagctgacacacgcccacccgtcggtcgcacgtcgtaccccgaggaaccaaaccggcgaaggactccacctgcctcgtggagagtagtaattacgaaccaaaagtaaattagttcgtacctttaggttacgtaaccagacgaaggtaacgtcgtacgtccgaccggtccccttacgtccgtggtacttaactttacgacggtaacggaaccaaaacggaaaccccgtccccggtaccgggtaacctccccgtagaaccgtacgtaccctaccgtcgtccggtcccgtaccgtcgtaccgtaccgggaacggggaacctacgggtccggtacccttaccgttacgtaaccctaccggtccgtaccgggtaccggggtacccgtaggggtaggggactaacgggtaagggaaacgggtacttaacccgttaagttcttttaacccggacctttaccgaaccggtaagggaaacgggttacgttacgggttactactaaccggtttggttaccgggtttagggggtcggttaccggggggtaacgaccggggtaaccgtaacgggtacccgttggggtaacccccgttaaaccgtaggacccgtaaccccggtaaccgggtaccggttccccacccccggggttcccccgttcgtaacccccttcgttaccccggttccccctaacccggtccccgttaaccccgg

SEQ ID NO: 163089 - DNA, 749 bp, Homo sapiens
  misc_feature: GYAE6OF01CMF47.8.1.A01.1.454.CMB.1.raw
tcagctcgcgtgtccacgaccggtgctcgatttagacgtctcatcagggggtgggctcaggaggcagagctctgggaatctcaccatggcctggacccctctcctgcctccccctcctctactttctgcacagtctctgacggccctactatgagtcgtagacacgacgtcccacccgtggtacgtcgagtccgtaccccgaaggaaccaaaccgggcgaaggtactccaccgtgtctcgtaggactagtacggtaattacgaacctaaaagtaaatagtacggtactttagtacggtaaccagacgtaaggaactccgacggtaccacggtccctgtactggtactaatttagacggaagtaccaaacggaacccgtacccgtaccggactcccgtagacgacgtactcgtaccgtgacctaccgagtcctacggaacggtctacggccgaccttacgtcgtaaactcgtaccgtacggacggggcctagggaacggacggtaagtacggaaacgtacgtactaacgtttaacgttcgtaactccgtaacaaggtacgtaaggtacgtcggtaactacgtaacgttaggggttacggtacggtacggggaaccggttaaccggaaccgtacgtacggtacccgttaaccgaccgttaagacccgaacggttaacccggaacttcccgggaacccgttccccggtaacgtcctaaccccgttcgtccccgttacccccgcgttaccccg

SEQ ID NO: 163090 - DNA, 854 bp, Homo sapiens
  misc_feature: GYAE6OF01BPB33.8.1.A01.1.454.CMB.1.raw
  modified_base (127)..(127): a, c, t, g, unknown or other
  misc_feature (127)..(127): n is a, c, g, or t
tcagctcgcgtgtccacgaccggtgctcgatttagacgtctcatcagggggtgggctcaggaggcagagctctgggaatctcaccatggcctggacccctctcctgcctccccctcctctactttcngcacagttctctggacggtccctcctagtgagtcctgaccacgaccgccctacccgttcgggtcgtcgtaacggtccgtaccccgaagggtaaccgaaaaccgggccgaacggtactaccgacctcggcttacgtagggaatagtagtaacgttacgaaacctaaaagtaacttgtacggttactttaacggttcggtaaccgaggacgtaaggtaacgtcggaaccgggtcccgaaccggtcccgtttagtcccggttaggttacttaggtttagacggaacggaacgaaaaccggtaacccggtcccggtaccggtacctccgagtaccgtatccgtcttcggtcgtccgtaccgagtccgacggaaggtaccgtacggtaccgtaccgtaacttacgacttaccggtccggacgggtaccgggccggtaggggtagggtaagggtacgtaacgggaacggttaactaaccggttttactttacgtttaccggtttacctaccgttaacggaacggtaaggtaacggtacgtttacgtacgttacgttcggtttacgggtttacggggtacggggttaaccggggacgggtaaccggaccggtaacggttcccggtacggttaaacccgtacgtaaccggtaccgaccggtaccgtacccggtccgtcccccgttaccgtccggtaccttacccggttccctacccttcccccgtactaccccgg

SEQ ID NO: 163091 - DNA, 509 bp, Homo sapiens
  misc_feature: GYAE6OF02ISF3Z.8.1.A01.1.454.CMB.1.raw
tcagctcgcgtgtccacgaccggtgctcgatttagacgtctcatcaggggtgggctcaggaggcagagctctgggaatctcaccatggcctggacccctctcctgctcccctcctcactttctgcacagtctctgaggcctcctatgagctgacacagccaccctcggtgtcagtgtccccaggacaaacggccaggatcacctgctctggagatgaattgccaaagaatatgcttattggtaccagcagaagtcaggccaggcccctgtcctggtcatttatgaggacaagaaacgaccctccgggatccctgacagactctctggctccagctcagggacagtggccacttgactatcactggggcccaggtggaggatgaatgagactactattgttactctccagagaaggatggtcatcagtttgggtgttcgggcggagggaccaagctgaccgtcctaaggtcagccaaggctcgcccctcggtccactctcgtcccgtccc

SEQ ID NO: 163092 - DNA, 562 bp, Homo sapiens
  misc_feature: GYAE6OF02HJAZT.8.1.A01.1.454.CMB.1.raw
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaaagaaatatgcttattggtaccagcagaagtcaggccaggcccctgtcctggtcatttatgaggacaagaaccgaccctccgggatccctgacagactctcgtggcctccgagcctcgaggggacaggtcggacctaccttgactatcacgtcggggacccagggtggaggataggaaggagaacgtacttattcgttactcgtaccgagagaaggtatggtactagtcgtagttgggtgttcgggcggacggaccgaagcgtgaccgtcgtaagtcgaacgcccgaaggcctccgccccgtcggtccaccgttcctcgttccccaccctcccg

SEQ ID NO: 163093 - DNA, 664 bp, Homo sapiens
  misc_feature: GYAE6OF02GTXRT.8.1.A01.1.454.CMB.1.raw
  modified_base (171)..(171): a, c, t, g, unknown or other
  misc_feature (171)..(171): n is a, c, g, or t
  modified_base (214)..(214): a, c, t, g, unknown or other
  misc_feature (214)..(214): n is a, c, g, or t
  modified_base (292)..(292): a, c, t, g, unknown or other
  misc_feature (292)..(292): n is a, c, g, or t
tcagctcgcgtgtccacgaccggtgctcgatttagacgtctcatcagggggtgggctcaggaggcagagctcgtgggaatctcaccatggcctggacccctctcctgctccccctcctcactttctgcacaggtctctgagcctctatgagctgacacagccacctcggtntcagtgtcccaggacaaacggcaggatcaccgtgcctctgganatgaattgaccaaagaatatgtactttagttggtaaccaggcagaagtcaggccaggcccctgtcctggtcatttagngaggacaacgaaccgcccgtcgggatcccgtgaccagtacctactctggcctccgagcctacgagggactaggtcggaccctacgttgaaccttacgtccgacgttcggggaccctaggggtacggaagggtagtagggaaagggacgtaacgttaacgttagtttacggttactcgttaccgaggacgaaggtatcggtactattacgtagtttcggggtacgttcgggacgggtaacgggaaccgaaggtccgttacggtaacccggttaccgtaacgggtaccgaaccgggtaccccgtaagggcccgttacccggcccccgttacgggttaccaccgttccttccggtttaccccccacccttacccg

SEQ ID NO: 163094 - DNA, 517 bp, Homo sapiens
  misc_feature: GYAE6OF02F2ANK.8.1.A01.1.454.CMB.1.raw
  modified_base (424)..(424): a, c, t, g, unknown or other
  misc_feature (424)..(424): n is a, c, g, or t
  modified_base (448)..(448): a, c, t, g, unknown or other
  misc_feature (448)..(448): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaaagaaatatgcttattggtaccagcagaagtcaggccaggcccctgtcctggtcatttatgaggacaagaaaccgaccctccgggatccctgacagactctctggctccagctcagggacagtcggccaccttgactatcacgtggggcccaggtggaggatggaaggagactactattgttactctcagagaagntggtcatcagttgggtgttcgggnggaggaccagctgaccgtactagtcgagccaaggcctcgcccgtggtacctcctcgtcccgcctcctcg

SEQ ID NO: 163095 - DNA, 528 bp, Homo sapiens
  misc_feature: GYAE6OF02IQ7AX.8.1.A01.1.454.CMB.1.raw
  modified_base (288)..(288): a, c, t, g, unknown or other
  misc_feature (288)..(288): n is a, c, g, or t
  modified_base (427)..(427): a, c, t, g, unknown or other
  misc_feature (427)..(427): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaactgaccaaaagaaatatgcttattggtaccagcagaagtcaggccaggcccctgtcctggtcatttangaggacaagaaaccgccctcggatccctgacagactctcgtggctccagctcgaggacagtcggcctacttgactatcacgtcgggccagggtggaggagtggaaggagtactacttattgttactctacgagagaagntggcatctagttgggtgtcggacggaggaccaagctagaccgtctaagtccgagcccaaggcctccgccccgtcggtcacctcgtacgttccccgcctccg

SEQ ID NO: 163096 - DNA, 551 bp, Homo sapiens
  misc_feature: GYAE6OF02J07LZ.8.1.A01.1.454.CMB.1.raw
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
  modified_base (415)..(415): a, c, t, g, unknown or other
  misc_feature (415)..(415): n is a, c, g, or t
  modified_base (427)..(427): a, c, t, g, unknown or other
  misc_feature (427)..(427): n is a, c, g, or t
tcagctcgcgtgtccacgaccggtgctcgatttagacgtctcatcaggggtgggctcaggaggcagagctctgggaatctcaccatggcctgggctctgctcctcctcaccctcctcactcagggcacagggtcctgggcccagtctgccctgactcagcctccctcgcgtccggtctcctggacagtcagtcaccatctcctgcactgganccagcagtgattacaactntatctcctggtaccaacaacacccagcaaacgcccccaaactcatgatttttgacggtcaataagccggcctcagggtccctgactcgccttctcaggctcaagtctggcaacgacgtcctcctacgaccgtctcgtcggctccagactgacgtatgaggctgatttacgtactgcagtacctnattactcacggnagcaacgtggtattcggacggaggtacctaaggttcgaccgtcgtagtacgacggacctaacggctaccggtccccgtcggttacctacgttccgtaccggtttccccacccgttcctacccgg

SEQ ID NO: 163097 - DNA, 565 bp, Homo sapiens
  misc_feature: GYAE6OF02I7WP5.8.1.A01.1.454.CMB.1.raw
  modified_base (289)..(289): a, c, t, g, unknown or other
  misc_feature (289)..(289): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaaagaaatatgcttattggtaccagcagaagtcaggccaggcccctgtcctggtctatttangaggacaagaaaccgaccctcgggactccctagacagactctctggcctccagctcgagggacagtcggcctaccgttgactatccacggtcggggcccgagggtggaggagtaggaacggagactacttattgttactctacagagagagtgtactatgtagttgggtgtcgggacgggacgggacgaagtcgtacgtaccgtaccgtaggtaccgacgaccgacgtccgtcccgtcccgtcgtctccgtccgttcccgtaccctcccgtacccg

SEQ ID NO: 163098 - DNA, 520 bp, Homo sapiens
  misc_feature: GYAE6OF02F71WT.8.1.A01.1.454.CMB.1.raw
  modified_base (289)..(289): a, c, t, g, unknown or other
  misc_feature (289)..(289): n is a, c, g, or t
  modified_base (318)..(318): a, c, t, g, unknown or other
  misc_feature (318)..(318): n is a, c, g, or t
  modified_base (513)..(513): a, c, t, g, unknown or other
  misc_feature (513)..(513): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctactgaggcctcctatgagctgacacagccaccctcggtgtcagtcgtccccaggacaaacggccaggatcacctgctctggagatgaattgccaaagaaatatgcttattggtaccagcagaagtcaggccaggtcccctgtcctggtcatttangaggacaagaaacgccctcgggatcccgngacagactctctggctccagctcgagggacaggtcggccacttgactatcacgtggggcccagggtcggaggatggaaggagactatattgtactctcagagaggatggtcatcagttgggtgttcgggcggaggaccagctgaccgtctaagtcacgcccaacggcctcgcccctcggtctactctcgttcccncctcccg

SEQ ID NO: 163099 - DNA, 700 bp, Homo sapiens
  misc_feature: GYAE6OF02IYLTF.8.1.A01.1.454.CMB.1.raw
  modified_base (215)..(215): a, c, t, g, unknown or other
  misc_feature (215)..(215): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganatgaattgaccaaaagaaattatgtacttaattcggtacccaagtcaaggaagtcacggccacggcccctgtcctggtctatttatggaggacaagaaaccggaccctccgggactcccgtagacagtactctcgtggccttccagtcctcgacgggacaggtcggaccaccttagactatcgacgtcggggcccgagggtggaggagtaggaagggaagtaccgtacttagtttacgttaccttacctaccgaaggtaaggtaaaggtacgtaggtaccgtaattaccggttaagggtttcggggttggttaccgggggtacggggaaccggggtaaccgtaaacggtaccgtcggtaaaccccggttccgtaaacggtcccgaacgggtaacccccgaaagggtccgttaaccccggtcccccggtaaccggttcccgtaaccgttcccgttcccggtttacccccctacccccgttaccccg

SEQ ID NO: 163100 - DNA, 527 bp, Homo sapiens
  misc_feature: GYAE6OF02FNBAO.8.1.A01.1.454.CMB.1.raw
  modified_base (287)..(287): a, c, t, g, unknown or other
  misc_feature (287)..(287): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaaagaaatatgcttattggtaccagcagaagtcaggccaggcccctgtcctggtcatttangaggacaagaaacgccctccgggatccctgacagactctctggctccagctcagggacagtggccacttgactatcactggggcccaggtggaggatggaaggagactactattgtactctcagagagatgtcatcagttgggtgttcgggcggaggaccaaggctcgaccgtcgtagtcgacgacccgtaaggccgtcgcccccgtcggtcctaccgtcgtccgttccccaccctcccg

SEQ ID NO: 163101 - DNA, 545 bp, Homo sapiens
  misc_feature: GYAE6OF02F6AR0.8.1.A01.1.454.CMB.1.raw
  modified_base (290)..(290): a, c, t, g, unknown or other
  misc_feature (290)..(290): n is a, c, g, or t
  modified_base (366)..(366): a, c, t, g, unknown or other
  misc_feature (366)..(366): n is a, c, g, or t
  modified_base (537)..(537): a, c, t, g, unknown or other
  misc_feature (537)..(537): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaagaaatatgcttagttggtaccagcaagaagtcaggccacggcccctgtcctggtcatttangaggacaagaaacgaccctcgggactcccgtgaacagactctctgctccagctcgaggacagtgccacttgactancacgtcgggccaggtggaggagtaggaaggagtactaactattacgttactctaccgagagaagagtgtacatcgagttgggtgttcggacggagggtaccaagtcgtacgacgtactagtacgacgacccgaacggtcctcgccccgtcgtccgtactcgtccgttcccnccctcccg

SEQ ID NO: 163102 - DNA, 643 bp, Homo sapiens
  misc_feature: GYAE6OF02GOVHN.8.1.A01.1.454.CMB.1.raw
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (294)..(294): a, c, t, g, unknown or other
  misc_feature (294)..(294): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctcgtgganatgaattgaccaaaagaatntgcttattggaccagcagaagtcacggccacggcccctgtccgtggtactatttanggaggaacaaagaaaccgtacccgtccgggactcccgtagaacagacctcgtcgtggcctccgagcctacgacgggacaggtcggcctacttgactatcgacgtcggggaccctagggtacggaggtagtaggaaggtacgtaacttaacgttatttacgttactccgttaccgaagtaaggaaaggtagtacggtactagtcgtaaggtttggggttacggttcgggacgggtaacgggaccaacggtcgtacggtaccgttaccgtaacgtaccgacgacccgtacggcccgttcccggccccgttcgtaccgtaccttccggttcccgttccccgtcccgtacccg

SEQ ID NO: 163103 - DNA, 683 bp, Homo sapiens
  misc_feature: GYAE6OF02ITJ30.8.1.A01.1.454.CMB.1.raw
  modified_base (293)..(293): a, c, t, g, unknown or other
  misc_feature (293)..(293): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagatgaattgaccaaaagaatatgcttattggtaccagcagaagtcaggccaggcccctagtccgtggtactatttagngaggaacaaagaaccgccctcggactccctagaaccagtacctcgtcgtcggcttccgaaggcctacggaaggactacggcggacctacgttagaccttataccggaggtacccggggacccgtaagggtgggtaacggaaggttaacggaagggtaacggtaacttaacgttagtttacgtaacttcgtacaaggaagaaaggtactggacctagtaccgttaaggttcggggttacggtccggaacggggtaacggacccgtaaggtaccggtacgtaacccggttaccgtaacggttaccgaaccggtacccgtaacgggtaccctcccggtacccccgtacgttacccaccgtttcccgtaccggttccccccgtaccctacccgg

SEQ ID NO: 163104 - DNA, 616 bp, Homo sapiens
  misc_feature: GYAE6OF02G34F7.8.1.A01.1.454.CMB.1.raw
  modified_base (216)..(216): a, c, t, g, unknown or other
  misc_feature (216)..(216): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (349)..(349): a, c, t, g, unknown or other
  misc_feature (349)..(349): n is a, c, g, or t
tcagctcgcgtgtccacgaccggtgctcgatttagacgtctcatcagggggtgggctcaggaggcagagctctgggaatctcaccatggcctggaccctctcctgctccccctcctcactttctgcacagtctctgaggcctcctatgagctgacacagccaccctcggtgtcagtcgtccccaggacaaacggccaggatcacctgctctggagntgaattgaccaaaagaaatatgtcttattcggtaccagcaagaagtcaggccaggcccctgtcctggtacatttngaganaagaacgccctcgggactcctagacagactctctggcctcagctcgagggacngtcgcctaccttgactatcacgtcgggacccgagggtacggaggagtaggaacggtagaacttagttattcgttaactcgttaccaaggtacggaaggtgttaggtcaatcgtaaggtttcggggttggtttacgggcgggaacgggtaccgtaaaggtccgttgaacccggttctaacggtaccgaaccggtaccgaaccgggccttacccggccccgttaccggtcccgacctttcccgtccgtttaccccccgaccttccccgg

SEQ ID NO: 163105 - DNA, 570 bp, Homo sapiens
  misc_feature: GYAE6OF02G09VY.8.1.A01.1.454.CMB.1.raw
  modified_base (172)..(172): a, c, t, g, unknown or other
  misc_feature (172)..(172): n is a, c, g, or t
  modified_base (306)..(306): a, c, t, g, unknown or other
  misc_feature (306)..(306): n is a, c, g, or t
  modified_base (440)..(440): a, c, t, g, unknown or other
  misc_feature (440)..(440): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtntcagtgtccccaggacaaacggccaggatcacctgctctggagatgaattgaccaaagaaatatgcttattggtaccagcagaagtcaggccacggcccctgtcctggtcatttatgaggacaagaacgacccnccgggactccctgacagactctctggcctccagctgacggacagtcggcctaccttgactatcacgtcggggcccagggtcggaggagtacggaagggacgaacttactagttgttactctaccgagaggaagntggctagtcagttggggtgttacgggacgggtacggaaccgtagcgtacgaccgtacgtaggtccgtagacccaaggtccgtaccgccccgttcggtcctaccgtccgttaccgttccccgccctacccg

SEQ ID NO: 163106 - DNA, 729 bp, Homo sapiens
  misc_feature: GYAE6OF02GBTF8.8.1.A01.1.454.CMB.1.raw
  modified_base (308)..(308): a, c, t, g, unknown or other
  misc_feature (308)..(308): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggactcacctgctctaggagatagtaattcgaccaaaagaaattatagtactttaagttcggtaacccagtacgaagaacgtcgacggccacggcccctgtccgtggtntatttagaggagacaaacgaaccgaccgtacggactccgtagacacgtactctcgtcggtcctcacgtctacggacggacgtacggtcgacctaccgtagtactacgtccgaccgggtccgggaccggtagggtacggaaggtagtaacgggaaggaacgttaactaacgtttacgttcgttacctccgtaacgaaggtaaggtaacgtagttacgtacttagtaccggttagggtttcggggttagggttaccgggaacggggtaccggtaacgtaaccggtccgtaaccgggtacccgttaacgtaaccggacgaacccgggaacccgtacgggttaccccgtccccggttccccgtacccgggttaccctacccggtttccccggtttcccccggttcccccgtaccccgtacccggg

SEQ ID NO: 163107 - DNA, 801 bp, Homo sapiens
  misc_feature: GYAE6OF02IIK7H.8.1.A01.1.454.CMB.1.raw
  modified_base (248)..(248): a, c, t, g, unknown or other
  misc_feature (248)..(248): n is a, c, g, or t
tcagctcgcgtgtccacgaccggtgctcgatttagacgtctcatcagggggtgggctcaggaggcagagctctgggaatctcaccatggcctggacccctctcctgcctcccctcctcactttctgcacagtctctgacggcctcctatgagctgaccacgacgccctacccgttcggtgtccgaggttccgaccccgaggaaccgaaaccggccgaaggacttaccaccgttgccttcgtagggaanagttaggtaattcggaaccaaaaaggaaattatgttactttaagtacgggtaaccagtacaaggtaacgtcgacgggaccctacgggtccccttcggtccgttgggtactaagttttcgaggaacggaaacgaaacggaaacccggtccctaccgggtaattcccgtaaggaaccgacgtaccctcgttaccgtcggtccctaaccgcggtccgtacggaacgggacctaggtccggacctacccgttagactacgtaccgtacgggtccgggtaccgtaggggtacggacggtaagtacgggaaacggtacgtaaaccgtttaacgtaacgttttaggtacctaacccgttacgggaaaggtaacgggtaacggttacgttggtaaccgtacgttacggttcggggttacgggttcggggtaacgggacggggtaaccggaccggttaaacgcgggttaaccgtaccgtaccgggtaatacccggcggaaccgtacggtcctacccggtccgtaacggttctaccgtttccgtacccgtacccaccgttccg

SEQ ID NO: 163108 - DNA, 835 bp, Homo sapiens
  misc_feature: GYAE6OF02HYJT4.8.1.A01.1.454.CMB.1.raw
  modified_base (823)..(823): a, c, t, g, unknown or other
  misc_feature (823)..(823): n is a, c, g, or t
tcagctcgcgtgtccacgaccggtgctcgatttagacgtctcatcagggggtgggctcaggaggcagagctctgggaatctcaccatggcctggacccctctcctgccctcccctcctctactttctgcacagtctcgtgacggcctctagtgacgctacgaccacgaccgccctacccggttcggtgtccgtacggtcccgtaccccgaacggaaaccgaaaccggaccgaggactcccgaccgtcggtccttaggtagggatagtacgtaacgttacgaaaccgtaaaaagtaaattcgtacgttactttaggttccggtaaccaggacgtaaaggtacgtacggaccggaccgacccggtccccttagttccgttcggttactagtttagacggaacgtaaacaaaccggaacccgtccccggtaccggtaccttaccccgtaggaacctacggtaccttccgtacggtaccggcctaccgagtaccgtacgggaacgggtacctagggttcccgaacccgttacgttacgtaacttacggtacccgaccgggtcccggggaccgtagggtagggaacgtaggtaacggaagggacttaacgtttacgtacgttacgtttaccgtaccgacggtaagaacgggtaacggtgtcgtacgtacgttagggttaggtttggggtacgggaccgggtagggaaccggtaccgaacggtccgtaccggtacccggttaaccgtcggtaccgaacccggtaccggacgttcccgaccccgttcccggtacggtcccacccggtttacccgtccccgtttacccccnccgttaacccgg

SEQ ID NO: 163109 - DNA, 716 bp, Homo sapiens
  misc_feature: GYAE6OF02GEKUG.8.1.A01.1.454.CMB.1.raw
  modified_base (176)..(176): a, c, t, g, unknown or other
  misc_feature (176)..(176): n is a, c, g, or t
tcagctcgcgtgtccacgaccggtgctcgatttagacgtctcatcgagggggtgggctcaggaggcagagctctgggaatctcaccatggcctggacccctctcctgctccccctcctcactttctgcacagtctctggacggcctcctatgagctgacacagcccaccctcggtntacagtcgtccccgaggaccaaaacggccaaggactcgaccgtgcctcgtggagactgaaattcgaaccaaaagaaattatgtactttaagttacggtaccgagacgaagaacgtacgacggccgacggcccctgtccgtggtactatttagaggaggaacgaacgaaccggacccgtaccgggactcccgtagacgagtacctcgtcgtgtcctacgagcgtacgacggacaggtcgacctacgttagactagtacgaccggtcgggcccgtagggtacggacggagtaggaacggagtaccgttaacgttagttacgttaccgtccgttaaccgaggtaacgaaggagttaggtactaagtcgtaggtttcggggttacggttaccggggtacggtaacgggtaaccgtaaggtaccgtacggaaccgtttaccgtaacggtacgtaaccggtaacccgtaacggtcccgttacccggtaccccgttccggttaccgtcccgtttcccgttacccgttacccccgtacccgttacccg

SEQ ID NO: 163110 - DNA, 781 bp, Homo sapiens
  misc_feature: GYAE6OF02H31K2.8.1.A01.1.454.CMB.1.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
tcagctcgcgtgtccacgaccggtgctcgatttagacgtctcatcagggggtgggctcaggaggcagagctctgggaatctcaccatggcctggacccctctcctgcctccccctcctctactttctgcacagtctctgacggccctctatgagctgacacacgcccacccttcggtgtcagtcgccccgaggacaaaccggcaggactcactgcctgngganatagaattcgaaccaaaaagaatagtgtactttagttacggtaaccaggacaaggtaacgtcgaacggcccgaccgggtccccttggtcccgttgggtaaccttattttaacggacggtaaacgggaaaccgtaaaaacggaaccccgggtacccccgttaccggggaccctttaccccggagaaccggtaacgttacccgttcctccggtacgggtccctaccgtacgtccgtacggaacgggtaccgtacggtcggacccttacgttagaacttacgttccgaccgggtcggggtacccgtaggggtacgggacgggtaaggtacgggaaacgggtaacgtaacgtttaacgtttacgtttacggttttacctaccgtacggtaaggaacggtaaggtacgtacggtactaggttcgtaggggtttgggtacgggttacggggacgggtaacggaacgtacggtccgtacggtaccctacgtacgtccgacgtacccgtacggccgttacccgtcccgtacggtcctaccgtccgttcccgtccccgtcctacccg

SEQ ID NO: 163111 - DNA, 550 bp, Homo sapiens
  misc_feature: GYAE6OF02G3NIP.8.1.A01.1.454.CMB.1.raw
  modified_base (349)..(349): a, c, t, g, unknown or other
  misc_feature (349)..(349): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
  modified_base (472)..(472): a, c, t, g, unknown or other
  misc_feature (472)..(472): n is a, c, g, or t
  modified_base (498)..(498): a, c, t, g, unknown or other
  misc_feature (498)..(498): n is a, c, g, or t
  modified_base (542)..(542): a, c, t, g, unknown or other
  misc_feature (542)..(542): n is a, c, g, or t
tcagctcgcgtgtccacgaccggtgctcgatttagacgtctcatcagggggtgggctcaggaggcagagctctgggaatctcaccatggcctggacccctctcctgctcccccctcctcactttctgcacagtctctgaggcctcctatgagctgacacagcccaccctcgggtgtcagtgtccccaggacaaacggccaggatcacctgctctggagatgaattgaccaaaagaaatatgcttattggtaccagcagaagtcaggccaggccccctgtcctggtctatttatgaggacaagaaaccgaccctaccgggactcccgtagacacgactctctggcctcanctcgaggacagtcggcctaccttcgactactccgacgtacggggcccgagggtggaggagtaggaaggagactacgtattcgttactctcgagagagntgtanatctagttgggtgttcgggnggaggacagctcgaccgtctaggtcncgacccgaggtccgccgtcccgtcgtcctacgtccgtcgtcccnccctcccg

SEQ ID NO: 163112 - DNA, 763 bp, Homo sapiens
  misc_feature: GYAE6OF02I9WVZ.8.1.A01.1.454.CMB.1.raw
  modified_base (172)..(172): a, c, t, g, unknown or other
  misc_feature (172)..(172): n is a, c, g, or t
  modified_base (295)..(295): a, c, t, g, unknown or other
  misc_feature (295)..(295): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtntcagtgtccccaggacaaacggccaggatcacctgctctggagatgaattgaccaaaagaaatatgctttattggtaccagacagaagtcacggccacgggcccctgtcctggtctatttagnggaggacaagaaccgacccgtccgggactccctgacacgactctctcggctaccgagctacgaggacaggtcggacctacgttgaacctactacgaccggtcggggaccctaggggtacgggaaggtagtagggaaacgggagtaacctttaacgttagtttaccggtttaaccttccgttaaccggaaggaaagggtaaacgggtaacgttcggggtactaacgttccggttaagggttttcgggggttacggtttacccgggggaacggggtaacggggtaaacccgtaaggtcccggttaaccggtaccccggtttacccgttaacggtacccggtaacccggggtaaccccggtaaacggggtcccccgtttacccgggacccccccgttttacggggtacccttaacccggtttccccggtttaccccggttttaccccccccaacccggttttaccccccgg

SEQ ID NO: 163113 - DNA, 703 bp, Homo sapiens
  misc_feature: GYAE6OF02H5O0Y.8.1.A01.1.454.CMB.1.raw
  modified_base (173)..(173): a, c, t, g, unknown or other
  misc_feature (173)..(173): n is a, c, g, or t
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
  modified_base (289)..(289): a, c, t, g, unknown or other
  misc_feature (289)..(289): n is a, c, g, or t
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagcctaccctggtntcagtcgtcccaggacaaacggcaggatcactgctngganatgattgaccaaagaatatgtcttattcggtaccagcagaagtcgaggccacggcccctgtcctggtactatttanagaagaacgaaacgaaaccgtcccgtacggactcccgtagacacgacctctacgtcggcctaccgagtcctcggacgggacaggtcggaccctaccgttagaacctagtacccgacggtcgggggacccgtagggtagggacggaagtaggaagggtaacgtacttaacgttacgtttaggttacctaccgtaccgtaaggtaacgaaggtagtacggtaacctagttaccggttaaggtttcggggttacggtccggggacggggtaacgggtaacgtacggtaccggtacggtacccgtaccggttaacgtacccggacggtaccccggtaacggtcccgttaccccggacccccggttcggtacccttacccggttaccggttccctttacccccccgaccttacccccgg

SEQ ID NO: 163114 - DNA, 730 bp, Homo sapiens
  misc_feature: GYAE6OF02FRG91.8.1.A01.1.454.CMB.1.raw
tcagctcgcgtgtccacgaccggtgctcgatttagacgtctcatcagggggtgggctacaggaggcagagctctgggaatctcaccatggcctggacccctctcctgctccccctcctcactttctgcacagtctctgacggcctcctatgacgctgacacagcccacccgtcggtgtcagttcgtccccgaaggaccgaaaccggccgaggactccacctgctcgtggagatagaagttcgaccaaaagaatagtcgtactttagttcggtaaccagactaaggaacgtccgacggccgacggcccccttaggtcccgttcggttacctaagtttagtaggaggaacgaaacggaaaaccgccccgtaccgggacttcccgagaccgtacgtacctctacgtcggcctccgacgctacgacgggacgaggtcgaccgtacttagacttactccgtacgggccggggacccgtagggtacgggaaggtaggtaaggaaacgggtaacgtaaccgttaacgttacgttacgttaccgttaccgtacggaaaggtacggtaaaggtgtacgttacacgttcgtaggttcggggttacggtttacggggacgggtaacgggaacctaacggtcgtaccgaccgttaccgtaagtccgtaacggtaccgtaacgtcccgttcccggtcccgttccgtcgtacccgtccgtaccgttacccccacccgttcccgg

SEQ ID NO: 163115 - DNA, 764 bp, Homo sapiens
  misc_feature: GYAE6OF02FUFLK.8.1.A01.1.454.CMB.1.raw
  modified_base (300)..(300): a, c, t, g, unknown or other
  misc_feature (300)..(300): n is a, c, g, or t
tcagctcgcgtgtccacgaccggtgctcgatttagacgtctcatcagggggtgggctcaggaggcagagctctgggaatctcaccatggcctggacccctctcctgcctccccctcctcactttctgcacagtctctgacggcctcctatgagctgacacagccaccctcggtgtcagtcgtcccaggacaaacggccaggactcacctgctctggagatgtaattgaccaaaagaaatatgtcttattcggtaccagccaagaagtcaggccaggcccctgtccgtggtacatttacgngtacggacaaagaaccgcccgtcgggaactcccgtgacagtcctctacctggtcctccgagtcctacggacggggactacggtcgggaccctaacgtttacggaaccttagtccgaccgggtttccggggggaccccgtaagggggtttacgggaacggggtaactaacggggaaacgggtaaggtaaccctttaaacgttaacggttttacggttaacctttaccggtaacccgtaagggtaaggtaaacgggtacgggtttacgggtaccgttaaacgttcggtaaacggttttcgggggtttacggtttaccgggggtaccgggttaaacggggaacccgttaaaggccgtacccgtaaccggttaccgttaacggtacaaccggggtacccaaacgggtcccgttaaccgccccggttacggtaccgttaccttccgtaccgttcccctacccctcccgg

SEQ ID NO: 163116 - DNA, 673 bp, Homo sapiens
  misc_feature: GYAE6OF02HM5E9.8.1.A01.1.454.CMB.1.raw
  modified_base (242)..(242): a, c, t, g, unknown or other
  misc_feature (242)..(242): n is a, c, g, or t
  modified_base (303)..(303): a, c, t, g, unknown or other
  misc_feature (303)..(303): n is a, c, g, or t
  modified_base (646)..(646): a, c, t, g, unknown or other
  misc_feature (646)..(646): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgacgcctcctatgagctgacacacgccaccctcggtgtcagtcgtccccaggaccaaacggccaggatccacctgctcgtggagagtgaattcgaccaaaagaatntagacttatggtaccagcagaagtcaggccacggtcccctgtcctaggtcctaagttttanggaacgacgaaacgaaccgcccgtcgggaactcccgtagacctacacgtccttgcgcctcgagtcgtacgagggactaggcgtccctacgttacgacttagtaccgaccgtcggggtacccaggggttcggacggtagtagggaaggtacgtaacgttaactagtttccgttactccgttacgaaagtaacgaaacggtgttcgtactacgtcgttaaggtgggttacgttccggggagtaaaccgggtaacgacgtcgtacgggttaccctaccgtaccgtacgccggtaacccgttacggccttaaccccgcccccgttacgggttaccctccgtttaccncccggtttacccccgaccttaccccgg

SEQ ID NO: 163117 - DNA, 780 bp, Homo sapiens
  misc_feature: GYAE6OF02JHMHK.8.1.A01.1.454.CMB.1.raw
  modified_base (122)..(122): a, c, t, g, unknown or other
  misc_feature (122)..(122): n is a, c, g, or t
  modified_base (203)..(203): a, c, t, g, unknown or other
  misc_feature (203)..(203): n is a, c, g, or t
  modified_base (251)..(251): a, c, t, g, unknown or other
  misc_feature (251)..(251): n is a, c, g, or t
tcagctcgcgtgtccacgaccggtgctcgatttagacgtctcatcagggggtgggctcaggaggcagagctctgggaatctcaccatggcctggaccctctcctgctcccctctcactttcngcacagtctctgaggcctcctatgagctgacacagccacctcggtgcagtcgtcccaggacaaacgccagactcactgctnggactatgattcgaccaaaagtaactgagtacttacgtacggtaaccngactaaggaacgttcgacggaccctacgggtccccttagttcccgtaggtacctaagtttacggtacggaacggaacgaaacggtaaccgtacccggttccgggaacttcccgtaggacacggtacctcgtcggtacgctaccgacggtctaacgtcggaactacggtcggactaccgttaggaactacgtaccgtacggtaccgggtaccgtaacgggtcgggtaacggtaaggtaacgggaaacgggaccgtaacgtttaaaccggttcgtttaacgggtttaccctaccggttaacgtaaccgggttaagaaacgggttcttaaacgggcgttaaccgtacgttaacgggtttccggggtaacggttcgggaaaccgggtacggtaaccggtaagttaccggaaccgttaaacccgtttacgtaaaccggtaccgtaaaccgggccggttaacggcccgtttaacccgtcccggttacggtacctaccgtacccggtttccgttaacccccggccggtttaccccg

SEQ ID NO: 163118 - DNA, 816 bp, Homo sapiens
  misc_feature: GYAE6OF02I86VT.8.1.A01.1.454.CMB.1.raw
  modified_base (163)..(163): a, c, t, g, unknown or other
  misc_feature (163)..(163): n is a, c, g, or t
  modified_base (743)..(743): a, c, t, g, unknown or other
  misc_feature (743)..(743): n is a, c, g, or t
tcagctcgcgtgtccacgaccggtgctcgatttagacgtctcatcgagggggtgggctcaggaggcagagctcgtgggaatcctcaccatggcctggacccctctcctgcctcccctctctactttctgcacagtctctgacgcctctagtgacgctgacacncgcctaccgtggtcgtctagtccgtccccaaggacaaccggcctaggacttccgaccgtgtcctcgtaggtactcgtaagaacttacgaaaccgaaaagtaaattcgtacggttacttaagttacggtaacctacggagtaacggtaacgtacggaccgacccgtaccgtcccgttacgtccgttacggtacttaacgtttacgagggaaccgtaaccaacggtacccgtaccggtccgtacgtccagtacgtacggtcctcggtacgcggtcctaacgcggtacctacgggagtaccgtcgtaccgtaccgttactacggtaacttcggtacccggtacgggtacccggggtaaccgttaggggtacgggttaacgaacgggttaccgggaaaacggttcgtaacggtttaccgtttacgtttacccggtacttaccgttaccgggaagtaaccgggtagtacgttagtcgtaacgtcgtttaggtacggttacgggacgggaaccgggttagaacgttaacgtcccgggtacgttaccggaccgttacggtaccgtccgggaacctcgggttaacccncccccggttaacggttcccggtaccctttaccgttccccgttaaccccggttccccgtacccgttaacccggg

SEQ ID NO: 163119 - DNA, 796 bp, Homo sapiens
  misc_feature: GYAE6OF02HPTEP.8.1.A01.1.454.CMB.1.raw
  modified_base (173)..(173): a, c, t, g, unknown or other
  misc_feature (173)..(173): n is a, c, g, or t
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacacgccaccctcggtntcagtcgtccccaggacaacggccaggactcacctgctcgtaggagatgaattcgaccaaaagaatatgtctttagttcggtaaccagcaagagtacgacggccacggccccttagtcctggtactagtttagcggaaggaaccaaacggaaccgtaccccgtccgggtacctcccgtagaacgtacgtacctcctcggcggtacctaccgacgtccgtacggacggacgtacggtccgaccctaacgttagaaccttacgtccggtaaccgggtaccggggccgtaacggggtacgggtaacgggtaaggttaacgggaaacgggtactaaacgtttaacgttacgttttaacgtttaccgtaccgtaaccgtagggaaacggttaaggtacgttacggtacgtacgttacggttacgggtttacgggttaccgggttacggggtaccggggtaaacgggtaaccggtaaccggtaccggttaccgtaccccggttaccggttaacgtacccggtaaccggtaccccggtaacgggttcccgtaacccggtccccccgttacggttaccccgtacccgtttacccggttaccccggtttccccgtaccccgttaaccccggg

SEQ ID NO: 163120 - DNA, 793 bp, Homo sapiens
  misc_feature: GYAE6OF02FYGH4.8.1.A01.1.454.CMB.1.raw
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (551)..(551): a, c, t, g, unknown or other
  misc_feature (551)..(551): n is a, c, g, or t
tcagctcgcgtgtccacgaccggtgctcgatttagacgtctcatcagggggtgggctcaggaggcagagctctgggaatctcaccatggcctggacccctctcctgcctccccctcctcactttctgccacagtctctgaggcctcctatgagctgacacacgcccaccctggtgtcagtcgtaccccgaggacaaaccggccaggactcacctgctgtgganatgatgaccaaanaatntgtattagtcgtacagacagagtcgacggccacggcccctgtccgtgtctatttagaggacggtaacaacgaacccggtcccgtaccgggtacctacccctagaccgtaagttaccttctcggtcggtccctacacggtacctaggacgggactacggtaccgtccttacccttagtacctacgtccggaccgggtccggggtacccaaggggtcggaagggtactagggtaacgggtaacgttaccgtaaacgtttactttacccgggttaaccttacgttaaccggaacggtaagggtaaaccggggtnttaccgggttaactaacggttaccggttaggggtttacggggggttttccggttaccgggggacgggggtaaaccggaaacccggtaacggtccggttaaccgtacccgggtttacccttacggtaccgaccccgggtaaccgtaacccggggtccgtcccccgtttaccccggaccgtttaacccgggttcccgtttaccccggtcccccggttttccccccggtacccccgtacccccgg

SEQ ID NO: 163121 - DNA, 744 bp, Homo sapiens
  misc_feature: GYAE6OF02HFGRR.8.1.A01.1.454.CMB.1.raw
  modified_base (125)..(125): a, c, t, g, unknown or other
  misc_feature (125)..(125): n is a, c, g, or t
tcagctcgcgtgtccacgaccggtgctcgatttagacgtctcatcagggggtgggctcaggaggcagagctctgggaatctcaccatggcctggacccctctcctgcctcccctcctcactttcngcacagtctctggacggcctactagtgagtctagacacgacgcccacccgtcggtgtcagtccgtacccgaggaaccaaacggtccgaaggtactaccgaccgtcgtccgtggtaggtacgtatagtaattacgaaccgaaaagtaattatagtactttaggtcggtaaccgagacgaagtaagtcgacggaccgaccggtcccgttgtaccgtggtactattttagaggtacgaaagaaacggtaacccgtaccgtacggtacctcccgtagacgtacgtcctacgtcgtccgtcctaccggcgtacgtacggacgggacgtacggtccgtacctacgtgacttacgcgtaccgggtacgggccgaggggtacggagtaggtacggaaggtacgtaacgttacgttatttaccgttacgttacccaggtaaggacgtaaggtcgtcggtactcgtaggttacgggttgggtcggttacgggaaccggacgggaacgtacctggtacccgttacccgcggttaagaccgacccgggtaaccggaccggttcccgtaacccggtccccggtttcaacccgttccttaccccggggttcctaccccgttccccgtacccgg

SEQ ID NO: 163122 - DNA, 801 bp, Homo sapiens
  misc_feature: GYAE6OF02G22W9.8.1.A01.1.454.CMB.1.raw
  modified_base (171)..(171): a, c, t, g, unknown or other
  misc_feature (171)..(171): n is a, c, g, or t
tcagctcgcgtgtccacgaccggtgctcgatttagacgtctcatcagggggtgggctcaggaggcagagctctgggaatctcaccatggcctggaccctctcctgctccccctcctcactttctgcacagtctctgaggcctcctatgagctgacacagccaccctcggtntcagtcgtcccaggacaaacggcaggatcacctgctcgtggagatagtaattcgaccaaaagtaatatgtactttaatacggtaaccagacaagaagtcaacggccacgtcccgtgtcctggtactatttagaggaggtaacaaacggaaccgtacccgtacgggactcccgtagaccgagtactcctcgtacgggtcctacgagccgtacgaacggggtactacggtcgacccgtaactttcggaaccttactcccggaacgggtttaccgggggacccgtaggggtacgggtaacgggaagttaacgggaaacgggtaacgttaacgttaacgttaagttttacggttaaccttaccgtaacgtaacgggtaacggtaaagggttaacttaacgggttaattccggttaaagggttttacggggttcggggtttaaccgggggacggggttaaacgggtaacccgtaaacgggtccgttaaaccgggtacccgttaacggttaaccgtacggtaacccggtaacccgtaaaccgggtcccgttaccccgggtccccccgttacggtaccccttaccggttacccgtttaccccggtttacccccccttacccgttccccgtaacccgg

SEQ ID NO: 163123 - DNA, 830 bp, Homo sapiens
  misc_feature: GYAE6OF02FTR2T.8.1.A01.1.454.CMB.1.raw
  modified_base (224)..(224): a, c, t, g, unknown or other
  misc_feature (224)..(224): n is a, c, g, or t
tcagctcgcgtgtccacgaccggtgctcgatttagacgtctcatcagggggtgggctcaggaggcagagctctgggaatctcaccatggcctggacccctctcctgcctccccctcctcactttctgcacagtctctgacggcctcctatgagctgacacagcccacccgtcggtgtcagtcgtccccaggaccaaacggccaggactcacctgctcgtggagntgaattcgaccaaaagaatatgtcttattcgtaccagacagaagtcgaacggccacggtccccgtgtccgttggtctagttttcagggtaacggaacaaacggaaacccgcccggtaccgggtactccccgtagacctacgtaccttcgttccgtcggtaccctccaggtccctaggacggtacgtaggtcgtaccctacgttagacctagttaccgacggttcggggacccgtaggggtacggaacggtacgtagggtaaacgtacgtaaccgttacgttaacgttacgttaccgtaccgttaacggtacgtaaacgggtaacggtacgttacgggttacctaacggttcggtaacggggtttttcgggtaccgggggtttaccggggacggggttaaacccgggtaaccgtaaccgggtttaacccgtaccggggttaaccccggttaccggtttaaacccggtaccggtaaaccccggggtcccccggttaaacggggttacccccggtttaccccggtacccccggtttaccggttccccggttaaaccctttccccgggtttacccccgtttaccccccgtaacccccggtttcccccggg

SEQ ID NO: 163124 - DNA, 714 bp, Homo sapiens
  misc_feature: GYAE6OF02JQMUG.8.1.A01.1.454.CMB.1.raw
  modified_base (125)..(125): a, c, t, g, unknown or other
  misc_feature (125)..(125): n is a, c, g, or t
  modified_base (129)..(129): a, c, t, g, unknown or other
  misc_feature (129)..(129): n is a, c, g, or t
  modified_base (162)..(162): a, c, t, g, unknown or other
  misc_feature (162)..(162): n is a, c, g, or t
  modified_base (178)..(178): a, c, t, g, unknown or other
  misc_feature (178)..(178): n is a, c, g, or t
  modified_base (223)..(223): a, c, t, g, unknown or other
  misc_feature (223)..(223): n is a, c, g, or t
  modified_base (394)..(394): a, c, t, g, unknown or other
  misc_feature (394)..(394): n is a, c, g, or t
tcagctcgcgtgtccacgaccggtgctcgatttagacgtctcatcagggggtgggctcaggaggcagagctctgggaatctcaccatggcctggacccctctcctgcctcccctcctcactttcngcanagtctctgaggtcctcctatgatcctgacaacncgcccacccgttggtntccagttctaccccgaggaccaaccggcaggactcacctgctcgnggagactcgaattcgaccaaaaggtaatcgtagtctttaagttaccggacagagtaacgtaacgtcagggaccacggtccctggtacctgtactatttaggcgaacgtaacgaaccgaaccgaccgtccggtaacacctagacacggtacctcttacggtgtacctcgtanccgttaagaaccgggtctacggccggaaccttccgtagtaccgtacgtccgtacgttccggggaccgtacggggagtaccggagtaacggacggaaacgttccgttaagttacggttaacctacgttacgtacgtaacgtaagggtaaccgtgttaccgcgtaatacgggttgttacggtacggttacgggacgttaccgggacgttagtacgtaccggtaccgtagtaaccttacggaaccgtccggaaccgtaccgtccccggtacccgttacgaaccgttccttacccggtttcccggtaccccggtccttaccggg

SEQ ID NO: 163125 - DNA, 934 bp, Homo sapiens
  misc_feature: GYAE6OF02I0MOS.8.1.A01.1.454.CMB.1.raw
  modified_base (262)..(262): a, c, t, g, unknown or other
  misc_feature (262)..(262): n is a, c, g, or t
  modified_base (409)..(409): a, c, t, g, unknown or other
  misc_feature (409)..(409): n is a, c, g, or t
tcagctcgcgtgtccacgaccggtgctcgatttagacgtctcatcagggggtggctcaggaggcagagctctgggaatctcaccatggcctggacccctctcctgcctcccccctctctactttctgcacagtcctctgaggtccctcctagtgtagctagaccacacgcccaccccgttcggtagtccaggttccgtacccccgaagggaaccgaaaaccgggccgtaaggacttacccaaccgtcgtactcgttaggganacttagtaaacttcggaaacctaaaaagtaattacgtaggttctttaggtaccgtaaccagacaaggtaacgaccgaccggccacggtcccccttggtaccttaggtcttaatttagacggaaacggtaaccaaaacggtaaacccnccccggtaaccggaccttacccgtacggaaaccgtacgtaccgttaccgtcccttagggacccctacggtaaccgtcggttaccggaaccggtaccgtaagggttccgaacccgttaccgttactaaccgttacgtaccgtaccgggtacggggtcccggtaaacggtcgggaagggtaacgtagggtaaacggaacgttaaaccgttaacggttaaatttccggttaaacccgttaacccgttaacggaacgggttaaacgggtaaacgttcgggttaaacgtaccggtaaacgtttagggttaacggtttcgggggtttacccgggttacggggaacccggggttaaaccgggaaccggttaacgtaaccggttaccgtacccggtttaacggtaaccggccggtaaaccggtaacccccggtaaggtacccccggtccccggttaacccccgttaccggttacgtaacccccctttacccgggtttaacccgtttccccccccgtaaccgttaccccccggg

SEQ ID NO: 163126 - DNA, 506 bp, Homo sapiens
  misc_feature: GYAE6OF01EI5T5.39.27.C05.1.454.CMB.1.raw
  modified_base (392)..(392): a, c, t, g, unknown or other
  misc_feature (392)..(392): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaacgcccctaagctcctgatgtatgatgcctccagtttgaaaagtgggtccatcaaggttcagcggcagtggatcgtgggacagtattcactctcaccatcaccagcctgcgcctgaagtntttgactaacttattactgtacaactaatttaattcttatccgtcttctactttcggacggagggaccaaggtggagagtacaaacgtactggcgctcgcacatctgtcttacc

SEQ ID NO: 163127 - DNA, 493 bp, Homo sapiens
  misc_feature: GYAE6OF01A5UD6.39.27.C05.1.454.CMB.1.raw
  modified_base (403)..(403): a, c, t, g, unknown or other
  misc_feature (403)..(403): n is a, c, g, or t
tcagtcgcactagtcacgaccggtgctcgatttagacgcgatcgaagggtttggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaagcccctaagctcctgatgtatgatgcctccagtttgaaaagtggggtcccatcaaggttccgcggcagtggatctgggacagaattcactctcaccatcagcagcctgcagcctgatgattttgcaacttnttactgccaacagtataatagttattcgtactacttttggcctaggggaccaaggctggagatcaaacgaactgtaggctagcaccatcg

SEQ ID NO: 163128 - DNA, 514 bp, Homo sapiens
  misc_feature: GYAE6OF01DZCL1.39.27.C05.1.454.CMB.1.raw
tcagtcgcactagtcacgaccggtgctcgatttagacgcgatcgaagggtttgggggtaggttcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaccaggaaagcccctaagctcctgatgtatgatgcctcagtttgaaaagtggggtcccatcaaggttccgcggcagtggatctgggacagaattcactctacaccatcagcagctgcagcctgatgtattttgctaactttattactgaccaacagttaataattagtttaattcgttaactactttttggaccgtagggggaccaaggctaggagatacaaaacgatagtggactgacaccgataccg

SEQ ID NO: 163129 - DNA, 543 bp, Homo sapiens
  misc_feature: GYAE6OF01CUH2A.39.27.C05.1.454.CMB.1.raw
  modified_base (334)..(334): a, c, t, g, unknown or other
  misc_feature (334)..(334): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccggcagtcagagtattagagctggttggcctggtatcagcagaaaccagggaaacgcccctaagctcctgatgtatgatgcctctagtttagaaagtgggtaccatcaaggttcgcgnagtgatcgtggacagaattcactctcacatcagcagcctgcagcctgatgtatttgactaacttattactgacctaaactagttaataagttagtttaactttacgttaactacgttttagggaccctaagggggacctaaagggctagggaagtaacgtaccgaaaacggtaacgttggtacggtactaggaccacccgtagttaccg

SEQ ID NO: 163130 - DNA, 487 bp, Homo sapiens
  misc_feature: GYAE6OF01AVVKJ.39.27.C05.1.454.CMB.1.raw
  modified_base (462)..(462): a, c, t, g, unknown or other
  misc_feature (462)..(462): n is a, c, g, or t
  modified_base (485)..(485): a, c, t, g, unknown or other
  misc_feature (485)..(485): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaagcccctaagctcctgatgtatgatgcctccagtttgaaaagtggggtcccatcaaggttccgcggcagtggatctgggacagaattcactctcaccatcagcagcctgcagcctgatgattttgctaacttattactgccaacagtataatagttattcgtacactttggccaggggaccaagctgganatcaaacgaatgtggctgcaccntc

SEQ ID NO: 163131 - DNA, 539 bp, Homo sapiens
  misc_feature: GYAE6OF01BYSRI.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaacgcccctaagctcctgatgtatgatgcctcagtttgaaaagtgggtccatcaaggttccgcggcagtggatcgtgggacagaattcactctcaccatcagcagcctgcagcctgacttgtattttgactaactttattactgacctaactacgttaataacttagtttaattacgttactacttttacggaccgtaagggtacccaaaggtccgtaggaagaacgtacaaacgtaactacgttaggactagacctaccagttaccg

SEQ ID NO: 163132 - DNA, 599 bp, Homo sapiens
  misc_feature: GYAE6OF01BJSEY.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgaccagtctccttccaccctgtctgcatctgttggagacagagtcaccatcacttgccgggccagtcagagttatagagctggttggcctggtatcgagcaagaaaccgagggaaacgaccccgtaagctcctgatgtatgatcgcctcgtagtttagaaagtcgggtaccatacgtaaggtcaggcggctaggtggatcgtagggacagtattcactctcgacctatccaccacgccgtgccggtacctagtaacgttatttacgactaactttattactacgtaactaaacttaaattttaacttactttactacccgtccttaccgttacgtttccgggacgggtaacgggtaacccgtaagggtacggaacgtaacgtaaccgtaaaacggtacgttggtacggtactacgaccaccctagttcctgttccttaccg

SEQ ID NO: 163133 - DNA, 560 bp, Homo sapiens
  misc_feature: GYAE6OF01EO0Z7.39.27.C05.1.454.CMB.1.raw
  modified_base (273)..(273): a, c, t, g, unknown or other
  misc_feature (273)..(273): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccggccagtcagagtattagtagctggttggcctggtatcagcagaaaccagggaaancccctaagctcctgatgtatgatgcctccagtttagaaaagtgggtccatcaaggttccgcggcagtggatcgtgggacagaacttcactctacaccatcagcagcctgcagcctgatgtattttgactaacttattactgtacaactagtagttacagtagcgtaggtaacgggttactaacgttttcgggacccgtaagggggtaacccgaaacgggtacgttaggggaacgtaacgttacgaaacggtaaccgtaaacgttagggtggtaccgtggtaaccccg

SEQ ID NO: 163134 - DNA, 349 bp, Homo sapiens
  misc_feature: GYAE6OF01BI2UD.39.27.C05.1.454.CMB.1.raw
  modified_base (340)..(349): a, c, t, g, unknown or other
  misc_feature (340)..(349): n is a, c, g, or t
tcagtcgcactagtcacgaccggtgctcgatttagacgcgatcgaagggtttgggtgcccaagctgctggagggcacggtcaccacgctgctgagggagtagcctgaaggcctcggacaccgccatgtattactgtgcgagacatggtgatattagtggttattcctcctggggccagggaaccctggtcaccgtctcctcagcctccaccaaggcccatcgtccttcccctggccaccctcctccaagcgcacctcgtggggcacagccggccctgggctgcctggtcaaggactacttccactagtgcgactgaggcgggctggcaagggcgcatagnnnnnnnnnn

SEQ ID NO: 163135 - DNA, 499 bp, Homo sapiens
  misc_feature: GYAE6OF01BP5DE.39.27.C05.1.454.CMB.1.raw
  modified_base (496)..(496): a, c, t, g, unknown or other
  misc_feature (496)..(496): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaagcccctaagctcctgatgtatgatgcctccagtttgaaaagtggggtcccatcaaggttccgcggcagtggatctgggacagaattcactctcaccatcagcagcctgcagcctgatgtattttgctaactttattactgaccaacagtataattagtttattcgttactacttttggccgtaggggaccaagcgtggagatacaaacgactgtggctgcacntcg

SEQ ID NO: 163136 - DNA, 551 bp, Homo sapiens
  misc_feature: GYAE6OF01DHIHC.39.27.C05.1.454.CMB.1.raw
  modified_base (364)..(364): a, c, t, g, unknown or other
  misc_feature (364)..(364): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaagcccctaagctcctgatgtatgatgcctccagtttgaaaagtggggtcccatcaaggttccgcggcagtggatctgggacagaatcactcncaccatcagcagcctgcagcctgatgtattttgactaactttattactcgtaccaaacagttaattaattagttatttacgttaactacgtttacggaccgtaggggacctaaggcgtagggaagtaagtaaccgaaaacggtaaaccgttaggtacgggtaccttaggacccaacctacgttaccg

SEQ ID NO: 163137 - DNA, 350 bp, Homo sapiens
  misc_feature: GYAE6OF01ANKWO.39.27.C05.1.454.CMB.1.raw
  modified_base (251)..(251): a, c, t, g, unknown or other
  misc_feature (251)..(251): n is a, c, g, or t
  modified_base (341)..(350): a, c, t, g, unknown or other
  misc_feature (341)..(350): n is a, c, g, or t
tcagtcgcactagtcacgaccggtgctcgatttagacgcgatcgaagggtttgggtgcccaagctgctggagggcacggtcaccacgctgctgagggagtagcctgaaggcctcggacaccgccatgtattactgtgcgagacatggtgatattagtggttattcctcctggggccagggaaccctggtcaccgtctcctcagcctccaccaagggcccatcggtcttccccctggcaccctcctccaagngcacctcgtgggggcacagcggccctgggctgcctggtcaaggactacttccactagtgcgactgacgcgggctggcaaggcgacatagnnnnnnnnnn

SEQ ID NO: 163138 - DNA, 345 bp, Homo sapiens
  misc_feature: GYAE6OF01E5F5Y.39.27.C05.1.454.CMB.1.raw
  modified_base (338)..(345): a, c, t, g, unknown or other
  misc_feature (338)..(345): n is a, c, g, or t
tcagtcgcactagtcacgaccggtgctcgatttagacgcgatcgaagggtttgggtgcccaagctgctggagggcacggtcaccacgctgctgagggagtagcctgaaggcctcggacaccgccatgtattactgtgcgagacatggtgatattagtggttattcctcctggggccagggaaccctggtcaccgtctcctcagcctccaccaagggcccatcggtcttccccctggcaccctcctccaagagcacctctgggggcacagcggccctgggctgcctggtcaaggactacttccactagtgcgactgagcgggctggcaaggcgcatagnnnnnnnn

SEQ ID NO: 163139 - DNA, 341 bp, Homo sapiens
  misc_feature: GYAE6OF01EV9GO.39.27.C05.1.454.CMB.1.raw
  modified_base (337)..(341): a, c, t, g, unknown or other
  misc_feature (337)..(341): n is a, c, g, or t
tcagtcgcactagtcacgaccggtgctcgatttagacgcgatcgaagggtttgggtgcccaagctgctggagggcacggtcaccacgctgctgagggagtagcctgaaggcctcggacaccgccatgtattactgtgcgagacatggtgatattagtggttattcctcctggggccagggaaccctggtcaccgtctcctcagcctccaccaagggcccatcggtcttccccctggcaccctcctccaagagcacctctgggggcacagcggccctgggctgcctggtcaaggactactccactagtgcgactgagcgggctggcaaggcgcatagnnnnn

SEQ ID NO: 163140 - DNA, 565 bp, Homo sapiens
  misc_feature: GYAE6OF01BJFMF.39.27.C05.1.454.CMB.1.raw
  modified_base (279)..(279): a, c, t, g, unknown or other
  misc_feature (279)..(279): n is a, c, g, or t
  modified_base (559)..(559): a, c, t, g, unknown or other
  misc_feature (559)..(559): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttcggccgggccagtcagagttattagtagctggttggcctggtatcagcaagaaaccagggaaacncccctaagcctcctgatgtatgatcgcctctagtttagaaaggtcgggtacccagtcgaacggttccgcggcaggtgatcgtggacagattcactctcaccatcagcacgcctagcacgcctagatgtatttgactaactttattactacgacctaacgtagttaattaattagtttaacttaccgttaacttacgttttacgggaccgtaacggggtacctaaaggtccgtaaggacgtagtacgaaaacgtacgttggtacgtactaggacctacgtnttaccg

SEQ ID NO: 163141 - DNA, 579 bp, Homo sapiens
  misc_feature: GYAE6OF01CT3AB.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagagctggttggcctggtatcagcagaaaccagggaagcccctaagctcctgatgtatgatgcctccagtttgaaaagtggggtacccagtcaaggttccgcggcagtggatcgtggacagaattcactctacacatcagcagcctgcagcctgatgtattttgactaactttacttactgacctaaatacgttaattaaattagtttaagttaccgtttaactacgtttttacgggacccgtaacgggggtaaccctaaggtaccgttagggaacgtaacgttaaccgtaaaaccggtaacgttaggtacgggtacttacggtaccctaccgtaacgtttaccg

SEQ ID NO: 163142 - DNA, 580 bp, Homo sapiens
  misc_feature: GYAE6OF01C5NZD.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaacgcccctaagctcctgatgtatgatgcctcagtttagaaagtgggtccagtcaaggttccgcggcagtggatcgtgggacagaattcactctacaccatcagcagcctgcagcctgatgtattttgacttaacttacttactcgacctaaactacgttaattaactttactttacccgttaacttaccgtttttcggacccgtaacggggtaacccaaggtaccgtagggacgtaccttaaccggtaaaaccggtaaccgttacggttcgggtaccttacggaccctaaccctagttcccgttacgg

SEQ ID NO: 163143 - DNA, 721 bp, Homo sapiens
  misc_feature: GYAE6OF01AD2NO.39.27.C05.1.454.CMB.1.raw
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (318)..(318): a, c, t, g, unknown or other
  misc_feature (318)..(318): n is a, c, g, or t
tcagtcgcactagtcacgaccggtgctcgatttagacgcgatcgaagggtttgggggaggtcgaggactcagtcaggacacagcatggacatgagggtccccgcgtccaggctcctgggctccgtgctgctctggctcccaggtgcccaatcgtgacatccagatcgaccagtctccttccaccctgtctgcatcctgttgganacagtactcaaccnctcacttcgccgggtccaaggtcagtacgtattagtacgcgttaggtcggtctcggtatcgacgctaacgaaccgaggaaccgaccctacgacctccgangtacgtataggatcgctaccgtagttagtaaacgtcgggtaccacgtacgtaaggtccgtacgggactacggaggtacgtcgtacgggtaacgaagttaacgtacgtactcgttaccgaaacctctaccggtaacacggtacctcccggtacgttaccggacctaccgtagtacgttacgttagttttaccggaccttaaactttaccgttcgtaaccgttaacccgaactaaacggttagttaaacgttaaaccggtttctttaaaccgttaccgttaacgtttttaccgggacgaaacggggttacccctaaaggttccctacggggttaacgtaacgttaacgttaaaacccgggttaaactcggtacgggtataaccgtccccgaagttccgttaaacg

SEQ ID NO: 163144 - DNA, 547 bp, Homo sapiens
  misc_feature: GYAE6OF01BKQIS.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtatagtagctggttggcctggtatcagcagaaaccagggaaacgcccctaagctcctgatgtatgatcgcctcagtttagaaaagtcgggtaccatcgaaggttccgacggcagtgatcgtaggaacagaacttcgaactctacaccatcagcagcctgcacgcctagattgtatttgactaacttatactgacctaactagttataaattagttacttacgtaacttacgtttacggaccgtaagggacctaaagtcgtaggataagtacgtaaaacgtaacgttacggtacggtctagacctaaccgtgttaccg

SEQ ID NO: 163145 - DNA, 517 bp, Homo sapiens
  misc_feature: GYAE6OF01BL3PD.39.27.C05.1.454.CMB.1.raw
  modified_base (481)..(481): a, c, t, g, unknown or other
  misc_feature (481)..(481): n is a, c, g, or t
  modified_base (512)..(512): a, c, t, g, unknown or other
  misc_feature (512)..(512): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaagcccctaagctcctgatgtatgatgcctccagtttgaaagtgggtccatcaaggttccgcggcagtggatcgtgggacagaattcactctcaccatcagcagactgcagcctgattgtatttgactaactttattactgacctaactagtattaattagtttatttacgtactacgttttaggacctaggggaccaaggtcgtagganagtacgaaacgtactgtacgctagcctactnttccg

SEQ ID NO: 163146 - DNA, 705 bp, Homo sapiens
  misc_feature: GYAE6OF01BQJH6.39.27.C05.1.454.CMB.1.raw
  modified_base (288)..(288): a, c, t, g, unknown or other
  misc_feature (288)..(288): n is a, c, g, or t
  modified_base (363)..(363): a, c, t, g, unknown or other
  misc_feature (363)..(363): n is a, c, g, or t
tcagtcgcactagtcacgaccggtgctcgatttagacgcgatcgaagggtttgggggaggtcagactcagtcaggacacagcatggacatgagggtccccgctcagctcctggggctcctgctgctctggctcccaggtgccaaatgtgacatccagatgacccagtctccttccaccctgtctgcatcgtgttggagacagtagtccaccatcacgttcgcccgggcctagtcaggagttattagtagcgtggttggcctggtatcagacagaaaccgagggaaacnccccgtaagctccgtggtagtatgatcgcctcgtagtttaggaaaggttcgggtaccagtacgtaacggtcccgnggacgaggttggactcggtcgggaataggtacttaccgtacttcctaccaaccctagtaccgacggtaccaacgtcccgtacgaccgtaccgtaccgtacgtagttacgttaacgttttacgtaactttaaccgtttatttaccgtacgtaacctaaaccgttaagttaaacttaaacgtttaacgtttaacgtttacgtttaaccgttaccggttttacgggacccggttaacggggtaaacccgtaagtaccggtaacgggtacgtaaaccgttaccggtaaaacggtaacgttaggtaccgggtaccgtacgtacccgtaccgttagttccgttaaccg

SEQ ID NO: 163147 - DNA, 703 bp, Homo sapiens
  misc_feature: GYAE6OF01DEB4U.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcacatcacttgccggcagtcagagtattagtagctggttggccgtggtatcagcaagaaaccgaggaaacgcccctaagctacctgatgtatgatcgcctcgtagtttaggtaaaacgtcggggtaccctaagtcgtaacggttccggacggacaggttggacgttcggtagggaactaagtaacttaccgaccttaccgtaccaaccgtattccgaggccacgtccgtcggtaccgacgtaccgtgtaacgttagttaagttttaccgtacttaaacctttttacttaaccgttacgtaacccttaaacgtaaacgtttaacgtttaaacgtttaagtttaaccttttacgttaacccgtttaccggttttacgggaacccgtaacgggggtaaaccctaacgggtaccgggtaacgggtaacggtaaccgttaaaccggtaaaaccgtaacggttacggttacgggaccgttaacgaccctaaccgtcgtttacccgg

SEQ ID NO: 163148 - DNA, 563 bp, Homo sapiens
  misc_feature: GYAE6OF01ER8TW.39.27.C05.1.454.CMB.1.raw
  modified_base (101)..(101): a, c, t, g, unknown or other
  misc_feature (101)..(101): n is a, c, g, or t
  modified_base (276)..(276): a, c, t, g, unknown or other
  misc_feature (276)..(276): n is a, c, g, or t
  modified_base (513)..(513): a, c, t, g, unknown or other
  misc_feature (513)..(513): n is a, c, g, or t
  modified_base (557)..(557): a, c, t, g, unknown or other
  misc_feature (557)..(557): n is a, c, g, or t
tcagtcgcactagtcacgaccggtgctcgatttagacgcgatcgaagggtttgggggagtcagactcagtcaggacacagcatggacatgagggtccccgntcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcaagaaaccagggaaacncccctaagctcctgatgtatgatcgcctccagtttagaaaaggttcggggtcccagtcgaacggttccgcggcaggtggtatcgtaggacagtaattcactctcaccatcagcacgcctgcagctgattgtattttgaccttaacgttacttactacacctaactaagtattaattaagtttaacttacgttacttacgttttcggaccgtagggaaccgtaaggacgtcgggtaanaacgtacgaaaacgtaacgttacgtacggtacgtagacctaccngttacg

SEQ ID NO: 163149 - DNA, 685 bp, Homo sapiens
  misc_feature: GYAE6OF01A090D.39.27.C05.1.454.CMB.1.raw
  modified_base (287)..(287): a, c, t, g, unknown or other
  misc_feature (287)..(287): n is a, c, g, or t
tcagtcgcactagtcacgaccggtgctcgatttagacgcgatcgaaggggtttgggggagtcagactcagtcaggacacagcatggacatgagggtccccgctcagctcctggggctcctgctgctctggctcccaggtgccaaatgtgacatccagatgacccagtcctccttccaccctgtctgcatctgtggagacagagtcaccatcacttcggcccgggccagtcagagttattagtagtcgtggttcggccttggtatcagacaagaaaccgagggaaacncccctaagcctcctgatgtatgatcgcctcgtaaggtttaggaaaggtcgggtacccagtacgtaacgggttccgacgggtcgaggtggattcggtagggaactaagtaacttcaccttcctaccacctctacacggcctacggccctaggaccacggtccttaggaattcggttaacttttcgaacctttaacttttacttaccgtacgtaaccctaaacgttaagttaatttaagtttaacgttttacgttacccgtttaacgtttaccggttttacgggaacccggtaaaggggtaaccctaagggtacccggttagggtaacggtaaacttaaacccggtaaaacgtaacgttcgggtaacggccttacgacccgttaacccgttagttacccg

SEQ ID NO: 163150 - DNA, 692 bp, Homo sapiens
  misc_feature: GYAE6OF01CSF1C.39.27.C05.1.454.CMB.1.raw
  modified_base (102)..(102): a, c, t, g, unknown or other
  misc_feature (102)..(102): n is a, c, g, or t
tcagtcgcactagtcacgaccggtgctcgatttagacgcgatcgaagggtttgggggagtcgagactcagtcaggacacagcatggacatgagggtccccgntcagctcctgggctcctgctgctctggctcccaggtgccaaatgtcgacatccagatgacccagtcctccttccaccctgtctgcatctgttggagacagacgtcaccatcacttggccgggcagtcagtagtattagtagcttggttggcctggtactcagcaagaaaccgaaggaacacccctaagcctcctagatagtatgacgtcgccttaccgtaggtttacgaaaacggttcggggtaccctaagttaccgtaacgggttcccgcggtacgaggtggtactcggtacgggaactacgtaacttaccgtacttacctacctaaccgtacttacccgaacgccgaacggtccctacggaccgacggtaccgtaggttaacgggttaacgtttttacgggaaaccttttagtttaaccgttgtaaccgtaagtaactttaacgttaagttacggttaccgggtcccttaacgggtaaccggtttaccgggacccggtaaacggggaccgtaagggtaacggtaaactaccggaaacgtacgtaggtcgacgtacgacctaccgtactcgttcgtccttcgttacccg

SEQ ID NO: 163151 - DNA, 551 bp, Homo sapiens
  misc_feature: GYAE6OF01E3TMN.39.27.C05.1.454.CMB.1.raw
  modified_base (385)..(385): a, c, t, g, unknown or other
  misc_feature (385)..(385): n is a, c, g, or t
  modified_base (504)..(504): a, c, t, g, unknown or other
  misc_feature (504)..(504): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgcccgggccagtcagagtattagtagctggttggcctggtatcagcaagaaaccagggaaacgcccctaagcctcctgatgtatgatcgcccttcctagtttagaaaaggtcggggtacccatcgaaggttccgcggcagtggatcgtggacagaattcactctacaccancagcacgcctgcacgctgatgttatttcgacttaacttattactcgaccaactaataattaattaagtttattacgttacttacgttttcggaccgagggtaaccaagtacgtggtaanaacgtacgaaacgtaacgttacggtcgactacgactacctagttccg

SEQ ID NO: 163152 - DNA, 696 bp, Homo sapiens
  misc_feature: GYAE6OF01ESJFD.39.27.C05.1.454.CMB.1.raw
  modified_base (279)..(279): a, c, t, g, unknown or other
  misc_feature (279)..(279): n is a, c, g, or t
  modified_base (295)..(295): a, c, t, g, unknown or other
  misc_feature (295)..(295): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtcctccttccaccctgtctgcatctgttggagacagagtcacatcacgttgccggccagtcagtagtattagtagtcgtggttggcctggtatcagcaagaaaccgagggaacnccctaagctcctgatntagtgatcgcctctaagtttaggaaacggttcggggtaccctagtaccgtaacggttcccgcgggacgtaggtcggtaacgtcggtacgggaactaaggtaacttccacttcctaccacctacgtaccacggtaccacggtcccctaggaccgtaccggtccgttaggtatttacggttactttttacgaaccctttaaactttaaccgtttaaccgtaccgtaaccctaaacgttaaggttaaactttaaaggttacgtttaacgttttaccgttaaccgtttaccggttttaccgggaacccggttaacggggtaaccgtaacggtacgtagggtaaacgtaacgtaaaccgtaaaacggtacgttcgggtagccgttaccgacttacctagtttaccg

SEQ ID NO: 163153 - DNA, 799 bp, Homo sapiens
  misc_feature: GYAE6OF01CRRFN.39.27.C05.1.454.CMB.1.raw
  modified_base (101)..(101): a, c, t, g, unknown or other
  misc_feature (101)..(101): n is a, c, g, or t
tcagtcgcactagtcacgaccggtgctcgatttagacgcgatcgaagggtttggggagtcagactcagtcaggacacagcatggacatggagggtccccgntcagctcctggggctcctgctgctctggctcccaggtgccaaatgtgacatccagatcgaccagtctccttccaccctgtctgctatctggtggagacagacgtcacatcacgtcgccggcagtcagtagtattagagtcgttgggttcgccgtgggtactcgaacggaccgaaacggaaaccgaacgggaaaccgtacccctaaacggtccgttaccgtagtaacgtgttaacgtacgtacgttcggtacccttacccggttaaggtttaaaccgggtaaaacgggttccggggttacccctaaacggttaccggtaaacccgggtccggtacgggtaccgtaaggttcgggaacgttaccgggtacggaaacgtaagtaaaccgtttaccgtaacttacccgtaaccgtaaccctaacgttaccgaacgtaccgtaaccggtcccgttaacggccctaacggtcccgtaaggttacgtttaacggttaacttttaacggaactttaaaccgtttaacgtttaacgtaaccgtaaccgtaaacttaaggttaaacttaagttaaccgtttaacgttacgttaccgttaggtttaaccgggaaccgttaacggggaaccgttaacgacggttaacggaattaaccgtaacgtaaacgtacggttaggtacgtcgtaactaccggaccgtcgttacccg

SEQ ID NO: 163154 - DNA, 523 bp, Homo sapiens
  misc_feature: GYAE6OF01AMDFH.39.27.C05.1.454.CMB.1.raw
  modified_base (384)..(384): a, c, t, g, unknown or other
  misc_feature (384)..(384): n is a, c, g, or t
  modified_base (424)..(424): a, c, t, g, unknown or other
  misc_feature (424)..(424): n is a, c, g, or t
  modified_base (483)..(483): a, c, t, g, unknown or other
  misc_feature (483)..(483): n is a, c, g, or t
  modified_base (489)..(489): a, c, t, g, unknown or other
  misc_feature (489)..(489): n is a, c, g, or t
  modified_base (516)..(516): a, c, t, g, unknown or other
  misc_feature (516)..(516): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaagcccctaagcctcctgatgtatgatcgcctcgagtttagaaaagtcggggtaccagtcgaaggttccgcggacgaggtggagtcgtgggacagattcactctacaccatcngcagctgcacgctagatgtactttgacttaacttattacncgtacaactagttataattacgttattacgttactacgtttgaccgtagggtacacggntcgganacgtacgaaacgatggtacggctagcncgtatcg

SEQ ID NO: 163155 - DNA, 630 bp, Homo sapiens
  misc_feature: GYAE6OF01EA10P.39.27.C05.1.454.CMB.1.raw
  modified_base (339)..(339): a, c, t, g, unknown or other
  misc_feature (339)..(339): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttagagacagagtcacatcacttgccggcagtcagagtatagtagctggtgcctggtatcagcagaaacgaggaacgccctaagcctcctagatgtatgatcgctccgtaggttacgaaagtcgggtacctagtacgtaacggttccgnggacgtaggtggagtcggtaggaactagtaacttcgactctaccactatcgtacgacacgtcctaggaccgtacgccgttagtacgttgtttaacgtttagaccttaacgtttaacttacgtacgtaaccctaaagtaacgttaacttaaagtttaacgtttacgttaccggttaacttaccggtttacggaacccggtaacggggaaacctaaggtccggtaggtaacgtaacttaaaccgaaaccgtacggttacggtacggtactaacgtccgtaaactcgtttaccg

SEQ ID NO: 163156 - DNA, 624 bp, Homo sapiens
  misc_feature: GYAE6OF01BFK5R.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccggccagtcagagtatagtagcttggttggcctggtatcagcaagaaaccgaggaacgccccgtaagcctcctgatgtatgatcgcctacgtagttacgaaaggtcgggtaccagtcgaacggtccgacggtacgtaggtggacgtcgtaggtacaagtacttcacttctaccacctacgtaccgacgtaccacgtaccgtcgacgtacgtccgtagtacttagttactttacgtacttaacttacttacctacgtactaaactaagttaacttaatttaacgtttactttacgttaaccgttacgtttacggaccggtaacgggtacctaacggtacgtaaggtaagtaacgtaacgaaaccggtaacgtacggtacggtacgtacgtacccgtacgtacgttaccg

SEQ ID NO: 163157 - DNA, 550 bp, Homo sapiens
  misc_feature: GYAE6OF01ARW85.39.27.C05.1.454.CMB.1.raw
  modified_base (547)..(547): a, c, t, g, unknown or other
  misc_feature (547)..(547): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagcgtggtggcctggtatcagcaagaaaccgagggaaacgccccctaagcctcctagatgtatgatcgcctacgtagtttaggaaaaggtcgggtacccagtaccgaacggttccgcggcaggtggatcgtggacagtaacttcactctacacctatcacgcgacgcctgcacgcctagtactagtactttcgacttaacttacttactacgacctaactaagtaataagttaagttacttacgtactacgtttacggcgtacgggaccagcgtaggagactacgaaacgtagtggtacgtcgagcactntcg

SEQ ID NO: 163158 - DNA, 811 bp, Homo sapiens
  misc_feature: GYAE6OF01CT3WE.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatcgacccagtcctccttccaccctgtctgctatctggttggagacagacgtcaacctatccacgttcggcccgggcagtcgagagttattaggtagcgttgggttcggtccgtggtactcgagacaagaaaccgaaggaacgcccctaagcctcctagatgtatgagtcgtcctcgtaggtttacgggaacgggtcgggtaccctagtaccgtaaggttcgagggtcggcgtaggtacgtagtcggtagggactacgtacttcgtacctctaccaaccgtactacccgaccgtacgtcccggtacggtaccggtacgttaacggtaacgtttaacgttttaccggtaacctttaaaaccgttttaactttaacccggtttaacgtaaaccccgttttaaaaacttttaaaacctttttttaccgttttaacccgttttaaccgttccccgggtttaacctttcccgggttttaaaccccggttttacccggggggacggggtaaaccggggttaacccgggttaaaacgggggtacggtaaacccggtaaaccgttaaaccggtaaaaccggttaacgggttcgggtaaccgggttacgtaccggtaacccgttaaccgtaacgtttaccggttccgtttaaccgtttaccccg

SEQ ID NO: 163159 - DNA, 630 bp, Homo sapiens
  misc_feature: GYAE6OF01A6T4B.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtcctccttccaccctgtctgcatctgttggagacagagtcaccatcacttcggccgggccagtcagagttattagtagctgggttcggccgtggtatcaagcaacgaaaccgagggaaaccgcccctaagcctcctgactgtatgatcgtcctacgtagtttaggaaaggttcgggtaccctagtacgtaacggttccggcggacgtaggtaggacgtcggtaggaacctaagtaacttcaccttctaccacctatacacgacacgtcctagcacgtcctagtattagttactttcgtaactaactttacttacgacgtaccgtaagtaataagttaagttagtttacgttaccgttaacttaccgtttacgggaccgtaacggggaacctaagggtcgtacggtaagtaaccgtaacgtaaaacgtacgtacggtacggacgtacgacctaaccgtcgttaccg

SEQ ID NO: 163160 - DNA, 722 bp, Homo sapiens
  misc_feature: GYAE6OF01ETKD1.39.27.C05.1.454.CMB.1.raw
  modified_base (103)..(103): a, c, t, g, unknown or other
  misc_feature (103)..(103): n is a, c, g, or t
tcagtcgcactagtcacgaccggtgctcgatttagacgcgatcgaaggggtttgggggagtcagactcagtcaggacacagcatcggacatgagggtccccgntcagctcctgggctcctgctgctctggctcccaggtgccaaatgtgacatccagatgacccagtctccttccaccctgtctgctactctgttaggacgacagacgtcaaccgatcacttcggccggccagtcaggtattacttagtcgacgtcggttcggccgtggtactcgagtacaacgaaaccgagggaaacctaccccgtaaggccttaccgagtactaagttaggacgtactccggtccctaacgtttcggtaaacgtaaaggggtccggtactaccgtacgtaacccgggtcggacgaacgtcggtaacgtcgtacggtacgagtaaagtacctacgaccttaccgacctaacgttcacccgagtcgaccgtcgtacgtacgcgtcgaacttagtacgttttacgttacgtaaaccttacgtttaactcgtaccgtaacgtaaacgtttaaggtaacttaaagttttaacgttacttttaaacgcgttttaacggttcccggaaccgggggttaaaccgacggtaaaccggttcgaacggtaacggttaacaaacccggtaaaaccgtcgttacgggtacgtacccggtacaaccttaccggtaacttcccgg

SEQ ID NO: 163161 - DNA, 673 bp, Homo sapiens
  misc_feature: GYAE6OF01AUR4N.39.27.C05.1.454.CMB.1.raw
  modified_base (249)..(249): a, c, t, g, unknown or other
  misc_feature (249)..(249): n is a, c, g, or t
  modified_base (266)..(266): a, c, t, g, unknown or other
  misc_feature (266)..(266): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgtggagacagagtcaccatcacttgccggccagtcagagtatagagctggtgctggtatnagcagaaacgaggaacnccctaagctctagactgtatgatcgcctacgtagtttagaaacggttcgggtacccaagttaccgaaacggttcccgcgggtactaggtacggtacgtacggtaggggaacctaaggtaaactttaccgaacttacctacccgaaccgtaataccgaacgaccgtacgccccgttagaccgtaacggccgtttacgaacgttagttaacttttacggaacttaaccgttttaacgttaaccgtaaccggaaccctaaacgtaagttaaacttaaagtttaacgttttacgttaaccgttaacgttacggttttaccggaaccggtaacggggaacctaaaggtccgttaggaacgtacgtaaacgaaaacgtacttaggacggtacaggaccctaacgtagttaccg

SEQ ID NO: 163162 - DNA, 804 bp, Homo sapiens
  misc_feature: GYAE6OF01DXD25.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctccgtggggctcctgctgctctggctcccaggtgccaaatgtgacatccagatcgacccagtcctccttccacccttgtctcgctacttcgtggttaggagacgagtacgtcaccatcctacgttcggcccggccagtcaggtagtattaggtacgtcgttggttcggccttagggtaactcgagaccgaaacggtaaaaccggaacggggtaaaacctacccccggtaaagtccgttacccgtaggttaagttaggtaacgtacggtaacgtccgtacccgtttaacgtaagggttttaaacggtaaaaacgggttccggggtaaccctaaggttaacccggtaaacgggtttccccgggacgggtacctaaggggttacggtacgttacgggtacgggaaacgtacgtaaaactttcccgtaaccgttcctaaccgtaacctacttaccgaacgtccgacgtcccgtagacctcgtaccttagtagtttagtttacgtttacgtacttaactttacgttactacgtaacctaaataagttaacttaacgtttaacgtttacgttacgttaaccgtttacggtttaaccggaacggaaccggtaaccgtaaggtaccggtacgttaacgtaaaccgttaccggtaaaaccgtacgttaggtacgggtacttaccgacttaacccgttcgttacccgg

SEQ ID NO: 163163 - DNA, 397 bp, Homo sapiens
  misc_feature: GYAE6OF01B1SMI.39.27.C05.1.454.CMB.1.raw
  modified_base (200)..(200): a, c, t, g, unknown or other
  misc_feature (200)..(200): n is a, c, g, or t
  modified_base (370)..(370): a, c, t, g, unknown or other
  misc_feature (370)..(370): n is a, c, g, or t
  modified_base (373)..(397): a, c, t, g, unknown or other
  misc_feature (373)..(397): n is a, c, g, or t
tcagtcgcactagtcacgaccggtgctcgatttagacgcgatcgaagggtttgggtgcccaagctgctggagggcacggtcaccacgctgctgagggagtagcctgaaggcctcggacaccgccatgtattactgtgcgagacatggtgatattagtgttattcctcgtggggccagggaccctggtccaccgtctcctnacgcctccaccgagggcccatcggtccttcccctggccaccctcctacaagcgccaccgtcggcggggccacgagccggcccgtgggctcgtccgtcggaccaaggaccttaccttacccacgtaggtcgcgtacgtggacggccgggcgtcggacaacgggcacaagtngcnnnnnnnnnnnnnnnnnnnnnnnnn

SEQ ID NO: 163164 - DNA, 692 bp, Homo sapiens
  misc_feature: GYAE6OF01BR1N6.39.27.C05.1.454.CMB.1.raw
  modified_base (101)..(101): a, c, t, g, unknown or other
  misc_feature (101)..(101): n is a, c, g, or t
  modified_base (277)..(277): a, c, t, g, unknown or other
  misc_feature (277)..(277): n is a, c, g, or t
  modified_base (640)..(640): a, c, t, g, unknown or other
  misc_feature (640)..(640): n is a, c, g, or t
  modified_base (686)..(686): a, c, t, g, unknown or other
  misc_feature (686)..(686): n is a, c, g, or t
tcagtcgcactagtcacgaccggtgctcgatttagacgcgatcgaagggtttgggggagtcagactcagtcaggacacagcatggacatgagggtccccgntcagctcctgggctcctgctgctctggctcccaggtgccaaatgtgacatccagatgacccagtctccttccaccctgtctgcatctgttggagacagagtcacatcacttgccggccagtcagagttatagagcgttggtcgccgtggtatcgagacgaagaaaccgaggaaccncccctaagcctccgtgactgtatgactcgtcctacgtaaggtttacgaaaggtcgggtaccctaagtaccggtaacggttcccggacgggtagtacggtagtacgttcggtacggggaactaacggtaacttccgaacttccgtaccaaccgtactaccgaacgtacctacggtcccgtacgtaccgtacgtcgttacggtacgtttaggtttaactttacgactttaaaccgttttacgtaacctaccggtaacctaaacgttaagtttaaacttaacgtttaacgttttaccgtttaccgttaaccgtttacgttttaccgggaacccggttaacgggaaccctaaggtaccgtaggtaanaaccgttaacgaaaccgttagtcggtagtctaccaccgtaccgttnttaccg

SEQ ID NO: 163165 - DNA, 786 bp, Homo sapiens
  misc_feature: GYAE6OF01EE19P.39.27.C05.1.454.CMB.1.raw
  modified_base (196)..(196): a, c, t, g, unknown or other
  misc_feature (196)..(196): n is a, c, g, or t
  modified_base (780)..(780): a, c, t, g, unknown or other
  misc_feature (780)..(780): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttgganacagatcaccatcacttcgccggccagtcagtagttattagtagcgttgggttcggccgttaggtatcgagaccgaacgaaaaccgaaggggaaaccgacccccttaaaggccttacccgtaggtaacgttggttaagttggaacgttccgtacccctttaccgttaagggtttttaacgggaaaacgggtttccgggggttacccctaagttaccggtaaacgggtttccccggacgggtaccgtaaggttagggtacgttccggtacgggaactaacggtaactttaccgaccttcctaccgaaccctaagttaccgaaccggaccacggtacccgttacggaccgtacggtacccgtagtaacgtttacggtttaacgtttttaccggaaccttttaaacgttttaacgtttaaccgtaccggtaaacccctaaacgttaaggtttaaacttaaacgtttttaggttttaaacctttaccgttaaccgtttaccgttttacgggacccggtaacggggtaacctacggtacgtagggaactacgtaacaaaaccggtgtacggtcgactaccgactacgtnttaccg

SEQ ID NO: 163166 - DNA, 549 bp, Homo sapiens
  misc_feature: GYAE6OF01BYZXS.39.27.C05.1.454.CMB.1.raw
tcagtcgcactagtcacgaccggtgctcgatttagacgcgatcgaaggggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggcagtcagagtattagtagctggttggcctggtatcagcaagaaaccgagggaaacgcccctaagctcctgatgtatgatgcctctagttagaaagtgggtacccatacgaaggttccgcggcaggtggactcgtaggacagtaattcactctacaccatcagcacgcctgcacgtcctgattgtatttacgacttaactttattactacgacctaactaagtaattaattagtttacttacgttacttacgtttacggaccgtaagggaccaaggtcgtaggagtaactacgaaacgtaacgtcgtacggtactagcctacgtattcg

SEQ ID NO: 163167 - DNA, 589 bp, Homo sapiens
  misc_feature: GYAE6OF01BFK71.39.27.C05.1.454.CMB.1.raw
  modified_base (583)..(583): a, c, t, g, unknown or other
  misc_feature (583)..(583): n is a, c, g, or t
tcagtcgcactagtcacgaccggtgctcgatttagacgcgatcgaagggtttgggggagtcagactcagtcaggacacagcatggacatgagggtcccccgctcagctcctggggctcctgctgctctggctcccaggtgccaaatgtgacatccagatgacccagtcctccttccaccctgtctgcatctgttggagacagagtcaccatcacttggcccgggcagtcagtagtattagagctggttggcctggtatcagcagaaaccgagggaaacgcccctaagctacctgtatgtatgatgcctccagtttagaaaagtcgggtacccagtcgaacggttccgcggctagtggatcgtgggaactaaggtaacttacgactcgtactacccaattcagaccagtccctgacaacgcctagattgtagttttcgacttaacgtttaacttactacgaaccaaataacgttaattaaattaacgttactttacgtaacttacgtttacgggaaccgtagggaaccgtaagtacgtaggagtaactacggaaacgtaacgtgtacggacgtagcctaacgtnttaccg

SEQ ID NO: 163168 - DNA, 892 bp, Homo sapiens
  misc_feature: GYAE6OF01BTEWG.39.27.C05.1.454.CMB.1.raw
  modified_base (101)..(101): a, c, t, g, unknown or other
  misc_feature (101)..(101): n is a, c, g, or t
tcagtcgcactagtcacgaccggtgctcgatttagacgcgatcgaagggtttgggggagtcagactcagtcaggacacagcatggacatgagggtccccgntcagctccgtggggcctcctgctgctctggcctcccgaggtcgccaaatgtgacataccgagatcgaccctagtcctccttccacctgtctagcactcgtaggtgagtacagacgtaccacctactaccgtacgttcggccccgggacctaggtaccgaaggtaagtttaagttacggaggtccgttgggttcggcccgttaggtaattccgaaggtaaccgtaaacgggaaaaaccccggtaacggggtaaaacccgtaaccccccgttaaagccccggttaccgttaggttaacgttacggtaagttacggtaacgtcccggttaaccccgttacccggttaaagggttttaaacgggtaaaaaccgggggttcccgggggttaacccctaacggtttacccggttaaaccgggggttacccccggtcggggttaaacccggtaacggggttaaccgggttaacggttaccgggtacggggaaactttaacggtaaacctttaccgacccttttacggaccctaaccgtactaacccgagtaccgaccggtcgtaccgtacgaccgtacgtacgtagtacgtttacgttacgtaactttacttacgttacgtaccgtaaccgtaaataacgttaacgttaacgtttaacgtttaacctttaccggttaacgttaccggttttacggaacccgggtaacggtaaccgtaacggtaggtaacgtaaggtaaccgtaacgtaaaccgtgggttaaacgtcggttacccggtaagcctaaccgttcgtttacg

SEQ ID NO: 163169 - DNA, 622 bp, Homo sapiens
  misc_feature: GYAE6OF01DFR3I.39.27.C05.1.454.CMB.1.raw
  modified_base (101)..(101): a, c, t, g, unknown or other
  misc_feature (101)..(101): n is a, c, g, or t
  modified_base (197)..(197): a, c, t, g, unknown or other
  misc_feature (197)..(197): n is a, c, g, or t
  modified_base (617)..(617): a, c, t, g, unknown or other
  misc_feature (617)..(617): n is a, c, g, or t
tcagtcgcactagtcacgaccggtgctcgatttagacgcgatcgaagggtttgggggagtcagactcagtcaggacacagcatggacatgagggtccccgntcagctcctggggctcctgctgctctggctcccaggtgccaaatgtgacatccagatgacccagtctcccttccaccctgtctgcatctgttgganacagagtcaccatcacttcggccgggccagtcagagtattagagtcgtggttggccgtaggtactcagacaacgaaaccgagggaaacgcccctaaagcctcgtagtatagtatgatcgtcctacgttaagttaaggaaacggtcgggtaccctagtacgtacggttccggacggtactaggtcggtatcgtacgggaacagttaacgtcgtaaccttccgtactacctaataccgagacctacgcctgctacggtcctaggaacttgttaactttcgtacttaacctttattacctacgaacctaaagtagttaaattaacgttagtttacttacgttaacttcggtttaccggaccggtaagggaccctaggcgtaggaagttacaaccaaggtactcgggtatacgtgtacccagtnttccg

SEQ ID NO: 163170 - DNA, 796 bp, Homo sapiens
  misc_feature: GYAE6OF01AYW2N.39.27.C05.1.454.CMB.1.raw
  modified_base (102)..(102): a, c, t, g, unknown or other
  misc_feature (102)..(102): n is a, c, g, or t
tcagtcgcactagtcacgaccggtgctcgatttagacgcgatcgaagggtttgggggagtcatactcagtcaggacacagcatggacatgagggtcccccgntcagctcctggggctcctgctgctctggctcccaggtgccaaatgtgacatccagatgacccagtcctccttccaccctgtctgcattctgtggagacagacgtcaccatcacgttcggccgggcagtcagtagtattagtagtcgttgggtcgcgttggtatcgagacgaaacgaaaccggaaggggaaaccaccccgtaaagccttacgtagtagttagtagtacgtagttcggtaccctttacgttaaaggtttaacggtaaaacgggttccggggttaaccccaacggttaccggtaaccgggtttcccggacgggtacgtagggttacggacggttcggtaacgggaactaaacggtaacttctaacccgttcctaaccaacctagttccgaagtaccacgtccgtagacccgtacgtacctagtacgtttaagtttacgttacgtaaccgtttaacttacgttaaccgtaccgtaaacctaaagttaacgttaactttaacgtttaacggttttaacctttaaccgggtttaaccgtttaccggtttaccgggggaaaccggttaacccggggaaaccgtaacggggttaacggttacgggaaaccgttaaacggtaaaacccggtaaaacggttcgtttaccgggttaggaacccgttaggtaaccctaaccgtttccgttacccgg

SEQ ID NO: 163171 - DNA, 698 bp, Homo sapiens
  misc_feature: GYAE6OF01B8XQI.39.27.C05.1.454.CMB.1.raw
  modified_base (199)..(199): a, c, t, g, unknown or other
  misc_feature (199)..(199): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtcctccttccaccctgtctgcatctgtggagacngagtcaccatcacttcgccgggccagtcagtagtattagtagcgttggttggccgtggtatcgagcaacgaaaccgagggaacacccctaagtcctccgtgactgtaatgtatcgccctacgtaggtttaggaaaacggtcggggtaccctaagtaccggtaacggttccggcggtcgaggttcggacgtcgtacgggactagtaacttcgtacctccgtacacctagtcaacggccaacgtcccgtacgaccgacgtccgtagacttgttacgttttacgacctttaactttacgttacctacgtaaccgtaaactaaggttaaactttaagtttaacgtttacgttttacccgtaacgtttaccggtttaccgggaacccggtaacggggtaaccccgaaaggtcccggttaagggtaacgtaacccgtaaacggtaaaacccggtacggtttggtaccgggtacgtaccgtaccctaaaccgttcgtttaacccgg

SEQ ID NO: 163172 - DNA, 706 bp, Homo sapiens
  misc_feature: GYAE6OF01CMQA4.39.27.C05.1.454.CMB.1.raw
  modified_base (235)..(235): a, c, t, g, unknown or other
  misc_feature (235)..(235): n is a, c, g, or t
tcagtcgcactagtcacgaccggtgctcgatttagacgcgatcgaagggtttgggggagtcagactcagtcaggacacagcatggacatgagggtccccgctcagctcctgggctcctgctgctctggctcccaggtcgccaaatgtgacatccagatgaccagtctccttccaccctgtctgcatctgtggagacagagtcaccatcacttcgccggcagtcagtagtattagngcgtggttcggctggtatcagacgaacgaaaccgagggaaaccgacccctaaggcctcctagattcgtatgtactcgcctacgtagttagaaacggtcgggtacccagtccgtacggttccggcgtacaggtcgtatcggtaggaactaggtaaacttctacgtcctaccacgtactacgacgacacgtcgtacgcctacgtcctaggtattggtttattttacgacctttaaaccttttaagttaaccctacggaaaccctaaacgttaacgttaaacgtttaaacgtttacgttttaaactttcccgggtttaaaccttaccggggtttttaccgggaaacccggggtaaccgggtaaacccccgtagggtaccggttaagggtaaaccgttaaaccggttaaccggaaaaccggtacggtttcggtacgggttaacccttacggaaccctacccggttacttacccgg

SEQ ID NO: 163173 - DNA, 1036 bp, Homo sapiens
  misc_feature: GYAE6OF01C1515.39.27.C05.1.454.CMB.1.raw
  modified_base (102)..(102): a, c, t, g, unknown or other
  misc_feature (102)..(102): n is a, c, g, or t
tcagtcgcactagtcacgaccggtgctcgatttagacgcgatcgaagggtttgggggagtcagactcagtcaggacacagcatggacatgagggtcccccgntcagctccgtgggccttcctgctgcctctggcctcccgaggtcgaccctaaatggtcgacatcccaagacgtcgacccctagttcccttcccttacccacccttggttcctgacctagttccgttagggttacgggaacgaccgtaaggtacgtacccaacccgtaacgttacccttaaccggtttcccgggaccccggggtaccctaacggttaccgaaggtaacgttttaagtttacgggtaaggtcccggtttagggttccggtacccgttaggttaccgtacaacggtaaccggaaacgaaaaccgggtaaacggaaacccgtaacccccgtaacgtaccgtacccgtaggtacgttagtaacgttaccgtacgtacccggttacccgttaaccggtttaaagggtttaacgggtaaaaccggttacccgggggttacccctaaggttacccgtaaccgggtttcccgggacgggtaccgtaggttacggtacgttacccgggaggtaaccgtaaaggttaacccttccgtaaccgtttacccctaaccgtacccttaaggtacccaccggtaccgtacccggtcccgtacggaccggtaccgtacggtaccgttaacgttacgggtttacgttttacccgtaaattttaacccggttttaaccctaccggttaaccctaaacccggtttaaagtttaaccgtttaaaatttttaaacgggtttttaaacgtttacccggttttaaacgtttttaaacccccgggttttccggggtttaaacccgggtaccccggggttaaaacccggaaacggttaaccggtacggggtaaccgtaaacgggtaaaccttaaacccggggttaaaaccccggtacggttacgggtaccggtaaccccgttagaaaccccctaggttacccggttttaac

SEQ ID NO: 163174 - DNA, 761 bp, Homo sapiens
  misc_feature: GYAE6OF01DRSMW.39.27.C05.1.454.CMB.1.raw
tcagtcgcactagtcacgaccggtgctcgatttagacgcgatcgaagggtttgggggagtcagactcagtcaggacacagcatggacatgagggtcccccgctcagctcctggggcctcctgctgctctggctcccaggtgccaaatgtgacatccagatgacccagtctccttccaccctgtctgcatctgtggagacagagtcaccatcacgttcgccggccagtcagacgtattagtagcgttgggttcggtccgtaggtactcgagacaacggaaaccgaagggaaaccgccccctaagcccttccgtaggagtcgtatgtactcgcccttaccgttaaggtttacggaaacggttccgggtaccctagtaccgtaacgggttcccggaccggtacgagggttacggtagttaccgggtagggtaaacctaggttaaactttccctaacgtttcccgtaacccgaaaccctagttacccgaaccggacccgtacgtacccgtgaccggtaccgtcgtaggtactttaggtttaacgttttacgtaaccgtttaaaccttttagttaacccgttacggtaaccctaaacgttaagtttaactttaaaggtttctttaacgtttacccgttaagtttcccggtttacgggaacccgggttaacgggaaacccgtacggtaacggtagggtaacctaacggtaaccgaaaaccgggttcgtacgggttccggtacctacgaacccgtacctcgtttaccg

SEQ ID NO: 163175 - DNA, 743 bp, Homo sapiens
  misc_feature: GYAE6OF01AHCR2.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccgaggtgaccaaatgtgacactccagactcgacccagttcctcccttcccacccgtgtctgctactcgtggttggagacagacgtaccacctatcctacgttcggcccgggtacctagtccgtaggtaacgttagttacggtacgtccgtttaggggttccggtacccgttagggtactaccgaaggaccgtaaacggaaaaccggaacgggtaaaccgtacccctaagtcccgttacgtagtagtagtacgtgtacgtccgtccttaccgtaggttaacgaaacgggttccggtacctacggtccggttaacggtccggacgtacggtggttaacggtacttcgggtacggtaactaacgttacttacccaccgtctaaccctacacgttacgaacgtccgacgtccgtacgacgtaccgtcgtagtacgttgtttaacgttacaacgtttactttaactcgtaccgtaacctaagttaacggttaattaaccgtttacgtttacttaacgttacgtttaccggtacggacgtaaccggtaacgaggtcgaacgtacgaacgtaccgtaacgttggtacgacgttcccgtaacgactacgttcgttacg

SEQ ID NO: 163176 - DNA, 680 bp, Homo sapiens
  misc_feature: GYAE6OF01D09NS.39.27.C05.1.454.CMB.1.raw
  modified_base (101)..(101): a, c, t, g, unknown or other
  misc_feature (101)..(101): n is a, c, g, or t
  modified_base (199)..(199): a, c, t, g, unknown or other
  misc_feature (199)..(199): n is a, c, g, or t
tcagtcgcactagtcacgaccggtgctcgatttagacgcgatcgaagggtttgggggagtcagactcagtcaggacacagcatggacatgagggtccccgntcagctccgtggggcctcctgctgctctggctcccaggtgccaaatgtgacatccagatcgacccagtcctccttaccacctgtctgctatctgtganacagactacacatcactgaccggccagtcgaagtagtattacgagtcgttaggttggccttaggtatcgaacgacgaaacgaaaccgaacgggaaacacccctaagtccttaccgtagtactaggtataggaactcggtacctaccgtaagtttaggaaaacggtcgggtacctagtacgaacggttccggacgacgtaggtcgaagttcggtaaggaacaagtaactccgtaactcgtaaccacaacttcgaagacgtacgccgtagaaccgacgtccttagtactaggttacttttacgaaccttaactttacgtacgactaaccgtaaacgtaagttaattaaacgtttagtttacgtttaacgtacgttacgtttccggaaccgtaacgggtaacctaaaggtcggtaacgtaaagtaccgtaaacgaaaaccgttagtacggtacggtacttaccgaacctaccgtacgtttaccg

SEQ ID NO: 163177 - DNA, 753 bp, Homo sapiens
  misc_feature: GYAE6OF01CRU8M.39.27.C05.1.454.CMB.1.raw
  modified_base (289)..(289): a, c, t, g, unknown or other
  misc_feature (289)..(289): n is a, c, g, or t
  modified_base (360)..(360): a, c, t, g, unknown or other
  misc_feature (360)..(360): n is a, c, g, or t
tcagtcgcactagtcacgaccggtgctcgatttagacgcgatcgaagggtttgggggagtcagactcagtcaggacacagcatggacatgagggtccccgctcagctcctgggctcctgctgctcgtggctcccgaggtcgaccaaagtgtgacactaccagactcgaccctagtcctccttccaccctgtctgcattcgtggtgacgacgagtacgtccactatccgtacgttcggccggacacgtacagtagttacttagagtcgttcgggtcgtccgttaggtacncgacgtaacgaacgtaaaaccggaaggaaaccctaccccgtaagtcccgttaccgtagtaattacggttanacggtacttccggaccgtttaaccgttaagggttaaacggtaaccgggttcggaaccctagtaccggttaacggtcccggacggtcgtaaggtcggaacgttaccggaacgggtaaccctaagttacccgttaccgtaccttaccgaacctaccaacgtacgtaccgtaccgtaccgtccgtacgccgtacgtaccgtagttagttacgtttactttacgtaactttaaccgtttaacttaacgtacctaactaacgttaagttaacttaaagttcgtttaacgttacgtttaacgttaccgttaccggtaaccggtacggaaccgtaggtaccggttaagacgtaacgtaaccgaacgttacgtacggtctacgtacacgtacctcgttacg

SEQ ID NO: 163178 - DNA, 763 bp, Homo sapiens
  misc_feature: GYAE6OF01CXWY9.39.27.C05.1.454.CMB.1.raw
  modified_base (225)..(225): a, c, t, g, unknown or other
  misc_feature (225)..(225): n is a, c, g, or t
tcagtcgcactagtcacgaccggtgctcgatttagacgcgatcgaagggtttgggggagtcagactcagtcaggacacagcatggacatgagggtccccgctcagctccgtggggctcctgctgctctcggcctcccgaggtcgaccaaatgtgacatccagtatcgacctagtcctcccttccaccctgtctgctattcgtggtaggacacagactaccacctntcctacgtcggccggtcagtcgagtagtattaggacgtcgttggtacgtcgtagtacacgagacgaaacgaaacggaacgggaacctacccgtataccgtacgtagtacgttgtactagtaccgtcgtacccttacgttaaggttaacgggtaaacggtccgggtttaaccaggttaaccggttaccgggtccggacgggttacggtacgggttacggtacgttacgggtaacgggtaaacttacggtaaacctttacccgacttacccgtacctaacgtactaccgaacgtccgtaccgtcgtacgaccgtacgtaccgttagtacgtttacgtttaacgtaccgttaacgtttaactttaacgtactaacggtaactaaacggttaatttaacgttttaacgttacgtttaccgttacgttttaacggtacccggttacgggaaccggtaaacggaccttagtacggtaacggaacttaactaaaaccggttacggtaagccggttacgacccgttagaccctaagttccttacgg

SEQ ID NO: 163179 - DNA, 480 bp, Homo sapiens
  misc_feature: GYAE6OF01DQNNH.39.27.C05.1.454.CMB.1.raw
  modified_base (416)..(416): a, c, t, g, unknown or other
  misc_feature (416)..(416): n is a, c, g, or t
  modified_base (437)..(437): a, c, t, g, unknown or other
  misc_feature (437)..(437): n is a, c, g, or t
  modified_base (440)..(480): a, c, t, g, unknown or other
  misc_feature (440)..(480): n is a, c, g, or t
tcagtcgcactagtcacgaccggtgctcgatttagacgcgatcgaagggtttgggtgcccaagctgctgggagggcacggtcaccacgctgctgagggagtagcctgaaggcctcggacaccgcatgtattactgtgcgagacagtggtgattattagtggtttattcctccgtggggccacgggaaccctggtcaccgtctcctcacgcctccaacccgaacggggccccagttcggtcccttccccccgtggccctaacccctccctacccaaacggacgacccgtaacctcgggttacggggggaccaaacgtaacggcccggcccgttgggctacggcccgttagggtaccaaagggaccccttactttccccaacgttaggtcggccggaagttaggacggggcgggaccngggacgaacggtcggaacaanagnnnnnnnnnnnnnnnnnnnnnnnnnnnnnnnnnnnnnnnnn

SEQ ID NO: 163180 - DNA, 761 bp, Homo sapiens
  misc_feature: GYAE6OF01CGQ8Z.39.27.C05.1.454.CMB.1.raw
  modified_base (635)..(635): a, c, t, g, unknown or other
  misc_feature (635)..(635): n is a, c, g, or t
  modified_base (741)..(741): a, c, t, g, unknown or other
  misc_feature (741)..(741): n is a, c, g, or t
  modified_base (753)..(753): a, c, t, g, unknown or other
  misc_feature (753)..(753): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccgaggtgaccaaatgtgactactccaagactcgaacccctagttccttcccttcccacccgttgtcctgcctattcgtggttaggacgaacaacgtacgtcaaccctagtcctacgttcgggccccggtactacgtcaaggtacgttagttaaggtacgtcggttgggttcggtacccgttaggtaactccgaacgtaccgaaaccggtaaaaccggaacggggaaacctccccgtaaaggtcccttacgtaggtagttcgtagtacgtaacgttccgtaccccgttacggttaacggtttaacggtaaaaccgggttccggggttaacccctaaggttaaccgggttaaccgggttccccggacgggtaacggttaccggttagggacgtttacgggtaaccggtaactaacgttaccgttaccgacgtttaccctaccacgttaactcgaaccgtcgtaccgtcgtacgacgtcgtctagtaccgtagtttacccgttanacctttaacttcgtaccgtactaaccttaataagttaactagttacgttacgtccttacgtacggttcgaaccggtaggactagtcggataacgactaacgacgtntgcgtcactacncgttatcg

SEQ ID NO: 163181 - DNA, 652 bp, Homo sapiens
  misc_feature: GYAE6OF01A270L.39.27.C05.1.454.CMB.1.raw
  modified_base (645)..(645): a, c, t, g, unknown or other
  misc_feature (645)..(645): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtcctcctcccacctgtctgctatctgttggagtacagacgtacacccatccacgttcggccgggcagtcagtagtattagacgtcgtggtcgcgtgtactcgacgacgaaggaaaccgtaacgggaaccgtacccctaacgtcctccgtagtacgtgtactgtactacgcccttaacgtaggtttaacgaaacggttcgggtacctacgtaccgtaacggtccggacgtcgaggtcggacgtcggtaggacctaagtacgtctacctcctacaccgatacgagacctacgtactgaccgtcggacctagtacttcgttacttacgtacttaacttacgtactacgtaacaacggtaataagttagttacgttacttacgtacgttacgttacgggaccgtaacgggtaccgtaacggtcgtacggaactacgtaaccgtaaacgtcgggttacgtaccggtacctacggtacctaccgtnttacccg

SEQ ID NO: 163182 - DNA, 883 bp, Homo sapiens
  misc_feature: GYAE6OF01AR4BN.39.27.C05.1.454.CMB.1.raw
  modified_base (100)..(100): a, c, t, g, unknown or other
  misc_feature (100)..(100): n is a, c, g, or t
  modified_base (151)..(151): a, c, t, g, unknown or other
  misc_feature (151)..(151): n is a, c, g, or t
tcagtcgcactagtcacgaccggtgctcgatttagacgcgatcgaagggtttgggggagtcagactcagtcaggacacagcatggacatgagggtccccnctcagctccgtggggctcctgctgctctggctccaggtgaccaatgtgacntaccagatcgaccagtctccttcccacctgtctgccattctggtggacacaggatccaactactcctacgtccgggcccgggactagtacaaggtcgttatacggttacgtcggttacgggttcggccgttagggtaccgtacgtaaccggaccgaaaccgggtaaaaccggaacggggtaaacccccgtaacccccgtttaaacgggtcccgttaccccggttaaggtacggtttaccggttaaggtagggttaacccgtcccggttaccccgtttaaaccggtttaaaggggtttaaaacgggtaaaaacccgggggggttttccgggtaaccccgttaacccggttaccgggggtaaaacccgggttttccccggggaacgggtaacccggtaaggggtttacgggaccgggtttaaccgggtaacgggtaaacccgttaaagggtaccccttttaacgaccccctttagtacccccgaacgtacaccgtacggaccgtaccgtccgaccgtcgtaccgtcttacggtagtttacggttattacggtaaaccttaagtttacgacgttaaccgtaactacgtaagttacgttaagtttacgtttaccgttaacttacggttacgttaccggtacgaaccgggtaccgtaacggttacggtactaacggtacctaaacgggacctacggttacggtacggaccgttacggcttaaccgtcggtttaaccg
